United States Patent 11,242,544 (MICROBIOMES AND METHODS FOR PRODUCING MEDIUM-CHAIN FATTY ACIDS FROM ORGANIC SUBSTRATES) - sequence listing, part 5

SEQ ID NO: 345 - DNA, 141207 bp, Unknown
  Metagenome-assembled genome
gacccatttctgcctagatgccgacagcccaaactcggcgagttgctgttcctatattgtgtatattgcgaacgttgcgaacacgcatttccttattgagatgctctgaagtctaccccccccccccgaaaatgcaagctaaatctcgcgtattgaggaagaattttttgatcacatggcagcgggctttcaagaggataggggttttgtatatgatcgatagcaagttcacgaaggaagagtgtatgaggcactcgtgggaaggtaagaggccaggtggggatccctgccttccttgccggctataagcgcatcgagcggacgatctagcactggaagaaagccagcatgaagggcaccctcacgaagatggatacaccccaggccaggcaccgcgacaaggtaaagaccatcaggcagaagaagcaggacgtcgtgacaaggcagaggacctccatgccgcgtgagaagaccgagaggaaggccctttaaggcgcaggtgaaggctttagaggctcttgacacaccggcgagcaggacccgttctttaacgtgagcgcagcctataaggcgctcgaggtctcgaggcgcggctacttacgagtgggtggtcacagccctgaagcgggccgagcgcgaggatggcgacctcacagcgaaaaagcaggtgcaggcggccttctccgcccatggcttcaggaagggctcgcgccagatcaccgacagccttgttccgagcagaaggtcaggataaggtgcaagaaggtgcagcgcatcatgggcaagttcggcatcgtgtggggcaggaagtgcaggaggccctaccacccgatcgggcaggacagcaagccccgggtagcgcccaatgctgcggacagaaacttcaggagcgaagatcccttgaaggtcgtctccaccgacaaacacctacctcctatacagggacgagagctccctctacatgtccgacatccttaactgtaagggtgatcgtgcttcttgcctacaagtgcttaacctcgatggaggagaagctggtgttcgatacataccgatcaattcaaaaggttcgagcttcccgacgacatctgggcatactcaaaccagggcatccactataccgcaagggcctacagcgacgagctcaggcagcttggggcccgcctgtcgatgtcgaggcggacatgttgctggaacagtgcctgcatcgagaacttctgggagcaggtgggagagacagcccatctcctggcagagaagatcatggaaagggtcgacgaatatgtcagctactacaacaatctcgggagacagggacgcctgggctggctgacccccttagagtatgcaggaaggctcactgcctatctgtgcggagttcagggtccacctcagtcagggcaggatcgctcgtctactcgaagccgtacgtgaacctcgatcccgtttgcatgcacgccatgctcggagcagttcatgcgcgcagggcggtattcgatccagcatttcgccctgccgaggtccatgacgcgccagcgccgcggctctatatggacatggcaggcgcatctcctgccacatacggggcagcgcagcgcctccttactgtacggcctcgcgaagaccacgatgccacatccccccatgcgggccccggtcacgaccatcttcacctcagtgcccagcgtagaatctgctccatgcgcagtcctttctgcggtccgagatacttttggtgaagtcgaatctaggtcgtgaagcacaaaccttgccgaactcctctcgctttaaggctatggcggaatttcgcaagtgtcgttgcatctggcacctgcttttgcatgaggtctacgtgcacagaagcgccccccaggagtggcaatccaggatagcatctttaagttccctcgtcttaagagagcaaacatgacctaaagcaggctacatcctaaagctttgtctttgcagcgcgcacatgcctgacaagagcctgtcagtggtagctggtatctaccagtgcaatccagctatcccacacaacgattgcatccatccgctccaggaatgcctctcgcctggtctttctccttagaccttaggatttaaggtcctaaaagctcatctggctgtccatatctgccttttggatatgcaggaatgcgtggatgtagctataccatatccagaagacagataggtatctatgtgggtatgggcactgcgtggttcgagacattttgagccgatgtcatacagcgtgtggccccactggcctcatcgaggctaattaatcatcgtttccctagaggaaaaaagcgctggcaacccctcgcggagtcgcccttcccatatctgaatactttctgtaccgtagctggcgttatgccgaataggtacccacatgaactaccgaagagttttttcatacggcatacggtggaattcggcagaagtgtaaagcactgcatgctcaggtctctttgagcgtctgccacacataccaaactctcttcagaacaggctactgcgcacgagagcgacccaatagaaaggcccgcattgtggtctctccagcattggggatctcgatcgccacacgtttcatgcaatcttccaacgtacaggggccttcaaccgtcgtgagcacacagtcgatccccgcactgtagacagaagagaggtcatcttctctacctcccaccacagctatcacgggaaggttatgcttctttgcacgcttagctactccgatcggcgcttttcctttgactgattggttgtccatatggccttcaccggtaacgacaagatcgacagtatccatcttcgattcgatgccgatcaggtcaaggatcgtgtcaataccggacacgatacgagcgccgcaaaatacatgcaggcctgcgcctaagccgcccgcagcaccggcaccgggaacatcagtcgatacgcctgtcagttcctgttcgatgaggcgggcatacgaagccatccacacgtctacctcatgcagctcttccggtgcaatccccttctgtggaccgtacacgaagacagctccctccgaaccagtgaggggattggtgacatcactgagtgcggtaaactcactttcccggatacggggatctaatccggaagtatcaatctggcgcagatccttaagccctctgagaccgggccggatcggttgtccttcagcatcgaggaactttacgcctaaggcttgtgccattccccatccgccgtcactcgtcgcgctgccgccaagtccaataaggaactttcttgccccctgttcaagtgctgcttcgatcagctcaccggtaccataggtagaagctttaagcgcattctcattcgatttaggcatcagagttattcccgaagcctgcgccatctcgatcaccgcagtcttcccgtcacctagaagcgcatagggagcctgaacggaatcgcccagcggtccgtgcaccttctcggtatagcgtgtccccttacaggcggtgagcagggcttccaacgtcccttctcccccatcggcaatcaggtatttgagaatatgggcttggggcacaacccggcggattccctcttcgaggtagtcttccacctcacggctcatcgcagagcctttgaaggaatccgaagcaagcaagaccgtatagttcctcattgcccatccacctgtcttgtgtaacaagagtttctttatgccagtatagatacagaaagccccacccctcaacaacactgagagatgggaccttatgcgccctatgtcagcatctctattgctgcatcatgctcatcgagtcagtaaccgtattgatgatctgcgtaccggcattcgcttgacttctcggccaggtgaactcaattgccatcaaccgactattgttcacatactcacggatgtagtatccggtatccccctgccagtaactgaccacgaaccagttattgagcgtcgagatataggtataggtgatctggtgcccgacctgcgcctgatcaaacaacccctccagcgtcgatccatcggtattgggtctcacccaagcgtcaatctgcatcgaggtggtcgggtctgtcatggtcaatcccgtcttgtctgaattgacctcagaggtcataccggtcggcaaggttgcgctgaaaccatagtttgcgatggagagcgctccggtgttcgtgtcgtaggtcacgtcgtcggtcgaagccggctgatcggtttcttgctgatcggtcgtatcatcagtgcttgcggcattatcctgggatgtcgcatcctgctcttgggtctgttcctctgtctgggaagccccattcatattctgataaacatagacgctgacaccgatcgcaacgaccgccacaatgcagataattgcgataatacggttgcggtactgatagagatgggtacgggcttggccgtagcggtcaacgtcgtcgtaatatccggcaccgggctcgccttcgtggaccgcgccctccgcaagccgtgcgtgctcgtcgagcgttgagttctccggagcagcactgattggacggttggccgcatcccgattgatcatggcaggacggcgcgcaacgttgtgctctacatcccgttcctgctgtttgtagcccacttcgttcatgttggcttcatagtcagcacgggagactgccgtagtgtacgtcctttgggcatgctttccgctgccttcacgatgcttgtgccggcgggcgtaacgtttgtcgatcgactggtgcgattcaatcggcacctgcagaatcggcgtagcgccatgggccaacgaggggttgacggtcggaaccggctgttgccctactccgttatagggaagcggcgggcgcaccaccgtatgctccatcgcctcaggtgtccctgctgcattgtgacccaactgatctgccgtcatcggctgatcgttgggggaagggacctgcgcggagctcggggtacggggacgacggtgcgtaagggcacgcaggcggggcgactgagagccgtctgacatatgcacatgctttggctccgacgcctcctcggcaccttcatctttctcatctacgttttctatgttctcaccagtatcttcagacgccggctgcccctgctcctcagcttgaggtacaggctctgccaccggttctgctgcaggctcttccggtgaagcctctgcattatcgaattccgctggcttgggagttgaggaatccacagcgccagtttcaggctctgcgttgtcctctgccggctcggtatcagctggctcgttctctccagcatcctgaggagtatcttccgccttcacctcatcgatctgtgaaggctcctcgggtaccgcttcagcgtcctctttcggttttgtatcgtcaggcgtctgagcctgtccttcctctgactgacccatcgtttgaggcaagggatttcgctctatgcgtgctccacaggaaggacaaaactttgaatcgtcaggaattgaggcaccgcaatgcggacaaagcatgtggtcgctcctccaatcctctctgcccagtatgtatctgttgtagaatacaccacacttatatatttcgatggtgcacctatctgccttcccatattttacatgctcaaaacctgctcaaacgttttttgccgccgagctacaaaaaagtacacgaacttttacttactcttaatcaagcagcggttctgagactaacggtgtatacgtgagcacgttgtcaacccgatgggaaagcatcaagtacaggtgcgtgtgcgtactttgatcaggctttagcactgctgaaatccgctgtttcagctcctcgacgctctgatccttcttcagtctgacactccgagcgagagtgatgtgtggcacaaagggccgctgttccaacacaaatccacgctgggtgagttcctcggtaaggtgactctgcagatgtttcagattctcgttcttctcaaggccttcccagacgatcagttgatggtgacagggaaagacaccaggttctcccagcgtactcttcacggtgtggcactgcgcggccgtcgctttgagcgcctcacatgcccggttatatccctgctcatcctgcatccccaagaaggcaagcgtcagatgcagattctgtggaagcatcggacgggctttgtccgcaaaagctacgacggtatcttccgccttaaccaaggtctgccgtgtcgtctcaggaaaacgcaacgcgataaagagtcgacgcttcggtacgggttcatccatgtgagtcaccctccctcgctatagaatattacaagtatgccttgccgctgatcttttcagtgaccatgacaactatccttctagcttcccttcaacccagattcttctgagctggctctattatcctccgttaccacaaaagctcagctcatacacaatgacctgtcattttgacggacggcaaaagatcaacagatgctgcattgagcgccaatggtcgatcgcataaccacgctcagtaaaattgatagactcttttagatcctcaagctaattctctgcgcaccaccacacgaaggttccgagggcagcctccgcttcagttgccttttggatgaacttcccatccgctctgatttccccaaagaggcagacgataaggggagtgccatacttccttgcaaacgaccacacagcctttgaatattcttatgatggcagaccgacgataaggtcaatgtggcgggccagcgcaggcgctctccccaatacccataggggatctcggacatttttccggatccaggctgcatatgcgcagctaaggtccctcctgtgctccctgagcgtcctccacccacaagtcacgcttgagcttagccaaacgataccactcgatgtagctgtcaagacagctcttgaactcctcgaacatgctgtccgtccagtccatgccggaaaagaagccgcccttgggcgtgccgaagaagccttctaatgcgtcgcatgcgattatgtgctgaacgggtgccggacagcaggcggggaagtttgaccatccggcgcccagcatataacgtgtttctctgaagggattcaaggaagtcgaggatatccccctgcgctctgtagcgcctgcacccggattcctgccggctgtggcaaggcccttcgccagcgcatcctcctcatatattctttctgccacttctcacgcagtggccgcgctcttttcctgtagtcgcgaatatgggataaagggcgtgcatggatcgcagggcacttggcgtgttctgctggagtttggctcttgcagacggctggcgcctttggcccgcagctggacgcgaattaggcaagatgtcgttaggcgatggatgtccccatgaggttgtgcctgcaaagaccagaggaaaaccttagcccctcagtcaagtaagaggtaggaggtagctgcatggtatatatcggcatagacatcgctaagcgcttctatgtgctgtcagccgtgggtgaggatggagggaccctcatcgagtcactcagatttgccaacagcgccggcaggcttcaaaaagctgctcgatcggctgaagaaggccggcatcggtccagagggcagcctgtctagtatgcaggccacagggcactactgggttgtcctgtttaacttcatggccgctcatggctacggcgttgcgcacgctcaagaccgatgcgatcaacgcagccatgatcgcagaccttatgcgctacaagcgctatgagcccttcgcgctgggcgagcggggagttgctcgcgcttgggcgcgctactacacgtcgcttgccgaagcgctcgaccatgctcaaaaaccgcgccacagccatcctcgacggcctgttcagcagctcgtttaggcccacctagcagacgctgctcgaacattgtgccacgccgcagcagacacactcaagcgacatgtgcacgctcgagtgcacactgaaggaagctttctgctccaactgtggccaaaagaaggccgaggagctgaaggccgccacgaaagcgtcggttgcagtcggcttcggttcaaagacgctcaccttcgagctcagactcttccatgaggagtctgagctcgtctgcagccagatcgacgaggtggaatttgaacttacccgcttgctcgacaaggcaagcggtaggtggctgctcagcgttttcggcatcgtcatcgcgctggcctcaattatcgcaggcgagatcggcgcgctgagcgcttcgatggtgcctatcaggtccttggcctgtgccggcatggaccctaccaaaagtaagtccggtaagagcgtggcatcgggtaaaagccatgtccaagcgcgctgcggcagatctcaggtgggccctcatgtaggctacagactgtgtgcgcagatacgacccataacttcggcgactactacgccaagagggaaggcgaagacaaaaagcaccactgcctagccctcgcaggtgttgctcgcaagctcatgggcgtgtgttctagccctcatgaaggagcagcgaccctgggagcccacggcaccatcaacccgaacatcttcaggagggcggcaagtagccttttctacatctgaatcgcgcttgcgctcccagcggggcgcgcgtcagcatgtctactctttatcccatattcacttctcaaggttcctatcgaaaatcttgggtttaccccttgactttaaataacaggtattcctgaggatgcagtcccgacagggaagacgttacagcgttatgcgctcattagagcatggacatgcccctttgcctgctgtccggcgcccgttcagcgcataatcgcatgtggtgcattagatgatatcttcggtagactcaagcatgaattcttttactgcctggattggagccacaccatacgcaacgaatttatgaatcagtttagtggctacatcacgtagtattgcaacgaaagaccaaaggaatcactcagccggatgagtcctttggaataccgcctgtcactgggtctagcgacctagattctccaactttttgggtccgcctcctatccaatgagaaccctatactgaagaacagtgtcttttaatcatccgtccttcagtatagagggcttgaaaggatagccatgttcaacgttgtgctcgtagaaccggagatccccgctaatacggggaatatcggccgtacctgtgttttagcaggtgcacgactccacctggctggacctttaggcttttcccttcaagaaaaagcgctgcggcgtgccggcctcgcctactgggaaagcttggatctggccgtctataatgactgggatgaattcgtacagaagaacccagtcgtggaacaggcactgcaggagaataccgccactactgcgcaggatgttgaggatatacatgtccacttactgactaaggcgggcaagcgtgtgtattcctcttccacctatcacgagggggactacctgatcttcggtaaagagagtgccgggctttcgagagacttgctttcagcgcatccctccctgtgtgagcgcatcccaatgcgtggggacgatgcgctcaagaatgcggatacgtggcatgagaccttcgacaatctccaccctgatctccaacgtgatatcgcaggcaacttcgtagatccccgagcgagtgtcgtcacgtccctcaacctctccaactctgccgcaatcgtgctctacgaagcgctgaggcagactggtttccaggggtgcgacatacaactctacaattgagggtacagagaaagcaaagtggggtatctacaccacaccggcacagggggaaaggagtacgatggcagagcgacacacgagtatgggaactcccctttgtccctaccagtcctgctcgtaccgtgccaccggtgactgttgcatgaaccacatccgacttttctcccatctggacagcggagctaagcgtgagctgatgcgctgcgcccaccagagcgactaccccaaaggctccgtgatcgtgcatgagagcgatccgatcgagtcgatcttcatcatccgaaagggccgcatcaagacctaccgcctaagcgaagacggcgaagaatacatcctcgatatcctacacgacggacaggctctatggcacggaatgtttttacaggatcacacctaccactacagcgctgcctgcctgactgaggtcagtgtgtgcagcatccgcagaacggactttgagtcattcatctccgcacatcccgaggtcgcgatgcacctcgtcgagacgctgagcaccgagctcgacgatgcggaggaaaagatcacgatcttaagcatccactcccccaagagccgcctagcgcgctatctgctccacagaaatgaccgttgtctccaccaggagatccatctgaggctcgatgagatcgctgcctcagtcaacctacgccctgagaccgtctcccgtatcctctccgcctttgagaaggatgggttagtcaaacgcatcggacgcgggcatctgaaagtgatcaaccgagctgccttagcccaagtcagcaaagaataatttttcgttacttgattttaatcatggaacgcacttccccttcttcgtagccttaaaggtgtaatgaatacgtagatgtggggagtgtaaatgatcggtcatatacattccgttgaatcgtttggttcggccgatggccccggggtccggtacctgatctttctgcagggctgtcccatgcgttgccgctactgccacaatccggacatctggaacttcaccggtggtaccgatatgagcgccgatgagctgctcgataaagctaaacgttaccgtgcctattggggaccggaaggcggcatcactgtctcaggcggcgaagccctctcacaggtcagctttgtccgtgagctctttgagaaggcccgtgtactcggcattaatacctgcctcgacacttcacttgctccctttaccaccaaggagccgttctacagcgagttccagaacctgatgcactcaaccgatctggtcctcgcagatatcaaacatatcgatccgattgagcaccaaaagcttaccggacatcccaacacaaacattcttgaagcactgcggtggctctctgaccacgacgtaccggtctggatccgtcaggtcttggtcccgggtatcacggacgtcgataagtaccttgagcgtacccgtgactttatcgccaccctgcacaatgtgaaacgcgtcgaagtgctcccctatcacaccctcggcatctacaagtgggatgcgctccatatcccctataccttacgcgacgtgaaacctccctccccgcaacgggttgagcgggcgcagcgcatcttatccgataaaccatccactatcgaggaggattagcaatggaaacagcagcatggaagggctttgccccggggctttggaccgacgaggtcaatgtccgcgacttcatccagaggaactatacgccgtatgacggcgatgagagtttcctcgcaggcccgactgaggcgacgatgaccctgtggaacaaggtacaggatctgcagaaagaggagcgcaaacgcagtggtgtcctcgactgcgagactgaagtcgtgagcggcctcaccgcctacggcccgggctacatagatcctaaggccaaggacctcgagcgcatcgtcggcctccaaaccgacaaacctctgaagcgtgcctttatgccctacggcggtatcagaatggctgaggaagctgctaaatcctacggctataagatcaacgagaagtaccacaagatcttcaacgagtaccgcaagacccacaaccaggcagtctttgacgcctatacccccgaaatgcgtttggcccgtcactcccacgtaatcactggactccccgacacgtatggccgtggccgtatcgtcggtgactatcgacgcgtcgccctctacggtatcgatttcctcatctcccagaaacagcacgaccttgcgaactgcggggacggaacaatgacggacgacgtgatccgcttgcgtgaggagatcgccgagcagatccgcgccctcaagggcatgaaggagatggcaaagatctacggcttcgatatctccaagcccgctaccaacgcccaggaagcagtgcagtggctctacttcgggtacctcgccgcgatcaagactcagaacggcgccgccatgtccgtcggcagaatctcaaccttcctcgatatctatctcgaccgtgacctcaaggccggccgcatcagtgaggcagatgcccaggagctaatcgaccatctgaccatgaagtttagaatggtgaagttcgctcgcatcccctcctacaatgagctcttctccggcgaccccgtctgggccaccctggaggttgccggcatgggtcaggacggccgctcccaggttaccaagaccgacttcaggttcctgcacacccttgagaacatggggcctgccccggagcccaacctcacggtcctttactctgaccggctacccatcgccttccgcaagtacgctgctaaaatttcgatccaaacctcctcgatccagtatgaaaacgacgatgtcatgcgtccggtctggggcgacgactacagcatctgctgctgcgtctccgccacagagaccggcaaagagatgcagttcttcggcgcccgcgccaacctcgccaagtgcctcaactatgcgatcaacggcggcaaggacgtcaagttcgacgataagaacggcaaccacctgcaggtcggccccgagtatgccccgatcacctcagagtatctagactacgatgaggtcatgcacaagttcgatctgatgatggactggttggtcgacctctatgtcaataccttgaacctcattcagtatatgcacgacaagtactactacgagtctgcagagatggcgctgatcgacacaaacgtccgccgtaccttcgctaccggcatcgccggcttctcccatgtcgtagactccctatctgccatcaagtacgcccacgtgaagacaatccgcgatgagagcggcgcggtcgtcgactacaaagtcgagggggacttcccgcgctacggcaacgacgatgacagagctgacgatatcgccgtgtggctcttgaagacgttcatgacaaaggtgaaaaagcaccacacctaccgcaattctaagcctacgacatccatcctgaccatcacctcgaacgtggtgtacggcaaagcgactggcgcactccctgacggcagaaaagccttcacaccatttgccccgggtgccaatccctcctacggcgcagagaaaaacggcctgcttgcttcactcaactcagtcgccaagctcccctacgagtacgccttagacggtatctccaacacgcagacgatcaatcccttcgctctgggcaatgacttgcatcagcgtcaagagaacctcgtccacgtcctcgacggatacttcaagcagggcgcccaccacctcaatgtcaacgtcttcggcactgagaagctccgtgacgcaatggagcaccccgagaagcctgagtatgccaacttcacgatccgtgtctcaggctatgcggtgaagtttatcgacctcacccgtgagcagcagctcgatgtcctcgcccgcacttgccacgaccacgtataatcaaacatcacgttgataccttgagcgcgcgtgaccaactcttatatgggctggtcacgctttttatgccaccccgtcatgtctcagccccaaaacgataattaactttcagagcagcatcaacaattgaagcagatggtaccataaatgcgtcaccgatcctctatcactttcttggtgatagcaaccatagaaaggacctccgaagtgaaatcccgtcttgttgttacctccctcgtcaccgctgttctctgcaccatctggatgcttctcggacccgctgcgggcttaattggttgggcaggattcgtcggctgcacttcttattttgcgtaccccaaaagcggtcccaaggccttaccgataatcttgtgctgtgttctgtgcggcagtgcctttgcctttatctcactctttgtgggaggcctcttcctcgatccgagagtctcgcaggcagtgtcgttggtgatgacatgcgtgacgacctacttcatgtgtgcagatgcccacttcaagtacctctcttacgtgccgggtaccttcttcggctccttctctacctttgccgcaggcggcaatccgatgatcatcccttcacttgttatcggtgtcttgcttggtctcgcctgtgacatgtgcggacagaagctcgccgacagcatctgtaagtaatggacctatccatttaatctatacaggtcccaacgaaattcgctttcttcgaagtagttgattcttgaagttagcgcaatatctagcagctagaaagtgtattcgcactcaacgcaagacttctcgacaacagatctttgatggaaacagtcggttcttagtgtttgcgcaggaacctatcgtccttttcggtgttgcaataagtcttgaaaccaactcatctaaggaaacgatgattaattcgcctcgatgaggctgttggggccacacgctgtatgacatcggctcaaaatgtctcgaaccacgcagtgcccatacccacatagatgcctatctgcctgcggatatattataattacagcaacgtattccagcatacccaaaaggaagatatgggcagccagatgagtttcagggtcgcgtgcgtggtccttgttcttcgttaagctttagggcccaggtgaaggtcgcatccaccatggagccatcccgcgccgtgatccctgccttctcgagctctaagttcaggtcgtgaagcatagctttgccaagtccctgccgctcgaggctatggcggaatttcgcaagtgtcgttgcatctggcacctgctcagacatgaggtctacgtgcacagaagcgctgccagggagtggcaatccaggatagcatctttaagttccctcgtcttaagagagcaaacatgacctgcagcagatacatcctaagcatcgtctttgcagcgcgcacatgcctgacaagagcatgtcagtggtagctggtatctaccagaacaatccagctatcccacacaacgatcgtatccatccgctccaggtgtgcctctcgccgggtctttctcctcagaccttaggatgtaaggtcctaaaagctcatctggctatccatatctgccttttggatatgctggaatacgtggatgtagctataccatatccagaagacagataggcatctatgtgggtatgggcactgcgtggttcgagacattttaagccgatgtcatacagcgtgtggctccactgacctcatcgagccgagttaatcatcgtttccctagggtcgcagcagtagagcctgattgcttgagtctctccttcgaaaaggtgtcctggcacctcttcatctgagaactcggctctccgacagactcaaagagcgtctcaagtgttcacttggtgttgtcgcagtctttgtggcccctcaaagatatgagctgaaacttcggtcaagtccgaatccgtgtgtaaaatcgctgccgcgttccctgccttaagccttcgccatgtcactctggttgcgcgctatctttgcgagctcgtcttccacctgcaggagctgcgcgtaagtcctatccgtagtagctcttcctctgcgtcgagctgcactcgttctcctcggtaaggaccgacccgatcagcctgatcgccgacaccttactcgggaagaccccgacaaagcaggcgtgcctctctatctccctgttcagcctctccaggtagttggacaccctcatgtacaggctcatcgcggcgatcagtaccttcgccgcccttgaggcgacgtcgcgcaagtgcgccagtatctcgtcacgtgtgcgcctcgcctccggcgcgcttggcagttgagcctctcgaccagctccccccttaaggccggcgcgcacgcccttgggggcggccttacacacgttgtacgagaagtgggcctggcagcgctgctaggcggcgccgggcagcacctcccttacggccgccacgagcccctctctggcgtccacgagggagcgcaggaagttcgtccaggagcgtcccgtgtgcgactcggcaagcgagaccccgatgacttagcagtgccttggacctcacgcggtggtcgaccctgaccttgaggtaggtggcatttgccatcacgaacggctactcgcccttaaggggccaatcgcaaaacgccctgatggcgcagtccagctcggcgcaggcctcaaaagacggagcacttggagaacgaccttccacagacctcctttatgaccctgcccaccttcactgtaaagacgctcgcgacaaccatctcggccatctcggtcataagggcagcctcgcttgcgcttgtagttgtcgaacatgagggtctcaaacgggacattgcgctgccttgacaccttcagctcgatggtggcgaccctggtcgtgagggaccttgccttcgtctcgttgtggctgtcggcgcgctcgtagggctgggcgcacagctgctcggttgacttctccctcagtaccccgttgagcgtctcctggagcagcagcctgaaggcgtccccgccccccgtcggtaagcagccccagtacctcgtcttggtccagtgcaagattgattcgagccatggccgtcctcttgggtgtcctcgttgtttggtgactgcgagcacaccttagcggcgggcctctggctcgcccgccttttacaccactttacggacgcaactgaaacttcgataggctgtacaaaggtgcaaggatatattcactgtcagattgaagaccttctgctgtatttatctcccaggcaccaacacaggctctcctaaggacagaaacgactataagcgctcggacgggtggttatagggggcacaaaggcgtgttgttaggacctatagcccacagatcgccttaaagtccacggcagacataatcgccataccgtctgtgaacccagcgatagatagtgaagacagatactggaacaggagaggcagttgctatctgcttaggggaaagcccgcaagcgagcttatcttgtatgtgggcaactgtgtgcgctgcatcctctttgctcatatcgatgccgcatttcatctgcaagcttttgtgcgtatttcaccatataggctacatggatgtggtagtggcatacctctgtttgtgtatctcatacacccgaagcaacactgcggtggctaccacaagcgtttccttgacagacagtctctgtcttttgttggctcgccgggctctcccttaggcactatgtagaccacgtggtgtctaacctctctctccgctgtagagggtactctatcaaagtcttttgcgatggaacagatagagtgttttgaatctagcccatgctcaatggatcttcttttcgcaaggctcaatctgtcgtatcgcttgtgcatttcgtacttgtcagccataagtctcatggctcttctcacaaccgtgtctttacagctacagctgtgaagataccttagttgacgcaagactcagcacaatacagtgcgatgagtcagaatagccgggctatggtagtgcacgagggacagaaatctaccgcttctttcaaaatgcctgctcaatatatgtaattaaaacactttcaattttctacttgtaattttgccgctgttcacgtaatctattacctgctacgcaggtgtagcacaatggagatgggcgtttagctcagggggagagcgcttccctgacacggaagaggtcagaagttcaaatcttctaacgcccaccataaaagaccaggtcatcagcatagttggtggcctgttttcttttggtacgcgattttggtacacactttttgcgcattttgactgtcgggtctcttcatatgttcgtcacgtatcgccttgccgttgagaagggggcggaccccggcctgcccaggttgacttccagggcgcgtgtagccccgtggcaagacccggtccggcaaaagcccggagcggagcagtggtgggtgggttggaaaaggttcccaaatggttagctagttccgtggcctttcgctcacgaagaaccgcgagatcggatagccctctatctgcctgcgctcggcttccgagcatcgactgagacaaacctgcgccatttccgaatagcccatgagcgcataggccgcagctttcgtgtatagctcgggggcttcgagagcaatgtcctctagggaaacgatgattaattcccaatgatatgccagaaaggaccagccacgtggcctttcgcggtcggcataggcattaatcatcgtttccctagcgcggacttctcctcctcgttgaactcacgcttgcgccctatcgtctgcaacaggttgagcaggtaggtctggcttttctggtcgaactcgtgcagtcttcgcgctagtaccgccgcgcatgcgagcaggccctgcggctgcctggcaccctcgtcataggccgtgagcatgtccaggagcttctggttgagcggcgtctggttgcccacggtcaccgggaaacggtcgaactgcgcatcgaacttccccaggtctaggttcacagccttctgaaggtcgtccttgccaagcaccatcgcagcgggaaccggctcgaacggccccctcacctccggctccttctcatctggcgaagagaaggagaagcacagctggtcggagtcgaggcccatgaaggcgtagctgccatccccacgtttccgaacgagcgcatagaccctgcatccctggatgtcgaagtgaacaatcggcaactctatatcttggccggcccatggctttccttccaccagcaggctgtgcatgagggcgagatcgtttagctcctttgtcgtcatgtcagcagaatcccagtcgacggcgataccgagcgcgtccagcgtctcgacaaactcgccgcatgcacgcacgtcctcgtccaggcgcatctcgagatccgggtcactctcgatcttggtccgcagtaacgtcttcccttcgacccttagttcgcccgtgcgcatgaactcgcggacgaaccgggccgtgttgtacctcctgcggatcgggcccttgatgtcgaagctcagcgtgaccctgtggtcatcgcgcaggatcatgctcacgccctcgaactcaatgtaggtgccctcacgatggtcgcccagcatcagcagcgtcgtcagttcgaagtccccggacgcaacattgacttccgtacctctggcgaacattgttacgtcctcgatcttcccgagcacgacgagctggccctccatgtccttgccgtagacgtaggcgttttccaaaccggctatcgttgtcacacgttcgcctttgtacaactgggtcgagactgatatagagttgatgtcttctggcagggttttgtatctccgtcgaagtcgtatgcgacgaccttagccttcatctgctttttccggttggcgttgagcgccgtgatgatccttgtcatctctttcgggtttgtcgggaatggcttgataggtaccgacgtcttctcctgatctgggcatgtctttgacagcgcacggttgatgttgtagagcaagagctgcgcgaagaagacatcctcgccaagacgggagttcttgttcacgccaacaacgaaaagaagtacgccgtagtacacgtccctgtagtgtttgagcgcctcggtgcgtgccatgaacttcaccacaccgtgcttgttgggcttcagcttccccatcgtacctttgacctgaacgggaatctccgcatgcaggttctcgaccctctgctccggtgagctgtacagatcaaggaaaccgtctatgaggatgttcttatcaccctcttttagcttgtcatcgatagtatcacactgctggataaggtcgcacacgcggttcacggcggctttctcgatctttttttgtccatttgcgcggtctttaccaagtcgtccctctctctgggccagccgatgacacctcgtgagcgacgcgcttgtcgctcgtggtatgattactgcataattattgcattttgttgattgtaccctggggagacagatgaattactccgagcttgtcgagggcggggctagcgagacccagattcagggtttcttagccgagggcgaccagaccgccgtcacctttcgtgtgcccaagaacctcaaggaggcggcgactgagacggcgcgtctacgtggggtaagcttctcggccttcctgcgctcgtgcgttatcaacgagctcacctccgggaggcgctaacgtggcagggcaggtaaagtcgcgcgagcgtgtacaggaacacggcgaggtcttcaccaacgagcgcgaggtcaacgccatgctcgacctggtgaagcaagagaccgagcgcatcgactcccggttcctcgagccggcttgcggtgagggtaacttcctcgccgaggtgctaaggcggaagcttgcggtcgtggcaaagcgatactcacggagcccccaggagtacatgcgctacgcgttcgttgcggtctcgagcatctatggtgttgacatcatgaccgacaacgtggcggagtgtcggcagaggctcttacgcatcgtcgaggctgccgccagggacgcgattggcaagcaggtggagcaggcgttccttgacgccgcccgttacgtcctcgagaagaacgtcctgtgcggggacgccctcacgatggtgcaggacgacggctctccaattatcttctcagagtggtcgatggtgaccggggacctcgtgaagaggaaggactatcggctcgacgagctaatggctggcggtgacacgaagcagggcgaccagctcggcctttttcaaaccggatgggagtacgactctgagattgacgggctcatccccgcctcgattcgagagtatccgcctgttgactacagggaagtttcgaagaatggctagccttctcgagaggacatataaccccgatgtcctaacgtgtctcgccaacctcagcaacgacgaggtgttcaccccaccggagctcgcgaaccgtgtcctcgacatgctcccgaaggagttgtgggaggaccctaacgtccggattctcgatccgtgctgcaagtcgggcgtgtttctccgggaggcggcgaaaaggttcatagaggggctcgcgcctatctacccggacctccaggagcgagtcgaccacataatgcacgagcagctcttcggaatcgcaatcaccgagatgacttccctcatgagcaggaggagcctctattgctccaagtatgcaaacggcaggttctcggtctccctattcgaccatgaagaaggtaacgtccggttccgcggcatccgacacacctggaaggatggcaagtgcgtctactgtggggcatcggagaaggagtaccggcgctcagcggacctagagagtcatgcgtatgagttcatccataccaagagaccagaggacatcttcaagatgaagtttgatgtgatagtaggcaacccgccgtaccagttgagtgacggtggaaacagcgctagcgctatgcccatttatcagaagtttgtagagcaagctaagaggctaaatcccaggtttttgacaatgatcattccggctcgctggtatatgggcggccgtggtcttgatgaattccgatccacgatgttgcatgacgacaggattcgagtgctccatgatttcccgtctgcttctgactgcttcccgggagtggagataaagggtggtgtctgttacttcctgtggactcgagatagtcatggcctctgtaaggtcgtgagtcatgatggagtgaacacaagcgagtctataaggccacttcttgaagagggaatggaaacattcataagaacaactcaacagctatcgattctcgagaaggttcgctcgcgtcgagaagtccctctctcaaagaggttgaatgccggtcggtatttcggattccacactcgcgtaacatggaatgggaatgtcggtaagttgcagacggccgacggtgcctcgacgtatccggtgcgcaagtcccagtccgaaaaattcaacgtgaaagtttatgtgtcacatggtgagtgttggatatctcctgaaaacgttacccgccattccgaggatgtcggaaaatataaggtattgattcctcgtgcgggcaatcccggtagctcgattctcggaaagctgaggatcagcgagcctgggtcgtgcagctcaaatacctacaacgtcatgattttgggcgatgagcttgatgaggcagagaacttagtctcatatctcaagactaaatttgttcggtacatgattgcgacacgaaccacaacacaagatatggctccgaaggcattcgaatttgttcctgatccggacatatctcacaaatggacggacgcccagttgtatgagaagtacgggttggatgaaaaggaaatcgagacaatagaaagttcgataccagagatggagtagatgaggatgccacaggtgctctttcctcagcgcccagaaattaagccagtaatctacgcctatgaggaacacaatccaaaatacaagggctttctaaaggtcggctacacgacgcgcaccgccgaggagcgcgtcgccgagcagcaccccgtgatacagccggggaaagggaagccctatacgattgtcttcaacgagagcgctgtgagggacgacggcagcaccttcatggatcatgacgtccaccgccgcctcgagcgaaacggcttccgctgcgtcggcggcgagtggtacgaatgcaccgtcgacgacgtgcgcaacgcatggctagaggtaagggaccgcaaggactacgagtcgcagaggaccgaggacttcaagatgcgccccgagcagaggcgcgcggtcgacatgacgcgaggttacttcgagcgctgcgagcaggaggggtcccagagagtcccgcggttcctctggaacgcgaagatgagatttggaaagaccttcgccacttacgagctcgcgaagagcatgggcatgaagagggttctcgtcctcaccttcaagcccgcggtggaggacgcctggcaggacgacctggagagccatgtcgactttgagggatggcagttcgtcgcgagaaacgctggtcggtacgaggactgcgacccctccaggcccatcgtctgcttcggttccttccaggacttcctacagccgggtaatgatggcggaatcaagccgaggaacgagtgggttcacttggaggactgggacctcgtcgtgttcgacgagtatcacttcggcgcctggaaggactccgccaagcggctcttcgagagcgctaaagatacgggagacgacttcgacgactatgtcccatctgccgacgacgactcgaagacggcacaggaggcgtcgtcgggcaaccagctcgacgagacctggctgccaatccagtcccgcttctacctctacctatcggggaccccgttccgggcgctcaactctggggagttcatcgaggatcaggtgttcaactggacctactccgacgagcaggaggcaaagagggactggaaggggccgcacaacccctacgccaatctctcgcgcatggtgcttatgacctacaaggtacctgactccattacccggatagctcgccaggggcagttcaatgagttcgacctcaatctgttcttctctgccaagggacatggcagtgaggcacgtttcgtgtacgaggagtacgtccagaagtggctcaatctgatccgtgggtcgtcgcaggagacggcggcagacgaccttaggctcggagccgagaagccgcccatgccgttcagcgacacgaggctgctctcgacgcttacgcacaccctgtggttccttccaaacgtctcctcgtgcgaggcgatggccaacctgcttgcccagaggcagaacaccttcttccacgactacgaggtaatcgtcgcggccggacccgatgccggcatgggcgtcgaggcgataaaaccggtccgcgaggccatgggtgacccgcttcgcacaaagaccatcacgctctcatgcggcaagctcactacaggcgtcacggtacgcccctggtccggagtactcatgctgcgtaacctcaggagccccgagacgtacttccagactgcgttccgcgtccagagcccctggaccaccagggacgacgagggacacgtccaggacctcaaggaggagtgctacgttttcgacttcgccctcgaccgggcgctcaccatggtgtgcgactacagctgccgcctgtctgtgaacgacgagagtcccgagcagaaggtggacgagttcatcaacttcctgcccgtgctcgcctacgacggcagcgcgatgcgcgaggtcgacgccgccgacatcctcgacatggcaatggccggcacgtcggcgacgctcctcgcacgtcgctgggagagtgccctcctcgtcaacgttgacaatgacacgctccgaaggctcctcgccaacgaggacgcgatgagggccctcatgagcatcgaggggttcaggagcctcaacgacgacatcaagaccatcatcaataagtcggaagccgtgaagaaggcgaagcgtgagggcggcgagctcaccacgaagcagaagaaggagctctccgacgaggagaaggagtacaagaccaagcgccgcgaggtccaggagaagctcatcaagttcgccacgagaattccggtcttcatgtacctcaccgatttccgcgagcagtgcctgaaggacgtgatcacgcagctcgagcccggcctgttcaagaaggtcacgggactcgaggtaaaggacttcgagctcctggtctccctcggcgtcttcaacgacggactcatgaacgatgcggtgtacaagtttcgcagatacgaggacgcgagtctctcctacacaggcatcgagcgtcaccgctacgaccggaaggtgggcctctttgacaccgagctgacccagacggactaccagcagatgcggttccaggacgagcgcctcggttccgacggcaaggcgaggccgactggaggagctgacacttacgttgtgcagagcatcaccgaggagcgctcctcaaaggaaggggaaccttcaaaggtgacgttggcggtctcctcggtccccgcgagtcccgtcgagacggagagtgagaaggccgaacgggaacgtgcccagcgaaaggcgcgggaggaagcccgccggaacctcggggcgaagatcgactcgcttggcgctggggacgttatcggcagcaaggctttcggaaacggcaggatcaaaagcatcgagggaacccgcatcgtcgtcaggcttggaggacgtgacaggacattcgcatttccagatgccttctaccagggattcttgaaaatcgagtgtgagcatcagtaggatggtaacaacggatgttggttttctgaggcaactacgagcgtacgaacttccttgcgagaaacgacgaacttcatttccctccccgccgtcgttaggtgttcctgacggcggggagggcggccgtgggagggtttggctgcggccgtggcgggagggaatcggggccactcgggacttccccgagcggcccctttccgaccgtgagcggctttacgttcttgacgtcctagggaaacgacgattaatgccccataacgtgttaaaggggaccgaccacacgacttttcgcggccggaatgtaggaaaggcagggaaggatgctcatccagcacgtgcaggagccgctatcctggcatttatcctgccgcatgcaccgcaagaaggctccaagacagatcaaacgacgctgagagccgggaggtgcagcctgccggcaaaagatgcacatgggtaaggtttgcaagggcgagaaagacttgagtgtgcagacatcttctctatcctcctgtagcgcttccttaagtgtctgaggcgccgcttcacgataaggaagggatgctctacctttgagcggccggaggccttcctgaactcgatacccttcttggacaagagcgcacaggcaagaccttctgtagtcgaaggcttccttagcgacactttagcgcatagatgagaggtgtgggtctttatgtgtccttaagggcgcttcgctatacctatatagcctaaagtctgcgcagcagaacctgtcatcttcccttacgagtgcatgtgccacaggatatgtcggatacattctaagcgatcgtctccacaccatgcacaaggccacctgcggcatccacgccgatatgcgccttgtatctgatacgccaggctcctcctttcttggactggtgcgctttaagggtcgcgcgtatggtccttgttcttcgtggagctcggagcctcgatgaaggtcgcgtccaccacaatggagccgccttacgccgtggtcgcatctggcacctgcacctgcatgaggtctacgtgcacagaagcgctgccaggagcgacaatccaggatagcatccttaggttctctcgtcttaagagagcaaacattacctaaagcaggctacatcctaaggaaacgatgattaattcccaatgatgtgccagaaaggaccagccatgtggcctttcgcggccggcataggcattaatcatcgtttccctaaagtatcgtcttcgcaccgcgcacatgcctgacaggagcctgtcaatggtagctgggttctaccagtgcaatccagctatcccacacaacgattgcatccatttgctccaggaatgcctctcgctgggtctttctcctcagaccttaggatttaaggtggcagattgtcaagctgagtgcaacatctccctaaggaaacgatgattaattcccaatgatgtgccagaaaggaccagccacgtggcctttcgcggcctgcataggcattaatcatcgtttccctaaagacctcgttggctgtcctgtatttcaggaccttcctcgctctgtcgcagatcagctctaccgcatgccggacctcctcgtttgttaccttgccgaagtcgctgcccttaggggaagaactcccgcaggagcccgttggtgttcttaactgttagcttctgccatagatggtgagggtcgcaaaagtagaactgcatgcctcaaagggcatctgtgagccctgtatgccctgcgagctgcttgcccctatccggagtgagcgtcttaagggggcgtccctgtagcagcccgaaggcggccttagagacgctcccgctgtcgtggtggctctttccgcggcaagcagccttaatgccctgtcggcaagcacgagcaggcacacaggtcctactccgataagcgtgtcatctgcccagtctccgaggcaagacctctcatcggcctgctttggcctctcctttacggtgtgtaagatctcgatcttgcccctcgtcttaagcctcttcctgcggatctgcttccccttcctgcgcaggtggcgccgcatcttgccttcggagccggcttccggcaggtcgagggcgcctgcatggacctcccggtagatcgtcgagaggctcacgacgcacctgccgccaccctcgagcctgagatgttgtctatctcctccagggaccagtgtctgtccatgatgagtaagcgcaccttctgcgtaagcgcagggtctgaaagccgccttttcgccctgcatctcctgcggcgctcatccgccctccttttgggcagcgcatgccctaaagcgtccgtgccgtgcgttcctcttgagcttgtggaagatgctggagctgtccctgccgatatctcccgcgatatagccgattggccttcccttgtgccacacagtgtggctatgcagtccctctcctgtaggcttgagatgcttgtagtgccacattccttttagcttgcgacgttgacttggacaaccaacatcgtagccttccggagtgtgccacacctgcattcagcgggccatcctgttgcactcagaatgctaatccacctctgtaaagggggtgaggccctttattcttaagctcgcgcatgcattttcttaccctgtagagggtagtattggaaaactcatcagctagatagcagtggtgtgaacctagccccaaaacctctgtcaaagtccgcctgcaagtgccagataccctctttaagctcacctcccccgttttctggtgctcctgcgaaacacccatgaataaaagcttgagcgtaataccttaaggattaaagcctgtatcttgatcgggaagttttccttctcctcaagcatctgcttgtaacaatctattgcgcttagatcctttgcgaagaaggcttaacagctgcctttaagaaggcatgttccatctcaagctcttagctgcgcttggcataaggcttttgagcttttcctctttagtctcgctgcgcttaagcagctgatagcctatctctgtgctcttctacccagcggatctgtgttttgggactttagccctaactcggtggtaaggtggcttttaggcttgccggtggagatagcgtagtcagctgtttttcaggcgctactcatcgctgtatttggtagcaagattgtttgttacctgtagtccttttggtcggcttgtcttgcagttgagaggagcctcataattcctcaagccgcactgtccgaaaaaatgatacaggtcacaggcccgccgcgggggtgtcccaaggcgctggcgtgcctggacgccgggtttaaggacgcaattggaagtcatggccctcccgcaggtgcaagtgcaccaggacgtcgaactgcctcgagaggctcaacgctgaggtgaagcgctcccagaagctcatcgctatattcccgagcgaggacttactcatcaggctcgtgggggcctaccttatcgaggagaacgacagatgggcggcaaagagcaagcagtacttgcctgtcggcggtcgaggagctatgagaggaagaaggaggcgctcgcaaagatagcccgcacgcagcgacagatgaggcttgattcgtgatggcttgcaggtagcggttgcttatgggctaatttacaagtcatctgcacaattaaacacgcagattcagaggactgtaccgttgacgcattgccgtgcaataggttgacggctttggggcacaatataatactgtgcgtttttgagtttgtatattcatgcactgataaattcagtgcaccgcggaaggatataaaagatattcatgagcgaggccctaacaaacaagcagcagaaagcgttgcaaaatgattcggtattccggaaggaacaggagaagctctccgaaacctacaagaagctgctggagctcagggatgagttgaaccaccgccttgaggtgacccacaaagaggctgcccaggacctacacgatatgtctgaggaaatcacccaagactacggttcagacgatgagacgatggagaccttggccgcaatcgagactttgaactctgttatcgactcctacaaccaggctcacgatttcgatgtcgagaagctgcgccgcgtgatggtgctcttgcgtcagccctactttgcgaaggtcacactcaagatgcatcccgaccatcccccacgcgacatctacatcggggtcgccggcgtgatggacaaggactcccgtccgctgatcgtcgactggcgctcaccggttgcggagacctactacaaccaggaaaacggcaagacgagctatgaggtcaacgggaagcgccacgatgtggagctgctactgcgccgacagttcgatctcaccgaagacaagctcaatatgtacttcgacacgacggtcgcaattgaagatgcccttctgctcaaggcactcaagtcccatcacaccgagaagctgcaggcgatcaccgccacaattcagaaagagcagaatgcggtcgtgcgccacagcgacattccggccttgatcgttgacggtatcgccggctccggcaaaacctccgtgatgctgcagcgcatcgcctatctcttctaccagcaacgtgagacactgaaggcggaccaggtctacctctttacgccgaacaacgtattccaaagctacatcgacacggtgctcccctcgttgggtgagtccaacccgcagagcttcacctggcgcaactttatagagtcgcaaggcatcgctgaccgtgcgaacggccgggacaccgaccctgcagagctcaagaagatggaaaccacagtcaaaggcctcacgcttgaaccagatgatctgcgcggtatcagtgtgggtgacgtacagctgatcaaagcatcacaggtaaagaacgcctttgcgaagttcccgcgcaccccgttgggaccgaggctgattgcgatggtgaaggatgtgctgcacgaacgccttgagacccgcctcaccaacctctcacgcgacgaaggcgtccacgaagagatgctgggagctgatatcgaggaccagattgcggtcttcggtgaaccgatcaaccccgtcgatgaggcagacaccactcgcttagccaggctctacgtggaccacaagtattcagacgtccacgatctgattgaaaccgcaggctggctcagaatcgaccgcatcggacagcgcctgctcggccaccagctcaatgccgcagagtacctctacctgaggtccctgatcaccggcgccggtgaccgcaacgcccgttacgttatggtcgatgaggtacaggattactcacccgctcaactcatggtgatggcgagatacttcagtaacgcccactttatgctcttaggtgacgcccgccagtcaatcttcgaaggttccgcatcctttgaccagttagagcaaatcctcaaggatgcaggtatcacaaagaaggacgtcgacataaagcgcctgaaattgctcacgagctaccgctccaccccggagatcaccaacctctttatgagcctctacgagcgcgacgaagccattcagacccactcagtgcagtgtaaaggtgtcgccgccaagctcttggtaaccaaggacgctgatacctacctcgacacgctgcgcaagcttgtcgaggggcagcgtgaggaaaacggtctcaccgcaatcgtgaccgatgaccgcgcccgcgcacactggatcggcaagcagcttggcaaatcagtacgcgtcctggaggacaaagatatcctcccgctctccggggtggtcgtaatggatttggcaatggcgaaagggttggagttcgacacggtgattgtgccggacgtccaggcaagtgtctatgaggctacgccgagatatcgtcgtcgcctctataccgcgatcagccgtgcgatgcacaaagtagtgctggtgagccaaggtaagcccacctcgatgctcgaaggctcccccgttgagaaagagaacctgtagatggccaaccccttcaagaacgctcaatttgtcgcctcgttcggcactgtggaacagttgccaccctcgacagagccggaggtctccttcgtcgggcgctccaatgtgggcaagtcttcactgatcaatgcactgctcggcagaaaggcgcttgcaaaggtctccggaaaacccggcaagacccaaacgatcaacttcttcgaagcgagtgggatccatttcgtcgatctgccgggctatggctttgcccatcgcagtaagcaggacaggcagcgttgggcagagctgatctctgcctactttgaaagcgagcgctcccacaacttagtcatttccctgatcgatatccgtctcgagccgcagccgctcgatgtacggatgatcgactatctcaagagcgctgagctacccttcatcgtcgccttaaccaaggccgataagttgaaaagccgcgctaagcagcaggcgagtctcacgaagctctcggatgccttcggactcgatcccctcgcctgtgtggtcacctctgctgaaaagaaacagggcatcgacacccttgcccactacattgagcgagcctgcttcgagtaaatcagtgcttcaagatattgagcagttgcgcgtgcaacagctcctgatccccaggcacatgcgaggagacgatcagcgttctcccctgcagatgttttctgataaaggctgccgcagcatagtggctctgcacgtcgagcgaagcaaagggctcatcgagcaacaccagcgccgagggatgcgcgagggcccgtaccaactcgacacgccgcttctgtcccccggagagctctgagaccggacgggacaaaacgtcttcggacagcagttcacacaggagttccttagccccctgttcagtcagtaccgaggtcaactgaacattctctgaggcagtgagcgcgcttaccaggcgcggttcctggcacactagagcgatatctaccggggcctcgatcctgccctggagaggtctcagaagtccgcagatggtcatgaggcaggtggtcttccccgaacctgaagcgtcctggaggatccaggagcctccctctaactcccccgtcagttccttagagaccgtgaccggtgccgcatggtctgaggttgccggataacccagcacggtatgcacaaaacgtatggtaccggggaccttcgaggtctgtggccgcagtcggttctggttgcgcaaggcacgcttgagtgcccagggacccgtagcagtaagcgccttcagaaagagtcgctcacacacccaggaaagtaggacgatcgtgatggtccaagagaagaggcccgcagtgttgagcaagagccgcgcttggtagaccccctccccgattgtgccccgtggggaagccaatacctcggcagccacgcctgccttccacgccattccgcacatattgtggcaagtcgcgaccaggaaaggcaacaattgctggtaggtatccacctggaagcgtacatggggcttgacgcccatcactttgagctcgtcgatcacctcatgatcctgtgagtccagcccctccagcaccgaaaaatagagcgccggaaagatgaggatcaccacggtgataatgctcacccgtttgggtccgacccacatgagcagcagcattatgaagcagactaccgggatggacttcagcgcgtccatggcaggctccaagagccgtcgcagccaagggaggcggtaggcggcaaacccgagcaccactgccaaggcgaagccgatcagaaaccccaccgcgatatgacagaaggaatgcaggacagtagtccaaaacactggcgtcacgatctgtgacgccagtgtcaccgcggtatcaactggacttgcgagcagcagatggtttcccactgccatgcttgccaactgccacacaccaatccagatgagtgcagccagtactgtttttatatgcgatttctgcgaagctctccgcatctatccctatcccttgtagtaaaaatcctcgccggggagggcaccaccgatggagtccggattcgcatcgctcatcacctgcaggaagccgcgttgggcatcctccatctcatcgcccgtgatgcacaccacattgcacttggggatcgcggcttgcgcgatcggtttctttgcgatgatgcccgcctggacgaccagatctgcggtgccgtccgggtcgtcattgcacttctgcactgactcctgatgcttctggaggaagtccgccacggcctgaggatgctgctcgacaaagtccttgcgggcaattgtagagccgagcacaaacttggatccggagtcgccggcatagcgatcccagacatcgttcaggttgatcacggagtggacgtcgctgttctgagtctccaccacagtcgtgaagggctgcggcaggattgcgatcaccgcaggatcggaggcgagctcagtcgctacctgctggtgctcactctcgtaggtaacctcaacacggtcagcgatgcccgcctgatcgagcaggtactcaatcacgtactcaggggtggagccttggcctgaggtcactacggtgtgccctgccaggtcttcccactgctggatcgaagagtcaccggtcacgaccgagagcacgccgagcgtgttgatatcgataagctcaacattcccctcggtacggttgtagaggatcgaggctgcattggaggggacaaagcagatgtcgcaggtcccctgtgccaccatcggcgtcacctcgtccggtgcgctcgagatctgataggcataggtgatgccggagccttcctcaggatcccctacagagctcaaatctcccccatccccagggataccggaggtgtcgttcatcatgttgaccaaaccaatcgaggagggacctctaagtgtcgccaccctaaccactacgtcttcggtttgctgctgtcgattattctgattgtcgggagattgtgaatttccacacgcggcaagaacacttgaaaatccgaggcctgccaaggtagcaagggcttcacgccgggtgagattggcactcatgatacttattccttcctgtcatgcgcctatggagcttaggggcgccttgtaatcgggtataaccattatatgtggcgcatacgctttaagctatgcacacaaaccaacgatcgttcagcagttaggagcgccatgaaaacacgcgtcgccgtgatcggtatcattgtggaaaatccggactcggtcgatcctctcaacaaaatcttgcacgagtactctcaatacattatcggcaggatgggcatcccctaccgtcagcaccacatggacgtaatctcgatcgtcctcgacgcaaccgacaatacgatctcctcactcgccggcaagatcggcgccctcgacgggatcagtgccaaggctgcctactcgagcgccttcacaggagaagaggactgacactgtcagaacaacttacctgtataagccaaaggacttcggagggaccacctgcggagtcctttttgtaccgttcgtacctatctaccgaaaaaggccggaagccacggatggcttccggccctcactgtctatgcgaagctagtcgctcgctgaggtatcgttacgccttggcatacatttccttgagctggacaaggtgagcatagcgctccattgcggcttcctcgttctcagcgaacagggtatccgcacggtccgggaagaagctcttcagggatgcgtaacgggactcgttcatcaggaactcctgatagccgcccttcggctccttggagtcgaggctgaatctcttgccagccggctttgccggattgtaacggaagaggttccagtagccacagtcgaccgcacgcttcatttcctccatgcagtgcatgagaccacccttcttgatggagtgcatctcgcacgggcagtagccgatgaccagagacggcccgtcataggcctcagcctcagtgagagctctgagcgtctggaccgggttagcgccgacagcgatctgtgcgacgtagacgtagccgtagtccatctgcatctcagccagggacttcttcttggtggccttaccggcagctgcaaactgtgcgacctggcccaagttggaagccttggatgcctgtccaccggtgttggaatagacctcagtatcgaagacgaggacgttcacgttgttgccagaagcaaggacgtggtcgagtccgccgtagccaatatcgtaggcccagccgtcgccgccgaagatccagaaggacttcttggacaggaagctcttattcttgaggatctcctcagtgatgctgttgatgtcgttcgcctcgagctgtgcgatgtaggcatcagaagctgcacgggacttcgcgccgtcgttgcggctctcgagccatgcagttgcagcgtcgttgaggctgtcatcaacgtcgtccattgcgatcagctgctgggtcagtgcgaccaggcggttctgctctgcctgatagccgatctcgagacccagaccatgctctgcgttgtcctcaaagagcgagttgttccacgcagggccgtggccagctgcgtcagttgcaaacgggctgatgcctgccgggttgccccaaatggaggagcagccagttgcgttggagatgaacatgttgtcaccgaagagctgcgcagccagacgaccgtagacagtctcagcacagcctgcgcaggaaccggagaactcaagcagtggcttcttgaactgcgtgtttctcggggtcttgaagtcgatgagctcagacttctcggtgaccttgttgaccgcgtagtcccaaacctcagcctgcgcagcttcctcttcctgaggaaccatggtcagcgcaccgccgttctgaacgtcggacttcgggcagacgtacaggcagttgtagcagcccatgcagtcaagcggggataccgcgatcgtataggtgtaaccggtgttcttcggaagcttgaggtcagacttcttcatagcagccggtgcattgtctgcttcctgctgatccatcacaatcgggcggatagtggcgtgcgggcaaatgaaggcgcagctgttgcactggatgcactcgtcaggattccaacgaggaaccatgactgcggtaccgcgcttctcgtactgggaagcaccgagctcccactggccatctgggttgtccttgaatgaggagacaggcagggagtcaccctccatgcggttgatcggctgcatgatctccttgacctgcttgacgatctcttcacggccctcaagggtaatctcatgctcttcgtcctgagcgttcgcccagcaggcaggaaccttgaactcacggaatgcagaagcgccagcgtcgatagccttccaattggcctcaacgatattctggcctttctttgcataggacttctgtgccgcgtccttcatgaacttcttcgcgtcatccagcggcaggatctttgccagtgcgaagaacgcggactgaagcacagtgttggtgcgcttgcccataccgaccttctgtgcaaggtcgatagcgtcgatcaggtagaccttgatgttgttctttgcgacgtagcgcttggcttccgcaggcatacggtctgcgaattcctcatcgctccactggcagttcaccagataggtgccacccggcttgacgtcgcggaccatcttgaagcccttgacgatgtagctcgggttgtggcaagcgacgaagtcggccttggtcacatagtacggtgagcggatcggggcatcgccgaagcgaaggtgagagatcgtcacaccgccggtcttcttggagtcgtactggaagtaggcctgaacgtacttgtcggtgtggtcgccgatgatcttgatggagttcttgtttgcgccgacagtaccgtcgccgccgagaccccagaatttacactcgatggtgctcgggtctgcagtgttcggagcatccggatccatcggaagggacagatgcgtaacatcgtcgtcgatgccgatcgtgaactcacgcttcggctgatccttcttgagttcctcatatactgcgaaggctgccgcaggaggctcgtctttggaacctaagccgtaacggccaccggtgacaacgaggtcagagcggcctgcctcatagagggcagccacaacatcctcgtagagcggctcgccgatggaacccggctccttggtacggtcgaggacagcgatcttgttgaccgtggacggaagtgccttgacgaaggcgtcgacgtcgaacggacgatacaggcggaccttgaccaggccaaccttctcgccatgtgcattgaggtagtcgatgacctcttcgagggtatcgcagaaggaacccatgcagacgacgacgcggtctgcatcgtcggcgccgtagtaatcaaacagatgatagtgggtaccgatcttcgcattgatcttgtccatgtagctctggacgatctcagggatcttgttgtaacgctcgttgcaagcctcacggtgttggaagaagatgtcgccgttctcgtgagagccacgggcgtgcggatgctctgggttcagtgcgtggttacggaagcgctggacagcacccatgtcgagcatatccttcagatcatcgaagtcccaggtagcaactttctggatctcatgtgaggtgcggaaaccgtcgaagaagttcaggaacggagtgctgccctcgattgcagcgaggtgcgcaaccggtgcgaggtccataacttcctgtacgttgccctcagcgagcatagcaaagccggtctgacggcatgccataacgtcggagtggtcaccgaagatgttgagcgcctgcgttgcgacggtacgtgcgctgacgtggaagacgccaggaagaccctcagcagcgatcttgtacatattcgggatcatgaggagcagaccctgtgaagcggtgtacgtcgtagtgagtgcaccagcgcccagagaaccgtgaacagtgccagaagcaccgccctcagactccatctcaattaccttgacaggcgttccgaacacattcttcaggccttgtgccgcccactgatcgacgtggtctgccatagggctggaaggagtgatcgggtaaatgcccgccacctcggtgaatgcgtaggagacccacgcagcggcctcgttaccatccatcgacttgaactttcttgccatatcctctcctttgaagtgatacggtccgtcccatattggacggaaatgaacctgctctttcgcccacaatgagcgaagtcacagagcacgttcgtgacacaatttccctgcgtcacaatacatactgcccatatagtaacgcatctgaaacgtaattccacatattaccaccaacagagaacctttaatatttaaacattttgcaacctatggtaagggcctctatcgggctcaataatgaaactcctgttagcgttccatatctgtcgagatgcacctcggtagacatcaattgtgatactgaaaaatctgaacacgaccgagagccaacgttcaaaaagggaacacaagttcctcacgttctgagtccaggacggatacgcctcgcatcctccctgaactcgacagcatcccctacggcagggcaacgctttttcggtatcgattctctcccggcaggctatcctttcgcgtgcgcttctgctccgccgcccgaacagctcaactgcgacgaccgataacctagactcctctgctgtatgagagtaagtattggtctacctattgaatgaagtgccaccgtaattcatcctgaagtatggttcttaagacatctgtctcataccggtgaggcgagccatggacacaacgtcatctatactctgcgatgcgctgtggctcctctaccttatcgatatgatcttgggacactgtgtagcagcgttcacgctgatatctgtcatgggagtcatctatctacttcaagcttctgcacgcagtgacactgccacagaagtgagcaatgccactctcaacaagaaacgctttttaagggtactgctcatcgcctgctcaggtatccccgtagctgtgagagccctgagacagaacgcttcgttgtgtccactatggagacagatggctttacctttgcaatcactgccacagcccatcccataactttgtggataccacagagctccaccatgtccgaccgagcgtttatgctaggttgtgagcgaacataactgcaaagggatctctctatgtcacattctcagcaaccaatgtatccgcacaccgcgcatacccatacaaaaaaacaccacagcaaggcggttgagccgatcaccccacgcccaacgcgcgatcactttctgccagtcagcaaagaagatatgaagcatcgcagttgggaccggtgcgatttcgtctatgttatcggcgacgcctatgtcgaccacccctccttcgggcctgcgatcatcagccgggtcctggagtcccggggctacaaggtcggcatcattccccaaccggactggcacgatcccaagagcatcacggccttgggtgagccgcgtctggcattcttggtgtgcggcggcaacatggactcgatggtgttgcactacaccgtagcaaagcatcgccgctccaaggacttctattctccgggcggtaagaccaatctgcgcccggatcacgcgaccaccgtctacggaaacttaatcaggcagacctacaagcacaccccgatcattatcggcggtatcgaagcctccttgagacgcctcgcccactacgactactggtccgactcgctcaagcgctcgatccttctggattccggcgccgacctcatctcctatggcatgggtgagcgctccatcgtcgagatcgccgatgccctcaactccggcatcgatgtccacgatatcacctggatccaagggacagtctaccgagcaaagagcaccgagcagtgcgaccacccggtgacgcttccctcctggaatgaacttcagagaagtaagcgtacctacgctgaaagcttcgggctgcagtgtcgaaacctgaatccatacctgagccactcactggtcgagccctatcctgacgaccatctttacgtgattcagaatcctcccgcaaagccgctctccaccccggacctcgatgaggtgtacgagctgccctacacccgtacctatcacccgatgtatgaaaaccaaggtggtatccctgcactttctgaggtcaagttctcccttacgagcaaccgtgggtgcttaggtgagtgcgctttctgcgcgctgaacttccaccagggccgcatcatccaggccagaagcgaggagagcttggtgcgtgaggcgacagcgatgacgcacgatccggacttcaagggttacatcaacgatgtcggcgggccgactgcccaattcatgatcccagcctgcacaaagcaggagacactgggcgcctgcacgaacaagcgctgccttgccccaaccccctgcaagagcctgagagtagaccacacgaagtatgtgcatctcttacgcaggctccgtcagatccccggcgtaaagaaagtcttcatccgctcaggcatccgcttcgactatgcgatgctcgactccgaccacacctttatcaaggagctcacagaataccacacctccgggcagctccgtctggcgccagagcatgtctgccctgaggtcttaaacgtcatgggcaaaccaccccacaggctctatgagaagttctgtaaagagtttgagcgttacagcaaagaggcaggtaaagagcagtacgtggtcccctacctgatgagcagccacccaggctccacaatggaggttgcggtcaagcttgcagagttctgccgcgatctgggttacatgccagagcaagtctctgacttctatcccaccccgtctaccatttccacctgtatcttctataccgggttagaccccaggacgatgaagcacgtttactgtcccaccaacccacatgagaaagcaatgcagcgcgccctgatccaataccgcgatcccaagaagtatgatctggtcgttgaagcgctccatcgggcacaccgggagggcctgatcggctacggacccaagtgcctcgtacggccgatgtgtccccactcccatcaagggaaacgacgccacaccaatccttatcggaagcacagcaaatgacgctacaaccgtaaagacatagcggaagaagaccacaatcgatcctcttccgcttttctgtcagatagcgcagtgatatctattcgagctccaactcgccggtctcgagctcccagtacacacccttctgcgccatgagctcctcacgcgtaccgcgctccacgatgcgtccgtgttccagcaccatgatcgcatccgcgttctgtaccgttgagagccgatgagcgatcacaaagacggtcctccctctcatcagcgcatccataccgcgctcgatcaaagcctcagtacgggtatcaacggaagaggtcgcctcatccaggatcagcaccggcgggtcggcaacggcagcacgggcgatcgctaagagctgccgttgcccctggctcaggtttgatccatccgcagtaatccgtgtgttgtagccttcaggcaacctagagatgaaggagtcggcgtttgcgatcgatgccgccttcctcacttcttcatcagtggcatccaacttgccgaaacggatgttatccgccaccgtcccctcaaagaggtgtgtttcctgcaggaccatacccaacgatcctcgcagatccttaaggccgatctcttcgatgttaatcccgtcgtaggtgatctcacctgaatcgatctcatagaaacggttgatcaggttggtaatcgtcgtcttacctgcaccggtcgaaccaacaaaggcgatcttctgaccgggtttggcgtagagcgtcagatctttgagcaccgtggtgcccggcacgtagccaaaggtcacatcgtcgaggcgcacatcgcccgccagcggagtccggaatccgtcaggcttgttccacgcccaggtattcttaccggtgcggatcagctgcaccttcccctcatccttctcaaccggtatctccatcactgaaaagatgcgctccgctcctgccaaggcggtcagaatgaagctgccgagctgcgtgatttggttgatcggcatggctgattgacgtacgaggacaaggtagctcgcaagcgctccgacatctgccatattgttcagcgtcaagagggaaccgacgacggctaccaccgcgtagttgaggtagctcatcgcaactgtcaccggcaccatcgagagagcataggaggttgcataggtgccggtcttctgcaatctcctgttgaggtgatcaaacccgtgcaggttctgcttctcgtgattgaaaactttgacgactttctggccagcgaccatctcttcgatgtagccgtccaaggcacccaggatcttttgctgcccggagaagagccgctgggagcgggctccggaatagcgcacatagagcacgatcacgaagtcgcaggcaacggtgataagcgtcaggcgccagttcagcacaacgagcagtatcaaggtgccgatcgtttggatgatcgactgtatgatattcgcaaagctgttgttgagcgcctcggagatcgtatccacgtcgttggtgaagtaactcattgcgtcgccggtgcgcgtcttatcgaaccaggagagcggcagatgctccatgtgggagaaaaggtcgtggcggatatcgaagacgatcttctgcgccgctctcaccatcatctgcgtatagccgatacaagaggtgatcgcgatcgcataaatgagtgcggtcagggcaaccagatgcacaaagcgcgggatatccccggtaccgacggcattgactaccggccgaatcatgtaggtaccgatgaggtttccgacgccggcaatcgtgactaggatcgcaacgagcaagagctgccaacgcgcatggcccaagtacgtgaggaaccgccgtacggtgtgccacagattctgagggcggttcgcagcttcccctttagcgggcatcttcgaccgcctttgcatcaacgacgttctgtgagacgcagagctcccggtagatcggatcgtggaccaggagctcttggtgcgtcccgatcccttcgatctttccgtcgtccaagatcacgatctgatccgcatcctgtacggaagtcacacgctgtgcgacgatcactttcgtcacgtcagtcagtttggacagccgcgagcggatcaaggcatccgtcttcatatcgcaggcgctcgtcgcgtcgtcgaagatgaggatcttgggatgcttgaggagcgcgcgggcgatgcagagccgctggcgttggccgccggagaggttggctcccccgtgacctaagtccgcatccaatccaccgatgcagtccagaaactcatcgacgcaggcaacgtagcaggcccaggtgagttctttggtattgttggcatggggattaccccatgccaggttctgccggactgtgccggtaaagagcacgttcttctgcaggacaatgcccaccgcttcacgcagagactcgatatcgtagtccctgacatcgtggccagaaaccaccacggagcctttgctcacgtcgtagagccgagccaagagttgcaccattgagctcttgcctgaaccggttccgccgaggatccccagcgtgctacctgcgggaactgaaagcgtgatgtcgctcaagaccggtttctctgcgtgcttcgtatattggaagctgacgtggtcgtagctgaaggagctggtcttcacgtgcttgattgcctgcttcgcggaaggctctttgagctccggctcctcacgcaggacatctcccacgcggtggatactggtaagcgagcgcacaagcagcaggaatacattggagatcatacgcagtgagttgttgatcagaagcacgtagctcataaagcccgtcagggcaccgataccgagagtcccattcaggatcatctgcccaccgaaccacagcaggcacacgctcgtgacgttcatcgaggcctggaagatcggcatgttgagcacgcttgtcaagaaggttgtggtcgcgatatcggcctgcttcctgttgactccctcaaagcgctccgcagcccagggttcacgcacgtaggctttgactgcatggatcgcaacgagattctcctgcagcactgcattcaggcgatccatcgcctgctgcaacactgagaagtacggtgccacgtggtgcacgatcagaaagagtgccagcgccaggcaaggtaggatgaccgcaaagaccagcgtgagctgtggactcatcgtaaacgacaaaatgagccccataacgagcatgatgggaccacgcagaagcgggcggaagccttgcaccagagcgtcctgaatgactgtgacgtcactcgtgaggcgtgtcacgagtgaggaggattcaaagtggtcgaggttggagaaggagagccgctgtacatgcgcataggcgctacggcgcaggtttgtcccaaagcccatcgcagcttccgctgcgaaatgagcataccccatcccggagacacccgcgacaagcgccagcaaaagcatcctgattccgatctgcacaatcagctctgtatcgcccgaagggatcgcagcatcgaccatctgtgccatcgtaaacgggataacgagctccatcgtcgcctcgatgcaggcacagatcgccgcgagcacaaaggaccgcttgtagggtccaaaggctgacccgacaatcgcaaggtcactcagttctgtttgcttatcgtttgctttcacggctacctcctccctggtcagcgttaatcaggttgtggtgggcggtctgaagacagcgcttaaagcaagcaatgtcctggtcgctcagccccttgagcatggcgcgcacctcgtcgtcgcagacctgctcccatttggcaagtatctgttttcccacctcaatcagggagaccagcttggttcggcagtcggtacccttgcggatcgttacaaatccgttctctctgagtgcgttcagcatacgtgagactgccgcggcatcgagcccgaagcattcagccgtactcgactgcgtcgaggggccgaaggcctgcaggtagctcaagagcttaggctgccccggacctaacttgatcggtttcatgcacggatagaaatagttctgctgcgcatggtgggcctgggaaagcagagtgtgtatatcgaacagggagcgaccgggcccacccgtctgttctgggcattgttccacagaaccaccttcctacctttcattcacgttctaaagagttgatatatcaacacttgatatgccaactaattttcagcgcaaacattaaaccgattagggatcttagacacatccctcactgcattttcatagaaatggctaagcacttccggcacactcccaacacttcctgtcacccctgcactgtacgatatggatgtaaagtgatgcatccgtcaaaacagagaaagacatagccaaagggcatacaggcgggcttgagcctgaaggaatgcaagcgcaggaagaaatgcttatggacctcacagagaggtatcaaggcgaggagtcgtacgaaaaaagcttttgggaaagaagttcccctgaagctttgcctgtccggcctgcaaagggaccagctgctcagaaggtgcacgggcatacacacacctatggtagtgcacgagatatttaacaccggcttcagcctcactgcagacacgatgatggaaaacacccacctgccttcaggacgtggtctgtagccttctggctcatagcacaccaaaaaggttgagcacgagcgcatgtgcgctcaagcgccagataggccacagctacaggacagcgtccttgctgctgtgccatagcgagattgaagtgtactcgatgtcctctcagctgacacactcgaggtggacggctcctatatagaagccagggcaaaaggcacaaggggatacggcacaaagcagcagcccatgctcgctgcgatggacagggcgcctgcgtcaatccgctgggctaaggactgccccaagacttctggcaggtcgcggataggagcggatgtctgaaggggatatcggtcggactctcctccttctgcgagctcgcccagaagaagtgtgacagcttcgacggtggtgtatcgcttcccctgagggctacaggctcatctcgaatatcaaggtatatgtctgtagcacgttccatagcctgccgaaggcgcacacacagtcgtatgcagacttcttcagcttggcggtacagccacaggggctacaacgatgcatgtatggagctcctgcatgggatgtgccttgtgcatgtgccgctctctccggcatcgctgcgacagtcacactgcagctgaagttgcctaagccgcttgcagttcggcagacctaactgtgcttaaagtcctcagcaccgagaattcaaagttggcctgcccacgtaggcaggccagataattggtccgtggtgcggcgacccatctttgcagcttgcgccccgagggggctgcactcaaatggacctgtcctgtgccacgggccgaagctaaggcctggcgatgacctgataggagcctaagtgcaggcttggggcccacacaaccctatgttagcgctcccttcgctgctttgtcttgcctacctaggccggcaggcaaggcgcgaggaagggacggaaggaagatgtcgaagggcatagagctcacagacagaaagctcgaggggaagatcgtcgccggcatcgacacacacgcggacacgcactggctgtgtgtcttggacgaagaggtgcagggtcgcgctgttgcgcgagtttctgtccacaccgaacggcttcgagggcacgtggctcctacggagctggcctcacggacactcagggtgctggaggtcctcaacaagaagaaggaccaaagaaggaggcgcggtgagggcaaggacgacgagaccgacgccgacgggacgtccatccccaagctgcgcggtggtaggctcgatgagctcaggtcgctgcttgtggcacgtaagcgcttgtgtgtcctgtgcgctcgaggtccatgcggccgcgctttcgcttaccaggacagtccccgacgatgttcgcagtaggtgggagggcatgtaggagaggatgatgagggcggccctgaagatcgacgagggcgcagccgacgcactgggtaggccgccagggatgaggtggacgcccccgagcatctcataaggggcgtggtcgctgagcaccgtcgctgcttacaatctagtgccttaagaccctgggcacctccgagctcgctgtcgccgcagacgacaaccccgaaaggctcaaggagcaaggccacattcgcgatgctgtgcggaacatcgcccatcccggcatcgtctggcaagacatcgggttgcatacacctcaacaggggcgctgaccggcgtgccaacaaggcgctgcacaccgtcgcggtgaggcgcatgagatacgaccccaaggacaaaaggctacgttaagcggcgcatgtcggagcaacacgccctctcgaagcttgaggcaatcaggtgcgtcaagaggcacatcgcgcgcgaggtctaccatacgctcatgcactcagggacggaggtcgagcgggtcgacaggttctcgctcagggaggcgcacaagagcgccggcctgaaccaggccaaggtcgcgcatgccctcgaggtgtcgccttccacggtgagcggatttgagtccggaaggtgcgagagccagatgttcgcggagaggtattccacctgggtactcgagagcatgccgatagatgtcgaaggcccaggaaacggctcttgacatctataggagtgtccattttcatagaaatgctacaacgagccagtacatcagccgcaccgccaacagaaaaatgtcgattgagctccccgcatggatactcaaccggcatatgcgacatcaatttaagcaaccttgctacgaggcttagcctaagatcagcaacgcccccatcgtgtaaataaccagaagcacgattgtaaatgtgttgtagaactgcttacgtagcaccatataagccacccattcgcgcaccagtgcattgagcgcaaagtagaggcttacatgggatccgacgccgtccgcctgaatattgagctcacgggccagcagcagcgcgcgaaacacatggtagttatctgacacgaccagaaaacgcgtctcctgatgctcttttgaaggatgatctattcgatactgcgcccacacggcatcagaatactgcagattctccttggtcgtcgcggagtgattctccaacaggatcttgttctcaggaaccccctgcgccagtgcataggtcttcatggagcttgcctcggactgaacctcgtcagcaccctggccccctgagaggatgagcatcgcctccggatgcttatgcagctgctcaatccccttgtcgacccgcttggcaagcaagggagtcggtgacccatcgggcatgagccccgctccatggacgatgattgcgacgtagtgacggtggtaatgggggatctgagcgatcatggcggagaccgtgtaaagcgtgaaggcgataccgaagataaagaaaagaactgcgataaaaccaaagataaagtcgaagactcctcctgccaccggcacgtttgagagcgcattcctcacaactgaccagatgatcaggtaggcaatcatcccaagtccgagtcctaaggacaggacattgcggaagctggcaccttcccgacggatcagtttgatccccgagacgatgagggtaataaccagagcgaccgggaagatcatcagcaggatcaaaaagaccatatcgattacagcaccgacgttgcggtaggtctcaaacccctctgcttgaagcatcgccggtatcgcgatagtcacaaatgcaagcaaggatccggcagccaaaataccggtaaatccaagccacaggctccgctcttcgtgagttcgcagtctccagaaccatagctgcaacagggtagtcaggatagccgccccgataccaatcaatgtctgtgaatccataccaggcctctccattgggccccatcgccgaactgattacaaactttatggacactatcctacttgaattcccctaccaactgcaatgtctgaaagtgaaagacgtcccagggtgtcttgttagcgaggcatctattcggtcttaggttggtagcattcgtatagagctgtctgacttcagataaggtggtatcacaaaagcttgtacactttgggaggtactcttagatagggccatagctgtctttcaacgctcgctttttgctacaggtgataaggcagacagaagagaaactcagctttcagtgtctgtgtgacatctctgtgctgtgcagatctctttgtctctctttggtgtgctggtcttgacaggacaaccggatacagcaagctttcctgtcttagctacagcttgtgctgtatgcagtgtggctcgcaatatctggacagtgatttgacgttcagaagagaacccgcacaatgcgtacaagcacgcaaagaagactgccaacgagctcgcctttgagcacgacctaaaaccccaacctggtcaagaactaggtctcaaaggctacctttgagatagcgtgtgttcacagcgtccgaggacgagcgggggctcagtgagcctcattgcaagattggcgagcgcgactatcttcaacactgcctgtttaagcgctacagcatcgacataaaagacattcctggtcgatccaagaaacgctgatatcaacgtgggaaggtagctccagcagctgtagatcctcaggctcacctactacaaggccaagggccgcgcaggcgctcttttgagggatctaatcgcaagcgctccatgcgcatcgtggataacgtccacctgaagcagcccttatacagggcgaggaagataagccgtacactcgaggcgtcgaggtgctgggcgcaaaggctcatggagaagatgggtgtgtgctcgatctgccccaagccggccaagagctcggtgaagcatccctgcctgctgaagaacaaggcgatacgcttccccaaccaggtagcgtcgagatcacctacattccgatagggggcttgcacctgtatctgatctgtgtgatcggctggttcttccgctgtgtcgtgggctggaaggacttcatccgacatgggcgccgcaggtgtgtgcgagtgcatgcaccaggtactggaggagcacagaaaagctctcctgcgccaacttcgaccagggatcgcccttctccgctgcaacgtataagggcctgctggcttgctgaaacatctgccagagcatggacggcaaggccaagtgggtcgacaacgctatcgcaaaagagatgatctagaagcctcaagagtgagtgcgtgaggatcaacgagtacaaagcgcccactgagctcaagaaggctcagcgcgggcttacgctaagcagtacaacaacgagcggctccaccagctacttagctacgagacgcccctcaaactggtatcgcttagggctgatagcggcgtaaggccgccgggatcgaaggaggcgggcactctttcggggttgatttcagtgtcgaatcaactgggccactttaaacaagtattcgccctcgatacggcgtagatcagcagtaccctcgtactttatggaatcttctgctttatctccaacttttgggtgacgtcgtcgacgaacactttggcgttgcgggagccgcggtcaactacctcttgaatgccgccgttatgatcggcctcgctgtggcgggcagcaataccgttatctcgctcatactcatgtgtgtgatcgcgcttctatgtatacggtctcagtcctctgtgtatccctctttatgaaagcctcgcgtctaaagcacccgaaagtgctgacgctggcaagctccctggatccttctgctatgaacatcggaatttcattggacagcacaatcggaggatggagtgtcaccacttggggtatcacttcggtaggatcaatcgcagcggctctgtcgtgcagcgcagctcagctgttctacctcacagcccgcattgagcgtgcgacgctcaagaagccaaccccacaactttcacacgagaaataggttttgactatatatggatgaacaagatcaagctcgttactacttggaagaagcctgcatgcgtatcggttttccgcaggagttcggtcaggcgcttgcccagtatctgggaagcgccgccgcgatgaatgacatggcgcactaccttgtcaccgaccgaccccacaccctggaggaggctgccgacgaagccgtgacaattgtgcaggaacgctccacctggattgatatacagcgctcagagcacgcgcagcagacctacaacgccttcgttaaccgtccccgcgaagacgaggatgaggacgatgacaatgatggggattcagatgatgcgggtgacgagtggttcaggatttcctgaaccactctcagagtttgcattaatcgttggagctactggcactgtttgacgtatccgcattgctgtagtactgattgagtgcctgcgtcaggtcgatatccatatcaaccttgccgtcgatacctgagactgtgccataggaggaatactgccacaggccacatgggatcgccatcagcggctgatccgtgtaggaggccagccaatatccgtacgagtacagcgtcggatagttcagggattccagatcatagatgttgccgtaaacgacagcagtcttgcccttgttctggatctcctggcagaaggcctctgcaatctgctgtgagctctccacgttcagatccgagatgcgcgaatccgcaccgctggccggctcccagtcgaaggcaaccggatactcgatcgaggtcggtcccaactgacccagcacaaagttggcttcctcaaccgcctcatcgaccgaggtcgcctgtgagtagaagtagacccccacatcgagtccagccatctgggcaccaatcaggtttttgcggaagttggaatccccgacaatctgtccgttatcgctaccgcgatagcctgcacggatcatcgcgaaggagatgccgtcgtttctcacctggtgccagttgatgtcgccctggaattcggagacatcgataccggtacggctcatctcctgaccgtcaaccgtatagtgcagcctgcctaaggcatcccggttcaggttctgccactggtacggattgacataggagtcattctgttggctcaggccggagccgtagtactgaccggaaacttttggctcccagtagataccgtttgcaaagagaatcacgatcgcagcgacgagcgcgcagattacgataatgagcacgcggcgtacgatcaggccccgcttcttcttggagccctttttcttcttggacgtctgcttggtcgacttgctagtcttggtgctcttgctggctttcgtactcttcggagccttcgacgtttgcttcgtcgtcttagtcgtcttagtagctttcgtggtcttcgttgttgtagaggttttggaagtctttttcgtgtcagcgtccttgttctcaggttcagatgccttctcagtgggcttctccgggaaagacctagcttgagcaggctttctggaaggtttggcaggcgcggccgccggagcagcttttgcaggctgagccgcgaattcctcaggagctacggagctctcagagggcggctccacatgctttgccgcaggtttcgccatatgtttccccactgtggtgttcgcgccctcgtctggctcctcagcggcctttggtgcctcggtcgccggctttgtactgcctgaagctgccgctacgtgttgaggtgccttctcgtgttccccatctttttcctggtcaatgttggcaaaatgcttcggcacatagccatcctgtgccgtcggttgtttgtctgtggaggatgaatcgcttgtcggcatatcaactcctcatagagtgacgataattcattcctctatgatagagggtctcagaccctcccacgatatctcttcacaagtttcttcaaaaccgaggtcggaacccttttgggctcttcgctacttatggtcaagtccgaatccgtgtgtaaaatcgctgccgcgttccctgccttaagcctttgccatgtcactctggttgcgcgctatctttgcgagctcgtcttccacctgcaggagctgcgcgtaagtcctatccgtagtagctcttcctctgcgtcgagctgcactcgttctcctcggtaaggaccgacccgatcagcctgatcgccgacaccttactcgggaagaccccgacaaagcaggcgtgcctctctatctccctgttcagcctctccaggtagttggacaccctcatgtacaggctcatcgcggcgatcagtaccttcgccgcccttgaggcgacgtcgcgcaagtgcgccagtatctcgtcacgtgtgcgcctctcctccggcgcgcttggcagttgagcctctcgaccagctccccccttaaggccggcgcgcacgcccttgggggcggccttacacacgttgtacgagaagtgggcctggcagcgctgccaggcggcaccggggagcacctcccttacggccgccacgagcccctctctggcgtccacaagggagcgcaggaagtccacccaggagcgtcccgtgtgcgactcggcaagcgaggccccgatgaccttagcagtgccttggacctcacgcggtggtcgaccctgaccttgaggtaggtggcgtttgccatcacgaacggctactcgcccttaaggggccaatcgcaaaatgccctgatagcgcagtccagctcggcgcaggtctcaaaagacggagcgcttggagaacgaccttccacagacctcctctatgaccctgcccaccttcactgtaaagacgcccgcgacaaccatctcggtcacgagggtctcaaacggggcgttgcgctgccttaacaccttcagctcgatggtggcaaccctggtcgtgagggaccttgccttcgtctcgttgcggctgtcggtgcgctcgtagggctgggcgcacagctgctcggctgacttctccctcagtaccccgttgagcgtctcctggagcagcagcctgaaggtgtccccgtccccgtcggtaagcagccccagtaccacgtcctggtccagtgcaagattgattcgagccatgtccgtcctcttgggtgtcctcgttgtttggtgactgcgatcccagcttggcggcgggcctctgactcgcctgccttttacaccactttacggacgcgaccgatatccgcgcgttgggtagcgcattttgatacttttggcggggtaaggaagggatgctctgcctttgagcgaacggatgccttcctggactcgatgcttttttcgaacaagagtgcacaggcaaggccctctatggtcgaaggcttccttagcaacgctttagcacatagatgagaggtgtgggtctttatgcgtccttaagggcgcttcgctatacctatatagcctaaagtctgcatagcagaacctatcatcttcccttacgagtgtgtgtgccacaggatatgtcggatacattctaggcaatcgtctccacaccatgcacaaggccacctgcggcatctacgccgatatgcgccttgtatcagatacgccaggtcttccctttcttggactggtgcgccttaagggtcgcgcgtggtccttgttcttcgtggatctttagggcccaggtgaaggtcgcattcaccatggagccgccccgcgccgtgatccctgcctttttaagttctgaattcaggtcgtaaagcacaagctttgccgagtccctctcgctttaaggctatggcgcatcttcgcaagtgtcgttgcatctggcacctgcgcctgcatgaggtctgcgtgcacagaagcgctgccaggagcgacaatccaggatagcatctttaagttccctcgtcttaagagagcaaacattacctaaagcaggatacatcctaaagcatcgtctttacagcgcgcacatgcctgacaagagcatgtccgtggtagctggtatctaccagaacaatccagctgtcccacacaacgattgcatccatccgctccaggagtgcctcccgccgggtctttctcctcagaccttaggatttaaggtcttaaaagctcatctggctgtccatatctgtcttttggatattgctggaatgtgtggatgtagctataccatatccagaagacagataggcatctatgtgggtatgggcactgcgtggttcgagacattttgagccgatgtcatacagcgtgtagctccactggcctcatcgaggcgaattaatcatcgtttccctagagtctccggttgagatacagcagaagacgatgctcccaattccattctgtaaggccagctcgagggaggagcgatagcaggaggcaagctgcttacacttcgctttactcggctgtccggtctcgatgatcggtcccacagcgtgtagtacacgggaagctggcaggttgtagcccggtgtgaccttcgcctgtccggtcggctcaggatgtccctgcgcttccatcagcttgtagcatttgtgcctgagccccatgcctgcataggtttgaatcgcattgtcgatatacagtgacgattgagaatgaagtacccgagcatctggtcattggcggcattcacgattgcgccggtctcaagcgtggtgatatcaccccgcgacactccgagattttctgcattgaggggtaccgcgaaaggtttctgcacgctgcactcctgcaggcaacatgccaaatagtcatcctggatctccaggaactgatcgctcaccggctggggcatccgtacgttcatcagtgcccgcaagaggagacgccgacttccccgaccctgaaggatatggaacccccttgccttccccttcggtcgcataggtgtaggcggaatcgtgcagcaggtaactaatcagccaagttgcctcctcatcgtctgtcatgatcgctcccttatcttgttgtaatatatctttttacatctttatcgatgagtatcaccacaatttggtcactacacaagaagtcccacacaaccttcaaacagactgcgtgggacttgttccatccctatgtatataggtttgaatcaccgggcaatctccgcgatggcctttgcggcagtgtcgacctcttcctgtgtgttgaaccaaccgaagctgaagcgcacaacaccctgctccactgtacccagggctttgtgcatgagcggtgcgcagtgtgcgccggggcgggtggcgataccgtaatcttcggcaaggtggtcagagaccgcaccggagtcgtagtcgcccacattaagcgagacgatcgcagcgcgctccacattctcttccaccgtgatgtccccgtagactctgacgctggggatatccttcacctgctcgtagaagttcttcatcagctcatcctcgtgatgttcgatcgtgtcaagaccggtgtccttcaggtaattcaatgctgccgagaggcctgcgattccatgggaattcagcgttccagcttccaaacgagtcgggtagtcagagggttgtgtcttcaaataggactgcaccccggtgccacctacagcccacggcctaatatcaacaccctctctgatgcacagtccaccgatcccctgtgggcccatcagcgatttgtgcccggtgaagcataggacgtcgatattgtccttttccatatcgatcggaataacacccgccgtctgcgaagcatcgactacaaagagcagcccatgcttgtgggcaaacttcccgatcgcggcgatatccgccatgttcccggtcacattggaggcatggttgaccacgatgagcttggtgttggacttgaggaaagactcaaactcctcagtcttgagcctccccacctcgtcggtccccacaaagctgacctcgacattgtgttcagctcgcagccggtagagcgggcggagcactgaattgtgctcggtcaccgtagagatcacatggtcacccgggttgatcagccccatcagggcgatattgagtgcaccggtggagttcggcgcaaagcagacgtggtcaggtttgcagttaaagagctgcgccaactgggcgcgacagacgaagtcaacacgggtggctttcagcgattcagcgtgggaacctcgagaagcgttccccatcgtggttagggccttcgtcacagcatccacaacgacctgaggcttctgtatggtcgtcgccgcattgtcaagatagatcaatgagtatggttccaatcacatcgttcttactggtcatcttcaggataccagtctcgaaagagcggctcacgcatacctcttagctacccccactcaccgatataagcggacgttcaatgaagcgatgtatcgctaccgacgtttggtagtgtgtttatgcgtcagatgccacccatcacaatagggacagtgatagtaggtgattttgggcgtgtctttctttgcggaagcgcgggccgcggctttcttcgcttcaagctccgtcgcaaagcggcgtttacgagcacaggtccggtattccaggatgtcttccccacgctgctgtccggccatcccgtagccggaagatctccagttcttgcgggaacctgcttcagataagttatgcacgcggtcgagctttttcctcattgttcgcggaacgtcacgttgttcgtctctgagtccatagattcgacgattgcgagtgaatccagcctatagccctcagagcgcaggcgtttacctcccggctggaagcccttttcgattgcgataccaatgccttcaacggtagcaccggcctgcgtgcagatctgcagaaggccgtccattgcacagccattcgcaaggaagtcgtcaacgatcagcacatggtcatccagacctaagaagcgttgcgcaacgataatgtcatagacccgtttgtgggtataggacttcacctttgaggtgtagaccgccccatccaggttgatgctcttggacttcttggcaaacactgccggaaccccgaactcgttggctgccattgcggcgataccgataccggaggcttcaatcgtgaggatcttgttgatcggagcatcggcaaaatctttgtgccactgcttggccatatccgcaaagagcttggtgtccatctgatggttcaagaaggaatcaaccttaagaacgtctcctggctttacgtccccatcgcgcagaatacgctcttccagctctttcatacatcctcccagtatggcatatgcagcatctgaacgatacttacttatttattgttagcagcacctcaagatttaagcatactccacggtggtttgggggtacgcataccaaaaatcgctatagtgaaacaaaccccttagaccaatacggaatttagaagtatgacctattcattaaaagactcgccctttgccccattactcacctcttgtgcctccggcggaggttatcttgccttcatcgggggcggtggcaagacgacgttgatggaggaattgggagaagagctccaccgcgcatttcctgcaaaaaccgtggcactgaccacaacaaccaaggtgtggccgcctaaggtacttcctctgatcgcggaggatgacacagacaaagcggttgaggagcttaaagaagatagactcgcctatatcggagagtactgcgaagtcaggggcctcaaaaagattgaagcgccctcctggggcgtcgagaaactcgccacgctggcagattttattctgattgaagcggatggatcccacgaacgtcccctcaaggcacatgcctcctgggagcccgcctatccggatctcccctgcttcacgatcgcagtcgtcggggcttccggcttcgatgaaccggtgattgaagtagtccaccgcccggagctcttttgccgccgcatgaaattaagctcccacgcaaaggcaacccccgagctcatcgcccaggagatgggtcaagagcatcagaagaaacatctcaccttcgacgtggtcttcgtgaaccagtgcgacgagtcagacctctacatcgaagcggcgcagctctttgccgagaccctacacgctacgcttcccgatatgcccatctattacggatcagcgcgggctaagacctgcacccgcgccgattgaagcaacctatgcagctgttagtgctgaggagcgcagtccgtgggtccggtggcattgatcagtgcaagcccatgcggcagtgccggcagcaccgcctgtagattctctcgggcggccttcgggctcccggggagattgataatgagggtccggtcggcaatgcccgcctcctcacgggagaggcacccatgtggggtgatcgcgagcgaagctgcacgcatcgcttccggaatacctggacaacgacgttgaatgacctgcaaggtcgcctccggcgtcacatcgcgcggtgcaaagccggtgccaccggtcgtcaaaaccagcgctactttatcctgtaccgcctgctcgagcactgctctaatttgatcctgcttgtcgggtacgagcacgacctcagactcaaccgcatagccctcatcctgcagcaacttcactaacgcgggaccggaagcgtctttgcgtgtcccttgtgaagagcggtcactcaccgtgatcacccgagcgctagaagccgcttttttgttatctgcatcgcccatagagccatcgccttatttgccaaaggggcacatcggataggtgcagggctcgcagtaaaggcacaggccaccctcacccattgtcacgaagtcctgcttcatgaggggaacgcgtgccgcaaggcgcgacaagacaaggtcgaagaccgtcgccttgttgtacatgacacagcccggcaagccgatgattggggtggggtcgcggccgtcttgtgtatcgaagtacccaaggcagagcatcgctccgggcaacaccggtgcgccatacgtcacgatgcgagccccagcgtgcttgatagcacccggtgtattgtcatccggatccacactcataccgccggtgcagacgatcatatcaaccttgaggtgacgagcatccgcgattgcccgcacgagatcatccatattgtctccgggtttcacgacgctcacggtcttgactccatactctgcaagctttcgctccaccaccggagtgaatttgtcctcgatcaggcctttcttaatctcagagccggtcgcaatcattgcggcagtctttaccttgtacggtgctacgcgcatgagcgcaccttggtgtgccacgtctgcggcctgctctgcccgctcgacaagtttttcgtcgatcaccaacgggatcacgcgggtccccgccagtgagtcgcccttgttgaccgggaagttaccgtgacgggtagcaatcatcacctggtcgacactgttgaccgcattcaggcgcttcgtatcgacgaggaatacgccgtcacaggccgcattgatctcgatcttgccttctttcggttcccctgaagcgcaggtgttgctgccgagacacagcgccgccatgcgccttgcggcatcatcttcgtggagcatcccttcctgtatctcccatacatagagatgctctttgcccatgcttagcagtacggggatgtcctccggttgcactacatgccccttacggaagcgtggacccttaaaggacttctggggtttgccatccttgtcggtaccacccatcacgatctgggtcatatcctggcagaggacttgccctaccgcgtcttcagtgcgaatgagtttcatacattgcctctccactattcaatgcgcttaatgcgtatggtggacgtaaattgtgtctcctgccttcacggtacctgactgcgtcacgacgcaaaagataccgtcggtcggcatcacgcacatgcctgtcaaccgcttaatctcgcagtcgctgtggcaggtctttccgatctgcgtcacgaccatccgaaccggaccgacatcaataattgagcccgtcgggatcttcgggagatcgataccctcagtcaggatgttctccgcaaagtcaccgggatgtaagtccaaacctttggcacgcattttatccactgactcattgcccaacaggctcacctggcgatgccagttgccggcatgggcatcgttcgcgatacctttgccgactttgagctcgatcgcatccaccaggtgtttgcgggtccctctcttctccgagatgcaggttgctacgaccgtgccctgtgaagcgatatcgtcgtttttctcgtctttccgaacgaagtgacccgacttaccaccgtccttctcaagcaggcgtacctgctcaatcaccatgtcacgctgcagggccttacacatgtcatagatcgtgaggcctgcgacgctcgcagcggtcaacgcttccatctcgacaccggtctccccggtacacttcgtggccgcgacaaaagagatcccatccggctcaaactggaagtcgatgtcgcagcccgtaagctgaatcggatggcacatcgggataagctcccagcacttctttgctgccatgatccccgccacttgagccaccgccagcacatctccctttttgacgccgccagtgcgcaccagattcagagtctccggattcatcaggatctttccagcagcgcgtgcaatacggcaagtcttgtcctttgctgacacgtcgaccatccgggcacgtccctgctcattgatgtgtgtcaaatccatgctctatcctccaatttcgttcatgtcgcgcagtgcatctgagtgatggtgctcaagcaattcgtggtggaggggtttcagtgcaatccctcgttgaatcgtggcacgcagttcatcgtcgttgagccccctcagattgatctcattggcggtatgcagacagggtttcagctttccgtctgcagtcacccgcacccgggtacacccggcacagaacctgttgctcagcggccgtatcaggcctaccttgcctttccagcccggcacctggtagagttctgccacaccttcgtggtctataggtttcagatctggtaccaacttcagcaccgtatcagctgggataaaccgctcccggggccagacggtgcaaggccccatcggcatcaactcaataaagcgcacctcgtaagatccatctttcgtgagtttcaccagctcaggcacctcagtatcattgatgccgcccatcagcaccgcattgaacttggtatgggtaaaacctgcctcacgggcagcctgaatgccagccaatgcctgatcgagcgtcccagtccgggtgatccggtgatagagctcaggattgagcgtatccagcgagatattgagccgatccaaccccgcttccttcaagggctttgcaaggctgggaagccccagtccattggtagtcatcgtgagctcgtcgatcccagggattgcgtggagcattgcgacaaagtcgacgaccccacgccgcaccagcgggtctcccccggtgatcctcaccttatgcacacccatttctgtcatcacctgggtgatgtgtgccaactcctcaaatgagcagatatcctgatgcctgagcttgggcaccccctctgctggcatacagtactgacagcgacagttgcaccgatctgtgattgaaagacgcagatattcaatgtgtcttccttcagtgtcatacatcaggcaaactctttcttactttttgtaaggtatactatcatccttttcgttatactccattgactctatcgcaccagagcaggaccggtcaccggaacaataaacacgcactaaacggtcagatccaccacactggagcaatctctgatactgggttaactgaaagcaaaaacgccggggtaacggagtgattccgctacccaagcgttggcattcatgtctctagtgttctctggctagttcttgatgtgctgatgggaacagtcaggacgatactctgcacggcactcaatcatctgcgcggcaatcgagattgcaatctccgacggtgttaccgccaagatatcctcaccgattggcagatggatgttctgcacatcggttgggtcgcacccccgctcaatcaatgtctgacgcgcaaacgcggctttgctacagctcccgatgcagcccacatatgcggggcggttcttcagagcctgctcgagcacatcgatatcccctttatggccgtgggtcagcaccaccacatagtcacgcggagtgatgtgcacatagtcgttgagcttcttgaagtctccgaccaggaccttctcagcctgggggaaatcctccgacttggcgaggtcgggacgatcgtccattatgatcaccttgaagccgacgctcgcgagcaccggggtcaacgcatgcccgacatggcccgcaccgaagataaaggccttcgggtctgcccccatgggctcactgtagagcttggtggcctcatcccagaccgggacatccgcactaacgcgcttgtcatctgtgggcagctcatccaactctactgtcgtgatcttcacatctgcaggatcagaccagtcctcttccagcaggaagggcttgccttccttgaggcagcctaagatctcatccttcaggatatggagctcctgcttcgccgggaacgaatggcgcaccgagaccaatgcgtcgcccccacaggccatctttgtctttgcgtgggtcagccactcgatcgagttacccctttctccgctcattaccttctgggagcgctcctgtgccatcatctcgatgcgaccaccgccgatcgtaccgataaaggaaccgtctgcgagcagcaccatacgcgcagaggcgtgccggggcattgagccccgcgtcgctaagacggaggacatgacaaacggatggccagcctcgacctcggcgaccagctttcctacaaactgctcgtcgcgcagggtctcgtgtgaatcactcatatatctaactttctttctcaggtgggttatgccattgtctcactgctgtggatatggatgcgtttacctgccgtatgctcggcaacgctgcccacttcgctcacgtacatcacctcatcatttgccttcagcgcatcaagcaaagccggggcatcctgaggatcgaccgcaatcatcagaccgccggaggtctccggacagaaaagcacatccatcagatcaagcggcacgcccggggcatccacctccgtctccgcaaaatggcggttacggtactcaccagcgggaagcaggccgagttttgcaatgtcgcggacacccgggatcaattggatgttatcggcgtcgatattgatgtcaacatcggcaccctgcgccatctccaacaggtggcccatcataccaaaaccggtgacatccgtcgctgcgtgcaccttatactggaccatcgtatcgcgcgcagcccgattgagcgtgagcatcgcatcgagcgccatctgctcattctcaggttttgcgagcccctctctatcggcggtgacggtaggaccgatacccaacggcttggtgtagatcaagacgtccccgaccttggcactcgcattagttaagagcttcttgaggttgacgaggccgaccacggccaggccatacttcggctctttgtcgtagatggagtgtccacccgcgatggaggctccggcttcgtagactttctcgtaaccgccacggaggatatcgtgcacgatatcagagggcatatcctccggtaccgccataatgttcagggcgactttagcctctccgcccattgcaaagatgtcggagagcgcattggctgcggcgatggcgccgtaagtatacgggtcgtccacgatcggcgggaagaaatcgagtgtcatcacaaaggccaggtcgtcgctcagcttatagaccgccgcatcgtcagccttgtcgtaccccacgatcaggttggggtcacggtgtgtaggaagcccagtcaagagctccactaattctccggcgcccaccttcgcggcgcagccggcacactcagcgagtttggtaagttttacgtcgtccttcgcttcactcatggttttgctcctcgtcgtctcgaaccggacgctctccctgttcggtgaccagcggcttactgtccgccagagtacccgaaagattcaaaatcgcttccagaacaccgccgccgacggcgattgccttatccgaggcacagcgagaataggcaacgacccctctggggtccacgtcgcctgacttcatgcctttacgcacgtgtgccccggtctggatcaggccacggaccacgccgccaagcgttgcgagcatcggcttacccgccacggtgccacacacatccccttggtggaccatatcgccgatcgagaccacaccctcaaaggtgccatctgcaggggcgcgcatcacgcgctcaccggcatagccgccgatcaagcccggcaccgccgtgttgggaatcggctttccaaagtaccagacacgacccagatagtggccgcgcatcgtctcaatcaccgcgtcgcagtccttctgagcctcaaagcccgggccgcaggcgataaccacgggcgccatatcctttgtggtgcccaggttcttcttagctaagatcgcatcgaccacaacctgtggcttgagctcgttgatgcagttcgcttcaggatctgccagaacggcgatcttgtggctttgagcaagcttgagcgcctcctgaggatcggcggccttgaccgcttccacaccctcgacggagtagcttcccaaacggatcgcttcactgaagcagacggtacgacggattgaggttgggatgggtagatcgcacatcacgatctgcataccgctccgaaaaagccgaagcgccaccccggtggcgatatcccctgcgccacggataacaacgagcatagtgttccttataaacctcggacttagatcagcgtgacacccggattggaggagaaggtctgcgcgatctcatagagattcgtgacgccgccgattgcgagctggtcacgcatcttgtagtagtcaaggcaggtgccacaggtcaggatcgtggtgccacgcttctcaagctccttcaggtcctcgaggctctcagagcctttgcaggtgaggtaggcgccaccgttgaagaagatcatcttcttggggaccttctcctggtgagcgaatgcatagatcaagcctttgatcaggatcttaccgagctcgtcgttgccctcgcccatgtggtccttaccaattgcgataacggaggaattgacgtccgggatctcgcagaaatcagcagcttcatcctgagcggagcggtcagaggtgatcacaccgcgcggcgtcaacgtcaatatcgtctcgtcaccattcgcctcggtcttaaggtcgcagtctttctcctgcgccaggcgggccaggttgtggacggcggcctcgttatttacgatgacctcgaggttctcatctttttgcagcttcggcaaggctccaagggccataacaaccggtttcggacaggtctgatttcttgcatcaacacgcacagcactctccttatcacgtggtgtcaaagaaatgtgtttaaactgatcactgataagtatatgcccatcggttagtgtaccaaaggaggggctgacaaaaatccgtacatctgattcgaagattggagtgtcagaggtatcaagaagaccaaaagaactgcttcattgaagaatatgagtgcaacggtcacttcattggcaaagcaatgcagacgctagggtatccacgtgataggaaaacagcgcacaagttcttgcaaggacacaatgtggattatgccctctgttgcaagaaggtggcgtgagcataagccccacagaagctttgaagagtacagatggcgattattcattgctagtgcaacgcccctggaaagaccacagcctgcgggctcctagaagggtgcttgcgaaagaaaccgaccaggaggatctcatgggtcaccaccatcttagcatctaccagcgcgagaccatcgctatcatgctccacgacaaggacagcccagacaccatcggctgcgataagtcgaccgtctccgggaagatcaagcgcaacttatggcacgtgaggaagcgcagccgctacagcgtcgcctacactatcgagcacacggcgcaaaagcaggaagtgcaggtgcaaaaagctgctggagacccccaagcgcacgcatcgtctgcgagaagatcttcgagcagcgctgctcccccagggtagcgcgtacctggtcgcgggactgcaagagcgggattttcgccaaaggcaagatgtgcgcgcaggtagagccagcaatcgaagaggcgctttgcggcaagccgatggagacgatcatgctggagcgcggcaagcagttcgcgtacaccgaggggctccaggaggctctcagtgctcggtcttcttctgcctgctatcccctgggagcgggccaccaatgagaacaccaacgggctccttcgcgacttcttctcgaagggcagatccctggacgacgtgagcggcgagtaggcccaggaggtatacgataccctcaaccgcaggccttgcaagcgcctgggctggaagtacccgctggaggtcttctgcggggtcacgttgtacttgctctgaagattcgccccagaaagattccggatagctcatgaaggctgcagtccaagcagcagcgagcctgaccctgcgagcttgggaattctaagcgcaaagacctgccctcatgcgcagcccagctttgctccacccaagccggctctactttttccatactatcagagctcccttgcacctgcgcactcatgcggatggcacggacgaaaccttggttacttgttgcatcggctgatttgcagcagattggacatttggggcctatgagctgctcattcaaccgagagttgagccatggttgagagcgtctcgagccacatcaacccttccgtcattgcaccatcctgccaacccgtcagaatggaacatgaaaaggacgtcgcccaagaagatgaaaccagaacccatgcggcagatgccacagcaggccatatagagggagagagcaatgtctgagaaagagaccatgggaaggcgcatcgcgagactgcgcatcgagcacggcatgacacaggaacatctcgcccgcgagatgggcgtgagcgcccaggctgtgagcaaatgggagcatgaccagaactaccctgacatcagcttgctcgtgcctttggcaaaattcctcggcacaacgaccgacgagctcctcggggcaggacctactacggcgccggcagagaacaagaaagaggaagagactccttctgtgtctgccacagaggaggcagaacccgagtctgagccagaaaacgtcgaggtccagccatccccgaagaagcgcaggggaccgatctctctcatcctttctggcaaggatgcagatgacagcgaagaggtacacacgccctccgagagaccaaagaccatgcatatccagtgcatcgacggcgacgaccccgacgaggtcgtgaacctcaatatcccgctcttcctcgcaaaaggtttcctcaagagcggcgtctcgagcatctcaggcctcgaaggcctcggcgtcgatctttccagcgccgcttccgccatggacttctccgaggcaggcacgctcgtcgatatggaggatggcggagaccacgtccgcatatggatcgactagcgacgcttcatatcattccacaagaaaggcatagccatgaaacaagcagcctctgccacagatgacgggctggagagcgagctttgggcatcgatgctcgagcacaaccatctgctcctcgctgccgtcatagcgcttggcatcttcgaaggcctcatcgggagcttcttctcctgggtcgtgaagctcatcctcgatgctatcgcctcgaactccctggagcagctcaggttctccgccatccttgcagccctctcgataggcttcgaacttgtcgatacgctccttctgaggcaggccgaaccggcatctttgaggtgtgctgtcatgaacttgcgcacgcactccttcgcaaagctgctcgacaagggcatcggtgccttcgaccaaggcggagcctctatctacgaatctgctttcacgaacgacatcacgacgatcgaaacgacctatctcgagaagatcgagaccttggcaacagacatcccgatgttcatctctgctgtgattcttctcttcatggagagtgtgcctctggctacctgggccatcgtctgcgccgtgctgtcgctttggatctctgtcgtctccggcaagcgcctggctccgcgccagaaggccatctcggacgagatgggacatttcgtcgcagcagttcatgacataatcgcaggctttgcgcagatcaagagcttcaaggcagaaaagcccacagagagacgcttccttgctgccaacactgagctcgaagatgccaagcaggcaaagcgccgctgcgagaaggcaatcatggctgtggcggagacgacaggctctatctcccagatatcggttctcttcttcggcgcctggctctgcgtgacgcagcaggcgataacgatcggcggcatcatgatggtgacgcagctcatgaactatatccacatccccattgccaaccttccgtccatctttgcagccagaaaggcctccaaggcgctctgcgaaaagcttgcccaggaactcgagcgtgcccagacagaagagggaactcttgcgctcacaccagagcttccgcaggacatcacgcttcaggatgtctccttcggctacgaggaaggaaaccccgtcctcaaaggcatcacggcagagtttgaggctggaaagtgctatgccgtggtaggagcatcgggttcaggaaaatcgacgctcctttcgctcctcatgggtgcacacaggagctatgaaggcaaggtcgccttcgatgggtccgagctccatgatatcagcctcgactccctctacgggacagaatcgctcgtgagccagaatactttcctcttcgataccagcttgaaggacaacatcacgatgttcggcgatgcagacgaggatgccctctcctccgctatcgagcgcgcggggctcgccgacttcgtagcagcacatgggctcgactaccagtgcggcgaggaaggagccaacctctcgggtggcgagcgccagcgtgtctgcatagcaagagctctgctccatggagcaaggacgcttctcttcgacgaggcaacaagcgccctcgaccagaggaccgcagatcaggtcacacgagcggtcctggggctttccggcacgacgaggatcatggtgacacataggctcgatgcaggactcctcaagggttttgacagcatcacagttctgaaagacggcaaggtctgcgaagaaggaaccttcgacgagctcatagcagagcctgagggctacttccatgccctctataccatcagcatgtgattgtaggagcaaagcaaagacagaagcaccatcgaagacaattcggtggcgcttcttctgtatgttccctagggaaacgatgattaatgccccataacgtgttagagggaaccgaccacacgacttttcgcggccggtatgcgggaaaggcagggaaggatgcccatccagcacgtgcaggagccgctatccttacatctgtcctgccccatgcaccgcaagaaggctccaagacggatcaagcgactctgggagccggaaggtgcagcctgccggcagagatacacatgggtaaggtttgcaagggcgagagagactcgagtgtacaggcatcttctctatcccctagtagcacttccttaaggggccgaagcgccgcttcacgatgaggaagggatgcttctacctttgagcggccggatgccttcctggactcgatgcccttatcggagaagagcgcacaggcaaggccctctctagtcgaaggcttccttagcaacgctttagcgcatagatgagaggtgtgggtctttatgcgtccttaagggcgcttcgctatacctatatagcctaaagtctgtgcagcagaacctgtcatactcccttacgagtgcatgtgccacaggatatgtcggatacattctaggcgatcgtctctacagcatgcacaaggccacctgcggcatccacgccgatatgcgccttgtatcagatacgccaggctcctcctttcttggactggtgcgccttaagggtcgcgcgtggtccttgttcttcgttaagctttagggcccagatgaaagttacatccaccatggagccaccccgcgccgtgatccctgcctttttaagttctgaattcaggtcgtaaagcacaagctttgccgagtccctctcgctttaaggctatggcgcatcttcgcaagcgtcgttgcatctggcacctgcgcctgcatgaggtctgcgtgcacagaagcgctgccaggagtggcaatccaggatagcatctttaagttccctcgtcttaagagagcaaacataacctaaagcaggatacatcctaaagcatcgtctttacagcgcgcacatgcctgacaagagcatgtccgtggtagctggtatctaccagaacaatccagctgtcccacacaacgattgcatccatccgctccaggaatgcctctcgtctggtctttctcctcagaccttaggatttaaggtcttaaaagctcatcttatctgtccatatctgccttttggatatgcaggaatgtgtggatgtagctataccatatccagaagacagataggcatctatgtgggtatgggcactgcgtggttcgagacattttaagccgatgtcatacagcgtgtggccccagtgacctcatcgaggcgaattaatcatcgtttccctagatccggaaaaatatccaggccccctgatgagaaatcacacttgatattctgtcttcttagaacgttaaacccgaccgcctctgcaaagtacggtgctatctatcttctctctcaagagcatgcaggctccgttctcgctcgcagagcctgcagatcgcgttcggtgaccaatatgctacgagagatcgatcctctgtccggcaacgaatttatcaacgagatggccgccctcatctgccagatacatataacgttcaaagcgctgcgacaaggtgagctcaagcggtgtcgcaagtgccgaatcgtccagcacaaggatgtcggcgtcgtatccccaatcaaaggagccgaccttcccatagacctgcccgccaccttgggtagccaggtagaaggcttcagtggttgtgagcggcgaaagatcttgatccaccatacgccagcgcagctttgataccataaccgcatccgcacaggcacggaacatattcaaggacgcgccaccggcaatatcggttccgaggcccacttgcatgtcttcgttcaggtagcggcggatcggcgcgatgccggaggcgagctgtgcattggactgaggacagtgggcgatcgtgacgtcgttgcgctttaggatctcaatctcctcgtcggaggaccaattgcagtgcgccatgatcaccggctcctccccggctaactccccgaagtgttcgtaggtctcaccgtagcagctcgaccaagggcagagctctttgacccagtcgatctcagagaggttctctgacagatgtgactggaggggaagctgccagtcgtgcctcaggtttcccaaccctttcatcagctcatcagtgcacgatggggtaaaccgtggcgtcaggatcggctgggtattgagatagttccgctcattgactgcgttgagccagcgtacagtctccttgaggctggtttgagcatcctgctccctcagatagtcggggctgttgcggtccatactgactttgcctaccatcgtcttgagccctgaggtttcaagcaaatccatcagctcgagggtggcgtccatatgcatcgtcgcaaagatcgtggcgcgggtcgtgtaggagcgtctgaggttgcgtacaaagttcttgtaggagcgcttcgcatagtcgaggtctgcgaacttagtttcctccgggaaagcatggatggtgagccaatcgaggagctcgaggtccataccgataccacggaagttgtactggggtgcatgcaggtggatatcgttcaaaccggggacaacgagcatgccggtgtggtcgatcagcggataatcacggtactcccacgatatgtcattgaacacgccctgtgtgacaccgcctttcacgatcagatacccgtccggaaaacacttcagttcatcgggatatctggcccaaacgatgtcacctttcaggacgaaatcaggacaactcacgatggcacgtgcctttccgtataaagctcgacacatgaaaagaacctaccagacgcgctggtaagctcttataacaataacccttttcggtaggagaactaccccttaacagcgacaaccttgatctcgactttgctattgcccggaagtgcaacaacctggaaagcgcagcgggaaggatagggagcctcgaaaaactcaccatagaccttgttcattgcgtcaaagtcgttgatatcggtgaggaggacctcggactcaacaacgtctgccatggaagagccggcagcctcgaggatgttctcgatgttcgtcagactctgacgggtctggctgtccacatcgtcacctgcgagcttgttggtaactgggtcgatgccgagctggccggagacatggatggtgttgccagcctcaacggcggcggaataggggcccagtgctgcaggtgctttgtcggtaacgattgctttcttgctcatgaataacgctcctttgtcctcgctagtcaaaattattacttacccatcatgaacgagctacataccggccgggtttgttgcccagaggctccccatccctgactgcgagctcgccgttaatgaagacatatttaggtttgccgttgacctcaaagtcctcatagggagtgtagtcaacgttttgatgctggttctttgtgctgatggtccactcaacgttcgggttccacacgcagatatctgcatcggatcccacggccaacgcacccttcttcggatacatactgaagaccttcgcctggccctcgctcaagagcttgaggaagtccatgggtcccagcttctccgcgaagctcgtcatgatcagcgccgggcggtgctcaacgcccggaccaccgttcgggatcttggtgaagtcgccgcggccgcggtccttctgtccatgtagattgaaggagcagtggtcggttgagatctgatcgatctcaccgtcctcgaccgcttcacgcagcgccgcgatatccgtcggctttctcaacggtgggctcatcacgtacttggcgccggcaaacccgtcgtccccctgctcgaagtagcgggtatcgtcgagcagcaagtactgcggacaggtctccaggttgaccctcacaccgcgcttacgcgccatgcggacctgctccaagccttccttggtggagcagtgtacaacgttcacgcgggtaccggtgagctcagagaggtacatcaggcgcgagatggcctccgcctcaacgatgctggggcgagacagcggatggccttcagggccgacgatcccagcatcgaggacgcgcttctgcagcgcatcgacgagggtaccattctcgcagtggacgcagaggattccgtcaaactttccgacctcttcaagcagctccatcgtctgtgcgtcgtcgagcttcaggtggtcgtaggcaaagtaggacttgaaggaggtgatacccttctcgtggatgtcgggcagctcctcacgggtggtctcattccagtccgcgatcgccatgtggaacgcatagttagcgatacaggtaccgtcggcgcgcttgtgccactcgtccagtgcctgatgcagcgtcatacccttgtcctgcgtgcagtagtccacgatcgtcgtggtgccaccacaggcggccgcacgcgttccagtctcaaaggaatccgccgtccagtccatgcccgtccagcactgcatatgtgtgtgggcatcgataaagcccggatacacgtagcatccggtggcatcaaatacctgatcgtctgcggcctgcgcataggtgccgccgacctgtacgatctggtccctatcgaggactacgtccccgcaccgcaaacccttgggcgtgacgagcacgccacctcgaataacctgcatagcgctacccctttacttgttttcctctgtttcagaatcaaacgcctgctcaagctcactcagcgcctgaggggtatcaatatctctcacttccaacgcagaggcggcctccacgagtacggtcgaccgccgcaagtccggccttgccttcaacagcgcggagccacccacatcccctttgaggttgctcaggtcctgcgccaggtagcccgggaacaggaccggtgccgcaatactacccgcccaggagagccgaacgacgttcttgggatggcgctcaagcgcagatgcaagggcattgaggctctcggtggtgatgaggggctgatcccccgccaagaaaaggtaccccgcacgcttccccaaggcctcgataccggcacggaccgtgctagagacctcattgccttgcggggtggttacggcaaccccgctctgctgggcgagcgccctcacctcatcccaccgagaggcgacgaccacgtcaaacacactggcctgcgccgcttgcacaacacgtttgaggaccggaacgccctggaagggctccaggagcttctgccgaccgaaccgatgcgccgcccctgatgccatgaccacacagcccaagggcttcacattcccgatgcccgcaaagcaggtatagaagctcgcttccatatcccgctggatcgtttggctccaagcatcgtaacgctcgaggatatcctcaccctctggggtgaggtcggatccgccgccgctgacaccgccggcccggcggttgagcagtttgataccaagcccttcctccgcatggtcgatcaggtggcaagctttggtgtaggccatccccatctccttggaagcagcattcaggctgtgcgtccgtttgacgcgcatcagcagctcataggggccggggccaaagaagcgctgattgagatcgtccgccaaccaaacgtgtgaggatggggtcatagcgtaaagtctccttactgcgtcgtcggtgcagtggagccttaagcgtgcaccaccgttccggtcttgctctgaataccctcggacgccttgtcgagcaacgtgatgagggaggttctgccttccccggactgcgcaaactgcagcgcggcctggaccttcggcagcatggagccgggagcgaactctccgtctttgatgtatttcgcagccgtctcaggggtgagctcatcgagccactgctggttcggcttcccaaagtgtagcgcaaccttttcaacggcggtcaggatgatcaaggcatcggcgtcgagctgttcggccaaacgggctgctgcaaagtccttatcgatcacggcggcggcgcccttgaggtgatggccctgggtggtgtagaccgggatgccgccgccaccgcaggcgataaccacatggttcgtctgcacgagggaacggatcgtatcgatctcgacgatattctgaggtttcgggcttgcgaccacacggcgccaaccacggccggcgtcctcgacgacgttgtagccacggtcgtggacgagctgttgagcctcctcttctgtcatgaatgctccgatcggcttcgtgggatgctcaaaggccggatcgttctcgtcgacctcaacctgggtcagcacggttgcggcaccacggtcgatgccgcggtcgagcatctcctcgcgcagcgcgttctgcaggtcgtagccgatatagccctggctcattgcgacgcacaccgacagtgggcaggggatgtatttctcagggttggaacgagtgagctgggtcatggcctcctggatcatgcccacctgcgggccgttaccatgggccacgacgacctcgttgccctcttcgatcaggtcgacgatcgccttagcggtgtgcttgaccgccaccatctgctccggcaggttcttgcccaaagcgttgcccccgagggcaatcacaattttctttcccatagttacctctcatcacgctcaatacacaacatggggaacaaacaaaaacaaagcgcgggacccaccccgttgagtgacgagccccgcgcggatcagactggttaggtgttgacgctcacatcgcgctgattagagctgataccagcggcgggtgtcagcctcttcgagtgctgcaagggtggcaactggatccttgaccttctgcaggaagatcatcgcggcgacagcatatggcttgttggaagcctcctggtacagaccgacgcgatggctatcgaagacatcgttctcgacctcaccgtgttcgcaggagacaacgttgatgtcagccggcagcggatgcatatagatcgtgtcgctaccgtgggcggtcttcttcataaggtcagtggtgcagcaccaatccttgtgggtggcattctcagccaggagcttcttctcgagctcgtcgatgcccttggtgtcaccctcagagtagagctcggtgcgctgctccatgccggcataggctgcccaagactttgggattacgacgtcggcgccctcgaaagcctcgcccatatcgtgggagatcttgaaggtggaggcggtctcggcggagtagtccttgcccttctggaccaggtctggcatcagatcatagccctcaggataggcgagggtgacatccatgccgaagcgcggaagcaaggtgatgagggactgcgggcaggaaaggggctttccgtaggaaggagagtaggcccaggtgaccgcgaccttcttgcccttcaggttctcaatgccaccgaactcatggatgaggtgcaagatgtcggcggaagactgcgtcggatgatcggagtcagactgcaggctcacaagcgtaggacggtgatccaggataccgcctctccaggactggtcgacggagtcggcgaccttctgcatgtactcgtcgccctcgccgatgaacttgtcatcgcggatgccgataacgtcagccatgaaggagatcatggtagcggtctcacggacggtctcgccgtgggcaatctgggacttagcctcgtcgaggtcctgaagctggaggcccaacaggttggagccggaagcaaaggagaaccgggtacgggtggagttgtcgcggaagttggagaccgcgaggcctgactggaagatgcgcgtggagatgttgcgctcacggaggttacgcagcgcgtcagccacgagatagagcgccttgagctcgtcggtggttttgtcccacgtgtgcaggaagtcgtcgttgtacatctttgagtaatcaagcgtctgaagctgatcgagaagcttctttaactgtgcgtccatgtagttcctctccttatatatgaacaccgattgttggtttcagggaatgatttgactatttgatatcgttgccggtgaggatcccacggtactcaatggcgtcgtccacattggccttacttgggttgtataggttgaccgctaccacgtagagggctgcacaggaggaaaggtcctgcttgtaggtgacctcgttaggcgcatgtgcctgagactccgcacccgggccgaagccgacgcaggggataccgtagcggccctggatggagacacagttcgtggagaaggtccacttgtcgcagagaggtctgccttcacgcttgtccatagacttcgggcagccgatacgcttgtcgccgaagagtgccttgtgggcgtcgacgagcgccttgacgtgcggagcgctctctttgttgatccaggtcgggaagtaggcctcggtctcgtagacagcgcccttccagctcggacggttgtacatatacatggagaccttcacgtcgtcaccgtacttcttgacggccggaaggtcctcaatctctttgaggcagctctgataggtctcgcctgcagtcatacggcggtcgatggagatggcgcaggagtcagcaaccgcgcagcggctcggactggtgtagaagatctgggagacggtgcaggttccacggcccaggaagcgtgcgtccttgtagtgattcgggttgtacttcgagtcgagcatcttcacgaggccacggatctgggtggactcggaagcgccgtcgttgttgagagcacggacatcgttgataatatcagccatcttgtagattgcgttgtcgccgcgctcaggagcggagccatggcaagaggtgcctttaacgtcgacgcggatctccatacggccacggtgaccacggtagatgccaccgtcggttggctcagtggagataacgaactctggcttgatattgtccttattgtagatgtactgccagcacatgccgtcgcagtcctcttcctggacggagccgacgaccatgatcttgtagccctgagggatgaggtccatatccttcatcatctttgcagcatagactgcggaggcgacaccgccctcctggtcggagctaccgcggccgccgatcagctggtcatcctcgaagcccttgtacgggtcgaacttccagttgtcgcggttgccgatgccgacggtgtcgatatggccatcgattgctatgatcttgtccccgttgcccatgaagcccattacgttgcctaggccatcgaccttgacttcatcaaagccaagctttcccatctcagctttgatgcaagcaacaacctcaccctcgtggcaagactcgctagggtatgagatcatcttacgcagaaaagcagtcatatcagcgttgtagtcgtttgcgaccttcttgatcctgtcgtaattgagcttcttcatttagttcctccttgcatgaaaccttttatgctaaatatgctaaaacacactagacaatttgtacgttaacctaactttttgtttggtcaatctttattaaagcaggtatccctgaggaatcaagaggaattctaaaggattgttagatttgtcgtcagcggtataaatatgcagataaacggtgacttgttgctgcctatctctgcatagcttgtccacgtattcacctctgcagatgctttgatccatacagcttgtcatccatacctaaaaatttgtttgatatctatcccacatgatacctcctactgcacgttcacccagttttgccccaggaagaagacatgggtatatagactgtaagtgatcccgtgtgtgagcaatctggaaaaagaaggtgcatcatatatgagtatcattgcagcgtttgcagtcccccatccacccctgatcatcccggcgatcggtcgtggtgaggagaaggggatttccgaaaccgttaaagcctacaacaaggtaggcaagcagattgcggaactgaaacctgagacgatcgtgatctcctctccgcacacgacgatgtatcgcgactacaaccacatctcccccggcaaggatgcccacgggtccttctcccagtttggggcgcctgaagcctccttctgggtcaactacgacgaagagttcaccacagccctcaacgtctacgcacacaagcatcagctctctgcgggtacagcccatgagcgggaaccggcgctcgaccatgcgacgatgatcccgctatacttcattcagaagtactataccgatttcaaggcggtccgcatcggactctccggtctttccccggccgagcactacaagctgggtatggcggtacaagcagtatccaatcaactaggacggcgcaccgtctatgtggcctccggcgacctctcccacaagctgaagagctccggaccctatggctatgccccggaagggcctgagttcgacaagaagatcgaagagatcttctctaccggtaacttcctcgacctgctgacgatggatcggagcttcgcagatcgcgccgcagagtgcggcctccggagcttccaaatcatggcaggcgccttggatggcatcccggtcaaagccacactgatgtcccatgaggggccgttcggcgtgggctacggcgtcgcctctttcatccccactgggaaggggccggatgaatcccgccagttcctcaaggcctatgagcggtttcacgaacagaagctcagaggtttcaaagcgagggaggacccactcgttgctctggctcgtaaggcactggagacatacgtaactacgcaccgaggtgtccggcttcccacagaccttccctctgaactcactcagacaagggcaggctgctttgtctcccttaaggaggatggagagctcaggggctgcatcggcaccatcgcgccgacccgggacaacctcgccgaagaaatctgctccaatgccgtctctgccggcacccgcgatccccgcttcccgagcgtgagacccgaagagctgcctgagctcgtctacagcgtcgatgtcttgcagaccccggagcgcatcgaaagtgcccaggagctcgatccaaagaaatacggcgtcattgtctctacccctgacggcagacgcggactgttgctgcctgacctcgatggcgttgacaccgccgaacagcagatctcaatcgctgccagaaagggcaacatcaatccgcacgatcccgatatatacctcgagcgttttgaagtggtgaggcaccattgagtgacacgaagatcacctgtccggtctgtccccatgcctgcaagctcgctgagggacaggtcggcttctgccgggcacgtatccgtagaggtgacaaggttatcgaccagaactacggtcgcctcacctcactggccttagaccccatcgagaagaagcccctagcgaactacaagccggggagctatgtcgtgagcgtgggcagctacggatgcaacctgcgctgccccttctgccagaactgggagatctcccaagccgacgagcatcaggttccctggaagaccgtttcccctgagcaactggtgcagatcacgctcaacgagcagaaggtctataccaacaccatcggtatcgcctacacctacaacgaacccctgatcggctgggaatatgtgcgcgactgcagtaagctcgcacatcagcacaacctcgacaatatccttgtctcaaacggctatgcgacagaagcagtcatacgggaaatcgctcctgtgatcgatgccgccaacatcgattttaagggctccaaccaggacttctacaaacagtgcgctggcgatatccaaaccgtagagcagacgatcaagattctggccgccacacctacctgccatctggaactcaccacactcattattccgggcatgaacgacacaacagcggatatggaagacatcgcgcagtggatcgcagcgctccccgtcaagggagaccctatcaccctgcacatcacccgcttcttcccgcagtggaggatgcaagatcgtcctcctacacccaagcagacgctctactcactggcagaggtcgcacgcaaatatcttgaccacgtcgagctcggcaatatctgaggttgaccagctcacgctgattctaacagagccagagatctgatccctggctctttttcggctcttcggcgtttttcatatgaccccaaacccttatcaagtggcaatgctatcgcagaacaggcgcccacaaggctttcctgaaccgatgaatgagggatattcggcaaatatcgctgcggacatgtcctgcatatgagacatgcggtagtgtccccaaggacgctcctagggaaacgatgattaatgccccataacgtgttagagggaaccgaccacacgacttttcgcggccggtatgcgggaaaggcagggaaggatgcccatccagcacgtgcaggagccgctatccttacatctgtcctgccccatgcaccgcaagaaggctccaagacggatcaagcgactctgggagccgggaggtgtagcctgccggcagagatacacatggcaaggtttgcaagggcgaggcagactcgagtgtacaggaggtcttctctatcccctagtagcacttccttaaggggccgaagcgccgcttcacgatgaggaagggatgcttctacctttgagcggccggatgccttcctggactcgatgcctttctcggacaagagtgcacaggcaaggccctttatggtcgaaggcttccttgcaacgctttagcgcatagatgagaggtgtgggtctgctgtgaccttaagggcgcttcgctatacctatatagcctaaagtctgcatagcagaacctgtcatcttcccttaacgagtgcatgtgccacaggatatgtcggatacattctaggcgatcgtctccacaccatgcacaaggccacctgcggcatccacgccgatatgcgctttgtatcagatacgccaggctccccctttcttggactggtgtgctttaagggtcgcgcgcatggtccttgttcttcgtgaagcttaagggcccaggtgaaggccgcatccacaatagagccacctcgccccgtgatccctgccttttcgagcttttaagtccaggcgtaaagcacaagctttgccgaactcctctcgctttaaggctatggcgcatcttcgcaagtgtcgtcgcatctggcacctgcgcctgcatgaggtctgcgtgcacagaagcgctgccaggagtggcaatccaggatagcatctttaagttccctcgtcttaagagagcaaacataacctaaagcaggatacatcctaaagcatcgtctttacagcgcgcacatgcctgacaagagcatgtccgtggtagctggtatctaccagaacaatccagctgtcccacacaacgattgcatccatccgctccaggaatgcctctcgtctggtctttctcctcagaccttaggatttaaggtcttaaaagctcatcttatctgtccatatctgccttttggatatgcaggaatgtgtggatgtagctataccatatccagaagacagataggcatctatgtgggtatgagcactgcgtggttcgagacattttgagccgatgtcatacagcgtgtggccccactggcctcatcgaggcgaattaatcatcatttccctagggggcggtgctgattgcgagattgatgagtcggcgctaggcggtgcatctgccgagagcggtggtgctaattacgcgaatggtggtactaaacgcggagaataatcacttcggcggcgggagccgcagcagcacctacatgccggtaagcgccaaagtggaagcctatgatcccacgatccgtaaatatgcccagcagtacggcatcccggaatatgtggagctgataaaagccgtgatgatgcaggaatccggaggccgggggcttgaccccatgcaggcggcggagggtggctttaacacccgctatccccatgagccgaacgggatcgccgacccgaagtattctgtggaatgcgacgtacaggagttgaaggcggcgctggaggctgccggggtggaaaccccgtggacatggagcggatcaagctggccctgcagggctataactttgggagtgggtacatctcctgggccttgcgcaactacggccgttattccttcgctaacgccgcggagttttctgatatgcaggcagcaaggctgggctggagcaattatggagataagcagtatgtggtacatgtcctgcgctactacccctatggccgagcgttcagtatgggctttggaaatcaggccaccgtggaactggcgctgtcccaggtcgggcagcagagcggacagccctactgatcctggtatggctttaatggacgtgtggaatggtgtgcctgctttgtgagttagtgtgcggaggagtgcggctacatcgaggtggggatcatcccgaaattttctctgtgctctgacggagtgaactggttcaaaacgcagggacagtggcaggaccgaaactatgaaccgatggccggagatatcatcttctttgattggggcggggatggttccgttgaccatgtaggcattgtagaatactgcgagaatggtgtcatttacaccgtggagagaaactcaaaggacgcctgccgtcagagagtacaccgttggaagcagcagcatctatggatgtgagctcccggtatactaaaaaagtgaaaagagcctggagagctcttctcatagtatatatttagttattctatttcggttaaaattgctttctcttcgtttgaggataatagcattagtaaactaattacccataaaataattacgatggcaatggtggtataaataaaataaacattgttcaaattatttgaaatgaactttatggataaaatcgaagaaaatattatcgcaagactaatatattgaaagattgaagcaattccttttctataacaagtcatggcaataccatttatgattccgtatggaaaagcaataaccgtatatgcgcaaagagccataatggtgctgatataatcaatgtgtttgaaaatggccattattaaaagccaactggatatagatgtacataatccgacaataagattaaacataattttacaaatcacaaaagaacgaagccgaactccatttgataaagtgtattcaagcgtcccagtaactttttcagaccaaaaactcattgaataaaggaaaccaacaatgcccatgtataactgtatgtatactacttcatttgtaatgttgaagccttgttctcgattcataaagacagttattcctgttatgaaaatgaaaaacatagctactgagaacacataggatcgaccccggtttttcaaaatatgaaattctttaaagaaagtggccttgacaaaattcgacatgctattccttctcaatatttatatcttcaaacaccttaaaatacataggcttcagcgattccccattaacagcttctttctcaagtagtattgttttatttataagaatcactttgttaattacgccttctagtaaatcgagattgtgagatgaaataaataatgaagaacttttagacaactccttaagcagcttttgcatactcttttgcccctgtgggtctaatccaataaaaggctcatctaaaagtattaaatccggtttggaaatcaaaaggcatcctatagagagccttcttttcatccctttagagaatttactgatccgtttcgatcccgtatctaaagcaatagtatttgttatagtattgtactcttcatcagttatagtctttcctgtttttagcagtgaaacataatttaactgttctctcatggttaaattttcatacattccatctcgatctagaactacaccagattccttatatgttctactaatgtgaccagacgttggtctatagatgcctgaaacaagtctcatagtcgttgtcttgccggctccatttggtccgattaaccctatgatttctccggtgcgtatcgaaaaactaatatcttgaagaattcttttcccatcaatatctttattaaccaaatcaaattttactaactccataacatcctccgttatttatttgaaccaaatcacgcttacgcgtgaagcctttttcttattattatatactctctgaacacatctttgcgggattcggaaggatggtcaaatccgtgtctcaaaaccggcagccacatcactcagggtaatgacaaatcgaattggatcattttcctctcagccaaatagaataggatgtttcaaacggataaagaacatgcccatctttatcttccgttctcagaagaactgtgcgggacggcaaatccaggcgcaagggatatatggcccatactcctcgacgcactgaatcattgaatcaagatctaacagtcaagtaaatgaaggccaccagacctacgtcgagctgtagaaactcgcatcggacatcatcatatggcggaccacccttgcagtctcgggtcacctgtcgcctacctggttgacaccgaacaggtagacgtaccagttgaggtagcttttgcatgttggacatgggacatgcccgtgaagcgccagaggtatctcttgagccaggagcagaagttgttagcgagctccatgctctcaaggtactccaggtctcggacatcggccttgtatgattcaaagatggctccggcatcgcgtatgaccccgctgtgggcgcgctcccgctcatgcacgacgatcgcgcctttggccatgtggccgccgaatgcgtccctgatccttctcgtggacggcttcccgtgtccgcagaccacggcgtaggggttcttgaagacatctatcccgatgtctatgcagagccgctgcgaggagagcccccgcttcctcgcctgcccgtatccatgcgtgagatccgtatccactatgtatgtctcgtcgatccagacccgcttcttaaggacgatgcggtcctgatagccatcccacggcggtaaacacccggtgcctccactcccagacgctctggtgagatatctgcagggatttagcgatgcagcccaggggcacgttgtagcgcatgagccggatgggtaacacccagctcgcagcgggcatgctcgaagacggtccctgtaagcgagctgtacttgcacccgcagccgaggcactcccaatctctgtgtgccactcggcgcgaggctatcgcgcttcgtgcgcacgaacccgcatgacgggcagcagggatgcggtctgaactcggaaggtgtcaaagcccgtctgcttacggcagcggcgaccggctgtggccttctccagctggcggatcttctgctcttcggcctctgcgatgcgggtgtcaaagggattctcccataccatgatcctgacgattccacttcgccctggaggccacccggcaaaaccgtcgccaaacacagagccgggtgagctccagggcacattctctatatttggcatgtggaattgtatcacctgggctgtcaggacagcctggaccggcccccatttacttgactgttagaatattcttctctcgctgttagaccatgattgacctgacgcccctgtccttccaatagctccagaagggctgctctatgtctatgagcgcacgcctggtatggacatacctgcctcctgcaagcttgcctgagagcgtatccttcttctcccgctcagaatgccttacctgctctatccacaggaagcaggcaagacaagtgccccagccacttcgtagaagaccccatggaagaaaagcaggaactcgcacaaccttcgctgcatcgcattgacgaggtcgagctcgccgtgtgcttgaagaccccaagcgagatgacgtacagtttctttcgcacttttgaaaaccggatagccgcatagagaaacatggccccgtctcgctacgattggaagcgaccaagtgcaaaccaacggaccaaaggaagtgaaaaccatgccacacgagacagtatcattcgacgagccgaagcttcaggactacctcggggagctcgtcagaaaaaccgtgcaggactcactgaacgccctgctggatgcgcaggcaaaccagatcgtcaacgcaggccgctacgagtggcaggcctgctgctccggccactacaggcaaaacctcaccacaacctcggtggacgtgacgctcagcgtctaaaagctttcaggggtgcgaccttcgcgtcgaaggtgatcgagcgctaccacaggcaggagagtttcctcgagcaggcgatgatggagatgtagctggcgggcgtctccaccaaaaggatacagggggtctcaaagatcctttggggcttaaacgtctcgcccgccaccgtctccaagctcatgcgcaaggccttcggtgccgtcccctcacgggcaagtaccccttacgtctagctgggcggcacgtacgtgaagagaaactgggcaggctcctgcgagggtgtgggtgtggccataggcatccaacgcctggggctttccgtaaggtcatcgactgtaaggagaccagttatatgaagtcaagacctgattaaaagattgtagaagaagttttaggtaagtaagttttattggattttgcactttgacagccgaatattgaatgcttttaggcgcaattagctttaaggctattggaatcctggataagggaatgcctacgttatctagccccgcgattcaaatggaacctggtcctgaagaattgtatagatgatatggcagagctttcttgcgacagccatggcagcaactctgtggcgcttgccttcgcttcgttttttatcgtagaaagcacgaagcccagggtcgagcctgcgggccccttgggcagcaaagcaaagagcacgtctcaaatacggcgatcctctctttgtgatagaacctccttttagctcaaacttagcggattggttgatagaggggttgatgttagcatagcttacgatagcggcaacgtttttaaatcgagaggcatcgcctatctcggcgacaatctgagcttctgttgcgtgagaaatccctggcactgtgaggattgaaggttcgattgaatctagcagcttggctattttgtcatctgcctcacaagcgcgctcgagcaggaactctatctgcgatatgcaggacttgatctcaaaggatgccgctgctgagccaaggcaaaagcctatagatgtcttggctttttgcttgatttcgctagcctgattgctaccggatctgccgtgggatgcctctacgataactttccctggtgtcgactgacacagatgtgcgatgtcttttggcagtgggcactttgaaagtactgctagcgatgctttcccgaacatgttggaaaagatagcgtcgtattcgggaaagtaggtgtcccatgagacatatgacatgagtccttacggcgaacacctgttctttgagcgactgctggtatctcgtgagagtctttaaggacttggtcctatgtcaagttttcggacaggttaaacacaacttttttcaccctctcctgccagtccctgcttgagctcagacaatcgcttcgaatatgctgcttcatattcatctggagattgatatttacaatgctgtgaatccgaaccgtgttaaaaacttattgatatattcgaatacatagcgatatgcctggtcataattctcgatctgaatatctttcagccatctccctctcttgatgagcgaatgaaaaggactcatgcatgcgtttatcccaaggataggcctttctttgaataactgtttgtcatttcctttccctggttgcctcaaggaatccatctatactactggcatccccgatcattatggatacctttggcttcacactccatcacgttctctgacagctttctgtactgtttccgttctacacttttttgcctccatgtgggctcaacaccctgccaaatcttacggagaacagatccatgacgctggtgagggaacaaagcccttttcagtccaatatatgttgatatccgataacccatacagcttccggttatacgggctaactgccatccaggatattctgcagtctcatcaaagcttgaatctgttgtttgtatgcgtccaatgactgacccacagggcgcaaatccccatctttcgcatatatttcctgtagtccgttcgctaatctatccccattcttatgaagaactgccgctattttcggcgcgccataaacttggtgactgctgataaatttcctgattttttgcctttcattttatttctgtgtatcttctgtcctgagggatatggctccccagcatagtaaccagatttggaaacgccgagataatacagtatcccgctgaccgaaacatggcgtttcgattgttctgtcggatctcatcgtaatgctttgagtctcagaataaaagttaacggtcattttcccaggatactgattgctttttttaggatttcaagggcatccttcgcatcccgcagctgccggcgtagcgggcaatctcttttgcctcatcaccttgaataattaccaccgatccacgggaaatgacgtctccatcattttgctttgcggatgcactccagtgtttgaggctgatttgcttaccacccagattattagccatatcatgagcgtcatctctggatgatcctttttgtactggacagcatcattttgaactgttgcagaatacctcgttaactaaccctttgccatgactcttatcctccctccatctcttatatattatgctgtagaaaaggtcatttttaaggcgtcctatttatatgctagcaccacccttattgctcaatgatttaagaatctgctgctatgaagcgggcttatacaaaggggatgggccgatgcagaataaggactcccgattctttgctcgccggcaagaggaatcccatccaccctcggcgttgattcacggcaccactcacaggacttcctcagggagcgcggttacaccggtgtcttcggcatcctttatctcggactgcaccatgaatcctccgcgaaaagagtttccagaggtctcggcgacatgctggacttcgtaaacaagatctgtccggtccaccgatacacgcaatgtatcaaacgacgctatcaaactaacgaaaaaatcctctgtctcggacacaacccgaagcagaggattacttttactccatctcaaaggatgcaggtatttgggcctactttgcgtccattgatggactccaagccccgtcccagacgatccacggttaacgaaccggatcggtgtcaccctcattgaaagagcaggtgacttgtgagtcagaaccgatctccaacgcgtcacgagatccttataggctggatctgtatcagggaagacacgacgcccataccacagccaccagactcaccaaggtgactgccgggtcgcccttgaccgtagccgcgacatacgcataccgcgtgcgctcaccaatccgggcagctaatgaaggcgtccgcgtggttttctcaggattcccacgatcgtgttcggctcgccgcaggcaggccggccatgatggtctgaaggtcaccagtgacgatacgggttcacctcagcagcttttgcactcttgtacaggcatgcagcagcgcctgcttccataatgatgaacttggaggattggggggaacaagttggcgaagaagccgaccatggaggaacacggggatccgacaccggcctgtcgaagacgtgagtcgacggttgatctcgagctgacggagctgatctgcagcctcagatgccatggtgccatagccctgcatgatctaggacgggatcttggtataaccgtcccaagcggtgtccctgaacgattacgccgtgctcgggttctcatcagcctctttggcagctagtacgcacgcaatcgtcgtaattgagatctcgaatggtgaccctcgcacaccctcttagcgatgttgtcgtagcgggtcttcggtaaacccttcggcatatgaacaactgccttctgggcaggcgctttggccgcccaagcgacgccgcggccgtggttaccgtcgtagcggtgaagaaggttgcatgaccgaatccttctcggctgctcagacgtgtagggtagttaaagtcgcagtcggaaacatcgcggcggccggtctgctcagcgatgtagcgtcgcaattgcaaacgagccaccgagaaccttaaaggcgttgagaccaaaacggtagctttcgtcctttacgtagaggccacccaggccaaggtgctcagccattcccttcaggtcagccaatggcgtgacgctgtactgcgggaagctcttgtggaaagcacgagcctttgcgacattttccaggctcatgatttgcagattcttatcctcatcctctggcatgtggtttaaaacccactgaaacttcggatccatacgctcctcctttatctcgggcagcagagtgccgccgctcccgtactaaccatctattagtatcgtacacatagtttgttcaactaactttttgtttgttagacggctactattacactacgaatggcttactttgcaagccccataccaccttgttttgctgaaaggacacggcttatccgcagatgttgagttaacaacaggctcttcattccatatgcagaaatttgtgcctgccctgtcatttttcttgaggctctcgtcctgcctaacaaagagcagcgcacccctactcacgtttgaagtacgctgtttaaatttgcaatgattgattgccagactaatcctgcttaacgaatttaacaccaagtttagccggaacattaaactctttacgtgttgccgtcaggataattactaaaagatatggcagcagcgagaataactcactcggaattccagcaagacctattgcctttgcatacgtaccgattgcatcgaagataccgaacacaataccgaataccaaagcgcctttagataatatgaagtgacctcacattagtagcaacgtggatttgccactatacgataggtgttcaacataaagtaagctggtttaccacatacaaaaggagatcactaatgaatagagtactcaaaatcgcaatggatgtccatagttcgaattacactttgtgtgcaatggagcctgtggttggggcaaaggacagggtcttcgccaacatccaggtaccccctgattataaaaacgttctccaatttattgagaaccttaaaaagaaacttggccttaccgatacttattctgttgaatgcggctacgaagccggatgtcttggatactccttataccatcagctaacgaacgccggtgtaaaatgcgtcattcttgcgccgagcacaatgctagcccctcagggcaagcgggtgaagacggatgcacgtgatgccaacatgatcgctcagtgtctttgctatggcggatatcttgcggttcatgttcccaccgataaggatgactctgtagaagaatatctccgtatgagggatgaccacaaactggcactcaagaagatcaaacagcagatcaatgctttctgcctgcgtcatggcttcttctatgatggcaacaaatggacaatcaagcactggagctagctgaagacacttggaggtggatgatctgctgcgtaagaccctcgacgagtatctggcatcctataaggaacactcatcaaagatcgaacgcttcgacaaacggatcgaggaacttgctggcgatgatgattacaaggaaagtgtcaaaaagcttggctgtcttgtcggtataaagactcatacggcaccttcactgattgtagaaaccggcgatttcagtcgttttgccaaaggcaatacctacgctgcattcctcgcccttgcgccgggagaatcttccagtggaacaaagatccaacgtagcggaatttcaaaagctggcaacagtcatcttcgtacgcttctcattgaaggggcaaaaggaatctgcaagggacagatcggacataaatccaaggaactgcgctgcaggcaggacggaaatacagctgatgtcattgcatatgctgacagagcaaacacaagactttaaagcaagtattaccggatgatccgccatgggaaaaaaagaaatgtagcggttgctgcggctgccagggaacttgcctgctttgtatgggcaatgatgacaggcaacatcgctttcagagaagcctaaaagaaggcagcatgagtaacatctgatccatttgtctgtcaagggtgctacacaccgcttacgcggcaagccctgtgacagccatctgtccatgatgtctatgggcagccaaggcataaatccacaggaatctgcggatttatgcagtaatagacaaagtaaatacctgacagcatctggaggaagctgtgatcactgtaaggtttaagccatccgcgtccatcctatgttggcactggaaacagaaatccacgcttttagatcgcagggctcacggcaaaaccattagcctgttggtagccaatccacgtataacagagtggccacatgccgggaactgttaaatcagagctctttccagatgctgtcagagaaacacaaatgtggctagccaggggggaaaatttcctgaaattgcctcttgacaacggtcacttcataacaggatgggcagattgtcaagctgagtgcaacatctccctaaagacctcgttggctgtcctgtatttcaggaccttcctcgccctgtcacagattagctccactgtatgctgcacctcctcgtttgtgacctttccgaagtctgtgcccttaggggaagaactctagcagcagcccgttggtgttcttaactgttagcttctgccatagatggtgagggtcgcaaaagtagaactgcacgcctcaaagggcatctgtgagccctgtatgccctgcgagctgcttgccccacttaggagtgagcgtctcgaggggacgtccctgtagcagcccgacctcggccttagagacgctcccgctgacgtggtggcatcttctcgcggcaagcagcctcgatgccctgtcggcaagcacgagcaggcacacgggtcctgctccgataagcgtgtcgtctgccaagtcttcgagacgagacctctcatcggcctgctttggcctctcctttacggtgtgcgagatcctgatcttgcccctcgtctcgggcctcttcctgcggattctcttccccttcctgcgcaggtggcgccgcatcttgccttccaggccggcttccggcagctcgagggcggcggctatggacctcacggtagaatagtcggcaggctcaacggtgcacctgccgccaccctcgagcctgagatgttgtctatctcctccagggaccagtgtctgtccatgatgagtaagcgcaccttctgcgtaagcgcagggtctgaaagccgccttttcgccctgcatctcctgcggcgctcatccgccctccttttgggcagcgcatgccctaaagcgtccgtggcggccattcctcttgagcttgtggcagacgctggagctgtccctgccgatctctgccgcgatataggcaattgaccttcccttgtgcatgcagcgtggctatgcagtccctctcctgagggctaagatgcttgtagtggcacattccttccagctttcgacgttgattgagacaaccaacatcgtagccttccggagtgtgccacgcttgcattcagcgggccatcctgttgcactcagaatgctaatccaccgtggcaaagaaagacttcgccacagcactatcacagcaggtgccctagcggctgcaggagagcctcacatcgtttatcttaagcccacagagcagacaagcctaagaggtgtattgggcacctttgtctgaatgaaagattgcattttctgccacatatcctcgacactgagccacttgcagtgtatctagcacactatcggctctcgttctatccaacagcgatcaagcccaccaccatgtaggtgtttaagtctcacacagcaagaaagatagagccagcccttttctgtggagagataggtaatatctccaacaagcttataggtggagtcagggctttatgaggtcacaatgtataagatcaggctttggtttggcatatctgtcagggacagtggttctcttctgatctgtaaagggggtgagccctttattcttaagctcgcgcatgcattttcctaccctgtagagggtagtgttggaaaaactcatcagctagatagcagtgggtgtaaacctagccccaaaacctctgtcagagtccacccacaagtgccagatagcctctttaagctcacctcacctgttttctggtgctcccttggaacacccatgaataaaagcttgagcgcgataccttaaggattaaagcctgtatcttgatcgggaagttttccttctcctcaagcacccacttgtaacaatctattgcgcttaagatcctttgtaaagaaggcttaacagctgcctttaggaaggcatgttccatctcaagctctctgttgcgcttggcataaggcttttgagcttttcctctttagcctcgctgcgcttaagcacctgatagcctatctctgtgctcttttacccagcggctttagtgttttgggactttagccctaactcggtggtaaggtgggctatcggcttgccggtggagatagcacactcagctgttttcaggcgctactcatcgctgtatttggtagcaagattgtttgttacctgtagtcttttcggtcggcttgtcttgcagttaagaggagcctcataattcctcaagctgcactgtccgaaaaaatgatacaggtcacatgacgattacgtgtcgtcgtcgggcgaaaatgtcaccccctcgttgcgcgaaaatgtcaccaccttcgccttggaataagctcggtccatcacggaacggaaggagccggcgatggacagggcgacgaaagagaaggcgctttggctgctcgggcagaaggccgatggcgcagggatcacatattcggagatagcgctcgagacgggatacagcaagcaacagctcatccggctctcgcacagcctggaggagtccggcgaggctgcggccctcgcgcacggcaattccggatcgaggccccacaatgcggcgaggccggaggagatcgcctatctccggaagctcaaggagccatatccgaatgtgacgatcgcccattttaaggacatctacatcgaggatgtcctggagaaccctgagaaggcaaacgacgtggagcgctacgggctctgcatgcgggggcccacatagttcagggagctcttcgcgaaggagggctggaggtcccctgccaccacagggaagaggagggatgcggacgccacgcagcatcccatgagggagcccctgccccggatgggcatgatggctcaggtggacgccacgccttacgactggctcggcaccggcgagagctggtgccgagcatctcggagtggacgatgcgacgacgtccgtcgtcggcggatggttcatggagaccgaatgcatgcgcggatatgcgaggatgatgatcgagaccgtgagcaggcacggcatcctaagatcgatgtattcggacaaggactccgtcttcagggcgctgaaggacggatccccgacccagttcgccttcatgatgcgcgacctgggcatccgcatgatcttcgcgagatcgccccaggccaaggagagggtggagagatacaattcgacagcccagatgcgtctgcccaccgacgccgtgaggttcgggatagacagctacgacaagctcaacccctggttcaacgacttctatgcgccatatctcaatgccaagttctcgtatcctccgcgcgaccccgtgagcgacttcatcccgctgcccgaagggaccgacctgagccgcatcttccgtacgagggagacgagggtgtcccatggatgcacgatctcgtacggaggcgcccggtacatgatggcagatgccgacggagtggtgctcgaggtgccggacggcactgtgctggatgtccatgtggatgcggtgacggaagagatgtatgtcgagcgctccggcaggagatggggatgcaggcccatctccccgagagagcccgtagacatatcgtcggcaccggaccgcagggggctgcagcatctcctgtcgcagatgtcaggagagaatgcagctaggagagggtgacattttcgcccgatgacgacactcatgacgattacggaagaagaaagagaacagtacaaagagcatgactataccaagcatgagatcaatgatacttgctggagcagttgtctcgtgagaaagaatagtgccaccaacctgcaaagcaccaaataacagagaacagaagatcacgccaattggattggaattagccatgatagcgataccgatgccataggatccaatgtcagaatcgagtccatcaagtaacatatgctgcatgccattaacctcaatgaatccagcaaggcctgccaagcatccgctgatagcaaaagcaataaggaattgctttttcggatcaattccagagagtctcgcagcgtccatattgagacctgttacctggatacgatatccaagggtagttttcttcaagataaaatatatggctatagcagcagcgactgatatcagaataccgattgatgcagtggtaccagggaggaatttaggaagccatactgcatttgataacatgtctgactgaacatattcatgttttgattcctgcaatgaagttctcaataacagtttcatgatgtaaagcacgacataggtggacatcatactgaccaagaactcattggcattaaatttcgttttaagcaaggcaataatatagccaattgctgctccgccagccattgcacggtcacgtccgtaaagtggtgtaaatagaggaacgagccagaggctcgggttccaagtatcatttgcaatcgccagagaacaagaagacttgaaggcccgaacatggcttagatcaatatcacacttaaccaggacgagataatgcggctgctcgaagattccagtggggaggagttcaagctcatgctgcagaagtcgctcaacgcccatctgctcgcggagtcggctgagcagatcggcgcggggcgcttgcgagcgtgccgacagccgcaacggcacgaggcggcgcaacgtgcccttcaagaccatggtgttcgacaactacaagcgcagcgaggccgcccttgtgaccaccatggcgaagatggtcgtgggcggcgcttcgacggcgaaggtgggcaagctcatagagatgatctgcgacaggggcttgcccgactcgacggtcgccgagacctgcgccgagctcgacggggccgtcgaggagttccgcatacggcgcatcgagggcgactagctgttcgtcatggtggacgcgacctacctcaaggtcagggtcgaccacaggatctgcccgatgacgctcatgatcgcgatggggatgactagggacgcgatgaaggagctcatagggtttaggcttaaggcctgcgagtcgcgtaagacctgggggaggttcctctcctcgctgcgcgcccgagggctttcgggctcaagcatgttcacctccgacgcccacgaggggctcgtgttctgggctgcaggaggtctaccccgactgagccctggcagcgctgccagacgcacttctcgcgcaacgtctccgacgcggcccccaagcggctgcgggcggggctgcgcttagagctcgtggagatgttcaactgcgccatgcttaaggaggccagggcccaccgcgacgagatcgccgcggaggcgcccgaggcggtggcgcgcctggacgccgggtttaaggacgcgatgacggtcatggccctctcgcaggcgatgcgcaggtgcaccaggacgtcgaactgcctcgagaggctcaacgccaaggggatgcgccgggcgaaggtcatcggcgtgttcccgagcaagggctcgctaataaggctcgtggggacctacctcatcgaggagaacgacaggtgggccgccaagagcaagcagtactggctgccggcggtcgaggggctatgagaggaggaagggggatctcgaggagatagcccgcacgcagcggcggatgacggctcgcagaggcgtttgcttatgaggcaatttacacacgatttcagacttgactgtagcgattgcattgcgtacaaaagtcacttccggattcggacgtacaccgccgcactcaataaactcaactccatgtgcagccagtgattgctctacccgatcaagaactccggtgcgcttgacggaactcccaccatagatcaacagtacatgcttagcgttaaaggctgcaatctcctcaccggttctatccacgtagcctctcccaaagacaaaccgagtaggggaataaaagataaagtcgttcatatggcctcgcctattagtatcactttagataatctagacaaagtttctgatacacgctccagttacagagtcactccatctttccatattgagatctcacgatacccgtttcgttcgcttgtagtacgtttaccagatgcaacatcaagcacaatcttaaacaggtcatttccagcctcacctaaagtacgagtgccatctgccactacgcccgcattaaagtccatccaatcgcccttatgcttcgcaaagtgtgaattagtaaagattttaagcgttggaacaggtgagccaaagggagtgcctctaccagtagagaacaacaccatgtgacacccagcgacagctaacgctgtagttgacacaatgtcattaccgggactattcagcatgttcactccatgctttttaatagtgtcagcatactcaacgacatcaacaataggtgcggttccacctttttggacacagccacaactcttatcttcaagtgtcgttataccaccctctttgttaccagggcttgggttatcgtaaacaacttcatgatgcgataagaaataatccttaaaattattgagcatagaagctgctcgatcgaatacttccttgcttgtgcagcggttcaataacaagctttctgcaccaaacatttctggtacctctgtcagtgcagttgttccgccttgtgctaccaatgtatctgagacacgtcctatgacaggattcgcggtgatacctgacagcccatcagaacctccgcacttcaaaccgataactaattcagacgttagaattggctctcgcttcaaattcgcagactgtttgatcagctcatcgcagatcttaaccccttcgtcaatctcatcgtcaacttcctggcaggtcaagaaacgtattctcttctgatcaaagtcgcctaatttctggagcatatgttcgtgtgtgcagttttcacaccccaaagagaggaataaaacacctgttgcattagggtgtttcgatagtgctgccaaaagcctctctgtctgatcaagatcttttcctgtctgagagcaaccaaatggatgggtaaatgcataaactccctcgacactaccctgtaaatgttcattagctatttgagcaatagagtgtgcaacatcattaacgcaaccaacagttgggattatccatatttcattacgtatagccgctcgtccatcagggcgtctgaagcccataaacgtagctggtttctgtgaaggcaacgtagcatctactggattgtatgtgtaagttacttcgcctgagagatttgttttcatattgtgagtatgaatccaatctccaacatttatatcttgagtagtgtggccaatgacaagaccatacttgtgaacttcgtctcccttcttgagcgcatgaacacaaatcttgtgaccctgaggtatatcctctgtacagatcaccgtaccaacaccatcaatgttgatggcttcgcccttcttcaaaggtctaagagcaaccgctacgtcatctccgttatgaatgtaaatacaatctttcatcaggaaacctcctacattaaatacgttgcatttttcagccttctattgaatgcttttagatgcaatgcagtaactggtgggtagggatgccgtcatcataggtgagagcatatgcatctcgtagaggagagtggtatcctgccccgttcaggtgaagccgcggattagctggatgaaggggcaagtgcgctcacttcgtgtctcttttgggaggttgcggttctggatggataaggcagaagccccaccaaaacaaccgaagagaaaaggatctgaccatgatctatgcaggtgtggatatcgcaaagatggaccacgtaatcggtgcaatagatgagaggggcgagcaggttacaaaacccatgcccttcaaaaactccagagagggctttgaaaagtgtatcgcttggctagatggtatcgcaaagacacctgatgacgttgtgattggtatggaggcgaccggccactactggcaggcttgcttttcatatttgacgtcttgtgactagcgagttgccgtcataaaccccatgcaagtgaaagcggtgcgcaaactagagagcctctcgaaggtcaaaaacgatcgtattgatagcgttgtcatcgccgagacacttacgcattggtgccttcgatgagacagcgcttgccacagacgaactgcagtccttaaagactctcacgagataccagcagtcgctcaaagaacaggtgttcgccctaaggactcatgtcatatgtctcatgggacacctactttcccgaatacgacgctatctttcccaacatgttcgggaaagcatcgctagcaatactttcaaagtgcccactgccaaaagacatcgcacatctgcgtcagtcgacactagagaaggttatcgtagaggcatcccacggcagatccggtagcaatcaggctggcgagatcaagcaaaaagccaagacatctataggcttttgccttggctcagcagcggcatcctttgagatcaagtcctacatatcgcagatagagttcctgctcgagcgcgcttgtgaggcagatgacaaaatagccaagctgttagattcaatcgaacctttactcctcacagtgccagggatttctcacacaacagaagctcagattatcgccgagataggcgatgtctctcgatttaaaaacgttgccgctatcgtaagctatgctaacatcaacccctctatcaaccaatccgctaagtttgagcttaaaggaggttctatcacaaagagagggtctccgtatttgagacgtgctctttgctttgctgcccaaggggcctacaggttcgaccctgggcttcgtgctttctacgataaaaaaacgaagcgaaggcaagcaccacagagttgctgtcatggctgtcgcaagaaagctctgccatatcatctacgcaattctacaggaccaggttccatttgaatcgcggggctagataacgtaggcattcccgtatccaggattccaatagtcttaagctaattgcgcctaaaagcattcaatattcggctgtcaaagtgcaaaatccaataaaacttaggttcagtcctaattcctgtgggtaccccccatcacgacacagctccggaaggctccgagtagcgcctgctggtatcgaagatcttgaggaagaagtactcgtcgttagggtatccctagcctgccctcctgagcgtcttgatcatctggttggtgccttccaccctgccgctgctgatatggtggcgtgcatgtgcgacgatcccctccatgtgcgactccacgagcctggcgaagtgcctgtctcccgttccgtggcagacctccactatctgctccatcgcatcgcgcatgcgcttctgctgtctgtagccgtaggccctggagagcatctcatctacgatgtcgcaggcgacaaggagctcgttttgggctatgaggtccttgtacctctggcggctagcgcccttctgggcggcctcctgctttccgaagagggcgcttccccttaagacgaccttgccagcacgtgcatcctggtccttcctcttgctggtgtcctcactggacatgaggatgtatgtggaatacttgagggcacgcgccgcatcggcatcgccttcgtccttaaaccttgcctgcttatccttcctgaccttacagatcaccttctcgttgaagttcttcacgaggtggaagcagtcgtagacgacatccaggcgcgggtgccttttcaggaatgcccgctcgaagtcggcgttcatgtcgcaggcgatggcctccaccttcgacatccattcctccccgacgaagtcgcacaagtcgtatacgacccgcttcttcttggagtatgcgagccacaggacatgccccatcttaaggtctatgatcacggtggtgtggcggcggcaattatgtagcttgaactcgtctgcgcccagatagcgcgcctggcgctccggcttgcggagcttcagctctccgtccccatcctcttccgtatagagcccagagagcctcgcccggtcgatctttttcacgacgttcctgttaaggcctgccgtgagcgataccgccttgagggtctggcccaaggcgagcaggtcatacacaaatgtcaggagcagcagcgtgatgcgctgccctggggcctgaacggcacctcttcggtggacgcctgcccgcactccctgcatacccatcttggccgggatacctcgatccttgccctctccatccccagagggaggtgccgaagcgcaatgggggcctgcccgttgccctccatggcctttccgcagcagaggcacgagggggcttcccttgcaaccatcctgcctgggacagtgaggatctgcactgccctctggcatctcctggtggatgtcccgaactcctttgtgcgtgcgctctcttgcggcgtacctgtctgcacgaagccgtccagatgcgaggggatctggatgaagccaggggcggcagcctcgtcggcatgggaaacggcgggcagctgggctgccgcggatgctacacttgtcatcgctctccattcctcttagagtctgtatgtcgcaatgcaagattctagaggatggccgcttctctgtctttctgggcatctgcccacagcttttaggattgaaccaaaacctacttacctaaaacttcttctacaatcttttaatcaggtcttgacgtcatatagctggtctcctttgtcgtttatttatattattaatattttcttctgtagatttgattaggtacttttatgtcatcgttcttaaactcgacgctacccaagtaatgcaaattaaggcattaaaagatgcatatagcaatgctgtctgcattactttagaggtgtcgcctctacgtttgcagtggccacaatcggcacgccggtaccacagacgtctttgacgagtacatctcctacatgcaccggtgccttgacttctgtggtgttgatcacatccatcaccttgaagatatctgccttcggtacatcttctttggtcttaaccgagacccgctcacgggtaccacctctaacacacaccgtactggtcacgacacgggtaggattggtgacttccttcttgccgtagatctctccacgcttacaggtattccccgtcactgaaacgactttgccctcgtctaaggttaccgtcagctggcagcccatggggcaattgatacaggtcaaatgtcttgtttccatgattgcccccttacttatcctctatggttaccgtgatgtcacttaagttcttaagcgcactgtcggtcagatctaactttttgagtatgacctgttccatctgtcctggtgtcaatatccgcttcttgcgatgttgcagacgtttctttcctgcatagacactcacatacgagttcttataaactgcccccacacggaagcgtaccgtaagtttgtcaggcatacggtcaagatcaagcgtggaaggtacggtgtagcgcaccccaccttttccgtgcagatggatgctgccctcagatggtttgtcggggtctccgagcttgccctgtacgaactcggcagcacacttccctgccgcatcagccccttcactcacatagtccaccagatcatggacgtgcagcacattgccacaggcaaacacacccgggatagaggtctcaaagctttcgttgaccacaggtccgtgggtcacaggactaatatctaccccacagacacgggagagttcgttttccgggatgaggccacaggagagcaacagcgtgtcgcagctgtagtattcctcagttcccggtatcggttttctgttctcgtcgaccttggcaatggtgacaccctcgacccgttcacgccctttgatatcgaccacagtatgtgagagctttaaggggattccaaagtcatcgaggcactggacaatgtttctctttaagccgcctgagtaaggcataagctcggcgacgactttgaccttggcaccttccagtgtcatacgtctggccatgatcaatccgatatcaccggagcctaagatcacgacttcacgtcccggcatatagccttcgatgttcactaggtgctgggcggtgcctgcagtaaagatgccggcaggacgataacccgggatgttgagtgccccgcgtggccgctcacggcaccccatcgcaagcacaacagagcctgcctgaatctggaacatcccattctgtttgttcatcgcagtgataacacgctcaggtgagatgtccatcaccatcgtatttaagcgatatgggattttgagcttttcaacttccttgataaagcggtcagcatactcaggaccagtcaactcttccttaaagcgatggagtccaaagccgttgtggatgcactggttgaggatgcctcccaactcactgtcacgctcgagaataaggatagatttaagtcctgattgataggcagagactgctgctgcaagacctgcaggtccaccaccgactacgacgagatctacgttttgaagtaccatttatgcctgcacctcctttgtgcgtccaaccacaatcttagagtccccaccactcttggtaatctcttccagtagcagatcgagctcacggctcaagatgtccatcacacgcgggctacagaaccctgcctggcagcgtcccatccctgcacggacacggcgctttacaccgtcaagtgagcgtgctcccaaaggtctgtgtattgcatctaagatctcaccttcggtcactgactcacagcggcatacaatctgtccgtaggcaggctgttgcttgatgagctcgtttctctcttccaccgagagcttcttgggatccaagatgcctttcctcttccagatccaggagtgcttttcttccagatgcatgagatcgcggatcatggcacctaagtactcaccgattgcaggagagctcgtaaggcccggagattcaataccggcacagtcaataaagcccggagcatcctcgaccggtcccaagataaactcgtggtgatcctcatgcgcacgcaagcctgcaaagctcgtgatggtctcacgaaacggaatccctgagacatcctgtgaggctttggcactgacctgatcaaggccttctctggtcgttgccgtgtcgtccttatcgtcgtccggcagatcaatggcggttggtcccgccaagatattgccgtgggtggtcggtgttaccagaacacctttgccgaacttggtcggctgcgggaagatcacatggtgtacaaagccttcggtcgtacggtcaagcaggtagtagtcacctcttctgggggtgatatggatcttgttcttggagaccatattgtggaagacatcggcaaagacaccggcggcgttgaccacacagcgggtggtgtactcaccgttgttggtacggatatgccagatcccctcttcgtcgcatgttaacttctccgcgcgggtattgaagtggaagtcgacaccgttggctgcagcattttctgccattgcgatatttaagataaaggggtcaatgataccggcagtgggtgcccacagtgccccgaccacctgatcgcttaggtgtggctccatagcgcgggcttctttgccggagagaatcttaagatcaggaaccccgtttttctctccctgctcaaataagtcatgcagaccatctaagtgttccttttgagtgcacaccagaagtgagccaatgcggtcaaaggggatatccagatccttacagagctgtcccatcaatacattgccccgcacattcatgcgcgccatcatcgtatctggtttgcagtcatagccggcatggacgattgcactgttggctttagaagtaccacaacccacatcctcgtcgcgctccatcactagtacattgcacgtatagcgggatagctcccgtgcaatggcacacccggatactccggcaccgataatgattacatcgtaggtcactctacacaccctctcccttgacccaaccacgtacggaatctactgcgtggtgccaatgtcgaagctcatagtcacgccacccgtcgttcttttcgggcttgaactccctatcaattgcccagttctgcatcaggtcgtctttagaatcccaaaagcctacagcgaggcctgccagataagaggcacccatagccgaggtctctacacaggcaggacgtctgaccggtgcattgataatgtcggattggaactgcatcaagaagttgttcttgcaggctcccccatccacacgcagtgaagagagattgcagttcatatcgcgctgcattgccgttaagacatcagcagtttggaaggcaatcgactcgagagtggcccgaataatgtgatacttgttggtaccccgagtaaggcccacaatcgcgccgcgggcaaagggatcccaatagggagccccgagccctgtgaaggccgggaccatatagcacccattggtgtcacctacccgagtggcaaagtattctgagtccggtgcagtgtcgatcacgcacagctcatcgcgcagccactgtatagcggcaccggctacatagaccgagccttccagggcatagtcaattctgtcatcgataccccaggcaatggtggtaagcagaccatacttggagaagaacggcttttctccggtgttcatcagcataaagccaccggtaccgtaggtgttctttgcctctccctgcccaaagcaggtctgtccaaacaaagcacactgttgatctcctgctgccccagcaataggaacacgagatcctacgaattccggatcaacatagccaaagatgccacttgaaggtctgacttcaggcaggatgctcatcgggatatccaagatcttgcaaagctccggatcccacttgagggtgttgatattgaacaagagggtacgcgaggcattggagtagtcagtcacatggactttgcctttggtgagcttatagatcaaccaggagtccaccgtaccaaagcacagctcccctttttctgccttcccccgggccccctctacgttgtctaagatccagcggatcttcgtaccggagaagtaagggtcgatcaaaaggccggtctttctgtggaaggtctcaacgaaggtcgggtcagaggctttgagcttctcggtgaaatctgcggtacgccggcactgccagacaattgcatggcacagtggctgtccggtttctcggtcccagataatagtggtctcacgctggttggtaatgccgattgctgctatgtcttcaggctgtgcagcaattctgatcatcgcctcacgggctaccgagagctggttttgccagatctcattggcatcgtgttctacccaccccggctccgggaagtactgcgtcagctctttttgtgccatcgagcagatctcacctgcatggttaaacaggatacatcggttactcgttgtgccggcatccaatgccattacatactcgccactcataactctcgttctaacttctacgatggtgtattacttatatcggtgctgttatcaaaggccttaacgcctcattcaaccttttcctcttccaaagcagttttttcagctgccgctttttctgctgcttctctctcaaaacgagggcaaccaaatttcctagcaatgaagtctacggtaggcggcacgataattgcggtaattacaacggctgctgcgatttgagttgttgcagaagcaacaaacggtgcccatgaagaatcaatctctgcaacagctgcaggagttgcgatggtatttccaccagagcttgcaatagctgctccagcataacctggacgcctgttgatatatctgtctgccaagaaagaaattccgccaccaataaagaagaccatagcggcaaagacaattccagagataccagcatcgacaatgctcttaaagctgatccctgcaccaatcgcaaagccaacaaacggtacgatgagtcctgctccggcatcaaagaacttcctcatatcgggatcgagattacctaatatacaaccgatgatcagagggataattgcagcaagcagtgactggagaggaatattggccatacctgatgcggttaatgtaagtaggcaaaggaatggtccatcatgaatattcatgatactttgcgctgcagtatctgccgcatcaccatactcacccataagtgagagatacaacgaaccattagcaccggtaattcctgcaaaacaagctaacgttgagatgcctaaaatgccagcctgtccaaagaacgcgccaattaaaagacctaagacaacgccggctaagtatttagcaatcagaaggactgaaccacgcttgagagcctctccgacctgattgaatcttaagttcgtgccaacaaagaagatctgcaatgctacgactgccgcagtgccctgagaagagaacagagccgtagtaaacgatccaatacgcagtgcatcaggtgcgaaggtattaattgtggcgcccatcagcaaaggaataaccatcatgcctgcagggactttttgtattgtttttagtattggaacactcatttgtctttccgatccgagtcaatgccaaagtaccatactcataataaaaagttgttttatttatctttgatatttatgcataaagcgtcttatcattttgccatgcaagcctataagagcaggtaaatagcaaaatgcaacttcttactacacaaactttatgggataaaacaatgttagtaaaacaagaatatttattagttagattcagcgatgatacgttttacttgctcatattctgcttgggttacttgacgagcaggtttctggatatacgtggaaattggtaacccttttacacgcacgccacatttcactgctgaaataaagagatcacacacatcatatacttgcatcaaatgagcaattctctttgcctttacaactgctgtggtgtaatcgccagcttcatatgccctatgcattgcaacgaaggcttctggttcaacattaaccaaaccacacagaacaccatcgccacctacaattctggtaggcagataatattcatcgtatccagaaaggatccccacattcgaccgtacagctttcacagattggatgacgtgcctagtgtgacttgcactatctaccgtgtccttcatgccaatgatcgtaggaacctctttaactatttttgctgcgagtgaaggattgatgtccatcccggtacgatcagggaagttatagatcacgatcggcatatcagtacactgagcaatatctttatagtatgtcagagctgtttgatcagtaggaccaaagtagtacggacatatggccacgattgcgtcaacgtcagctttctctgctgccttcaccatacgctctacattcttaaaagcagtatctccgactcctgccaagacctggatatcccgatcgcggagtctatctgcagcaaattgaactgcttgttcgcgttcttctatggggagcgcataaaactcgccgatgctaccaaagataagggcaccattaatccctgcatctgctaagtgatctaaatgcttaccccaaaggtcatagtcaatatctccagtatcattgaatatggtaatagctggacaataaatacctttaattttcactattgtacccctacatcatcactcttatgtcgtttatcatgtgcgctattagtcctatttcagcagatagcacaatcacttcaatttagaaatcgatagaggttctgccatgctcggtacaccacaagagccttatcgacaaaacccctctcaaaagagacgaactaaatgtagttgcacaggtgcggtaaagcggtctcaacaaatcccattgattcagcacaggtttcacgaccgttgaacacttcgataagatcattaaacatcttatctctcagttcctccatcgtatctggaccgtagatcgaggcagttgcgtcaaagtcagtattgtctgccatcatctttgcggtagttggattagcggtcaatctgtacacaggagcaagtgcatttccggttggagtcccttggcctgttgaaaaaacaacgagttgacaaccaccagcgatacaacctgccacagaagaaggatcgttaccaggagtatccataataacaaggcccttatgtttctctattgcagcggcataatcatagacggcttcaatgggagagtggccacctttatgaatgcaacctaacgacttctcctccagagttgtaagtccaccagccttattacctggagaaggattgccttctctcatttcgaagccaaagatgctcacactatgctcatagtctttcacgattttgataatttgatcgccgacctttttagagacagctctctttgccaaaatgtgttcagcaccaaaaagctctggagtctcgcacaacactgatgtggcaccaagggaaacaaacttatcagatacagtaccaattaatggattagaaccaaggccactcgatgagtcggagccgccacagtttgtccccagaatgatattggaaatatcgctgggctctctatgacaggtttgcgcttctttaacaagttcgcgagcataccgaatacccaaatccagtgctttgagggtgccgccaactttctgaatgataatccggcgcattggtttgtcacaacgttttttgatttcgtcgacaaccatatcattttggcaggtctcgcaaccaagtgaaagaactaacgtgccatagatatttggatttgcagcatatccagccattgcatgaagagtttcatctctgtcaatatcaatctgtgagcaaccgttttggttgtggaatgatacgcagccatcaacagattttgcaatttgctcagcaagatcggatgcgcaaatactagtggggagaatcaggacatggtttctaattccaaccgatccatcaggccttttatagcctaagaactcgatattactcattttttcctcctgcagccgcttcaagattgtctgaacttgccaaattatgcgtatgtacccactgaccttttgagatatcctgtgttgctacgccaatatactcgccgtactttgtgacttgatgaccttcaggaacgtctcgcaatgcaaatttatggaatagaggcacgtcatctcgaaccgtaatcttttcctctttaccagatgagtacgtgtaggttacttcatctcctttttttaatgggtgtactgcaatggctacattatctgagtcttcaataacaattgcatctctcatcaaatactcccctctcaaacatgtacggacctatataacacagatttttgcttgcttaagcagctgataatatttatcttacagaaaatgttctttatttggaccctttggtccatataacgaactaaacggtcactattctcctgcgaatggcaaaagtcctcacaaaaaggttcaattctaaaaactgtgggcagatgcccgtggcttgatgctcaaagagacagaaaagcgtccactctctagaatcttgcatcgcgacaagaagattccgaagaaggatggagtgcgatgacaagtgtagcatcgccatcagcccagctgcccgccattccccatgccaaggaagctcctgccttcctttcgatcccctcgcatctcgagggcttcgtacagacgggagagcccagagaaggcgtgcgcaccgaggagttcgggacgtcgtccaggcgatgccacaagccagtgcgcatcctgtccgttccaggcaggcttaaggcgcaggaagctccatcatgcccctgctgcggaaggggtcgcatccgtaaagtggtgtaaaaggcgggcgagccagaggcccgccgccaaggtgtgctcgcagtcaccaaacagcgaggacacccaagaggacggccatggctcgaatcaatcttacactggaccaagacgtggtgctggggctgcttaccgacggggacggggacaccttcaggctgctgctccaggagacgctcaacggggtactgagggcgaagtcagccgagcagctgtgcgcccagccctacgagcgcaccgatagccacaacgagacgaagacaaggcccctcacgaccagggtcgccaccatcgagctgaaggtgttaaggcagcgcaccaccccgtttgagaccctcgtgttcgacaactacaagcgcaagcgaggctgcccttgtgaccgagatggtcgtcgcaggcgtctttacagtgaaggtgggcagggtcgtagaggagatctgcgaaaggtcgttctccaagcaatccctctttgaggcctgcgccgagctgaactccgctatcagggcgtttggtactagcatataaataggacaccttagatatgaccttttcatacagcataatatataagagatggaggaaagagtcatggcaaagggtaaaaggtattctcaacagttcaaaaatgatgctgtccagtacaaaaaggatcatccagagatgacgctcatcgatacggctaatcacatctgggtgtaagcaaatcagccctcaaacactggagtgcatccgcaaagcaaaatgatggagacgtcatttcccgtggatccggtaattattcaagtgatgaggcaaaagagattgcccggctacgccggcagctgcgggatgcgaaggatgcccttgaaatcctaaaaaagcaatcagtatcctgggaaaatgaccgttactgtttattctgagactcaaagatataccgatgagatcagacagaacaatccgaaacgccatgtttcggtcagcgggatactgtattatctcggcgtttccaaatctggttactatgcctggaggagccatactgatatggccgccgattctgagacactgatttgaccatccttccgaatcccgcaaagatgtgtccgaggggacacggattgcgaggaagagatgtccaagacgacgaggaagacatacagcgcgagcttcaagatggccgtcgcgctggaggtcgcgaaggagcaggagacgctctcgcaggtggcagccaagcacggcgtgagcccgtcgctcgccgctgcatggagggacgagctccttgcaggcgccgacagcatattcggcaggacgaaggaggagcgcgagagaaaggagcaggaggaggccgcgcagagaaagtacgacgaagccctgaagacgatcgggcagctcaccgtcgagcgcgacttcctccagcggttttgcgacaggaacggatacgaccccaaggcgtgaggctgcggcaggggaccttccggaggggctcacgaggcagcgcgcatgcgagctgctcggcgtgagcagggcgagcgcctaccgagacatggcaggcgcaggagcggcggatggcgcagatgcatggtccgataaggacgagcggctcgccgccgagatcgaccgcatccatgtggagagccccgcattcggcgcgaggaagatctcgaagatgctgcagaagcagggcgaggggcgcgccacccgctacagggtggggaagctcatgggcctcatggggatccgcccctgctgcccgctgccatctctctcgaagcccagcagggagtcgaggaggttcccatatctgctgaagggcaagagcatcctcttccccaaccaggtttggtccacagatatcacctatgtccagatagggggaaggcacatgtacctcacggcggtaatcgactggttcagccgctacatcgtctcctggaggctctttgacaccatgcgcgcccaggaggtggctgcatgcgccaggcaggccttcgaggagcacggcacgccctccatcatgaactccgaccagggaagcgtgttcggctcggaggagtatgtgtcgctgctcgcatccatgcatgtggagcagagcatggaggcaagggccagatggagggacaacgctctgatggaaagatggttcaggaccctgaaatcggagtgcctgcggcaggaggagtacagcacgcctgcagagctcagggcgatcatcgcgaagttcgtgacgtggtacaacgagaagcgcatccaccagtcgctcggctacgacacgccggcggagtggtacaggagcggtatctgcgaggctgcataggcctacaatgctgctgtccggttagcaagggttttcggaagtatcgggccttcactgtctcacgagttcggccacttcatactccctccaggacagaagatacacagaaataaaatgaaaggcaaaattcaggaaatttatcagcagtcacatcagatttatggcgctccgaaaatagcggcagttcttcataagaatggggattagattagcgaacggactacaggaaaatatatgcgaaagatggggatttgtgccctgtgggtcagtcattggacgcatacaacaacagattcagactttgatctgagactgcagaatatcctggatgagcagtttagcccggatatgcaaaatgctgtatgggtatcggatatcacatatatttggactgaaaagggctttgtttacctcaccagcgtcatggatctgttctcccgtaagattttggcatgggtgttgagccgcacactggaggcaaaaaatgtcgtagaaacagtacagaaggctgtcagagaacgtgatggagtgaagccaaaggtattccataatgatcgtggatgccagtatgtatcagatgaattccttgaggcaaccagggaaatgacaaacagttattcaaagaaaggctatccttgggataacgcatgcattgagtcttttcattcgctcatcaaaagagaatggctgaacagattcaaaatcgagaattatgaccaggcatatcgctatgtattcgaatatatcaatacgttttataacacggttcggattcacagccattgtaaatatcaatctccagatgaatatgaagcagcatattcgaagcgattgtctgagctcaagcagggactggcaggagagggtgaaaaaagttgtgtttaacctgtccgaaaacttgacataggaccaaaagacctcccatccgtccctaagccccatggacctctcgaagagccttgccagcatgccttccttaagcatctgactagtaaacgcccatggtaaccgctgtcaggcaacctggtaccacgggcatcttctggacggtaccgctgataatgcggggcggtaccgctacagctcgggcatgtccttcgcgaaatacctccgcatgtcaggaccgtcgaggtcgtagcgccgcgctgcggatgcgacgcggcccaggatcgagtcggccatcgacccgccctctatccaaagataccattcatggggctccagctgggaggatatgagcgtggccaccttctcgttgcgcccctccaggatctcgaagagatcgactgcattctgcgtggcgatcggagtggtgaggaagtcgtccaggatcaggagttggacgctcttcaggtcatccatgaagctatagtaggaggcggcatcgaatgccctcgagcggttgagcctgtcgaacacgtcggcgaggcgcaagtagcgcgtggggatgagcttgctgcatgctgcgttgcccagcgcctggcacaggaagctcttcccgcagcccgtcttcgatatgagcaggaccacttcggcccttcccacccacctgcatcccgatcagccttgcgacacggtccctgctgagctttcgctccggcaggtagacgatatcctccacgcaggctgccggcagcttgaagcctgccttccttgtgagctttgcgaccttgcacccatgccttgcggatagctttgcatccagcaggatcttgatgcgctcctcgaaggccatatcgtcacattcggaatcgtctatcatctcgcggagcctgtcgcccatcgccttgatgcaaaactgcctgaacaggtcgaaatcctcctctgtcagcatggctcgccaccccctgtcctccaggcgtcggctccccggacatggccggcatgcttcgcgcgctcctcaagctcctccctgcacctgacaggaggcgctttctgcacatgcttccttgcctgctgctggatcgagttcttcagggacgtgtagctcgccaccgccccgagcgaattgatgcgtccgcatgcggcctcgagctgcacgagcgaatagcgcttcgagagggcgagtatgttgcggcaggagaggaaggcctgctctaccatgggcctcgaatcgagcaggcggacgatggccttccccgtctcgggcccgaccctgcctgcccagctctcgaagcgctcccgcgaccacggagactcctgccggtggctttccggcatgtgctcggcgaaggtcgaatactgacccttcctgcccctgagcctgggatgggtcgcaaccatggcgccgccgctcatgaccagagcctcgtggccgtgaaactaacgtccacctgcatcccgatcagcctgtgcgggaccgagcagtggccatagtcgaccacgatatggtagtcggggccgaccttcgtgctgcgccactcgcagcgctcgtacggctggacgaggagcggcagcatgcagccgccgctcctcgtcctcgtagacgccctcgagccttcctttgagtatttgcgcgtgtaggcaccagtgattattgcggctgagcaccggctgcgtcgcgaatcggcaccgggggcagcgccgtgcagcaccgccccctcacgaggcctcagctcactgcatcaggatctgggaccggaagatgctgcagcccttgcggcggcacgcatgttcatctctcccatgtcgacccatgccgtgttgtggacgatgcggtccatgcccggctcggccgtgacatccgcgccgagacgggcatgccagtccttctgccggtacggggtgcaaaaagatcgtcgacctcttgtcgtagcgcagctcgaagatctcgagcaggaagcggcaaaagccgtcgtccggcctgctgagcagccattcgtcgaggacgaggacctggaaggccccgcatttcctcacggccttcgcgacccctcccgggcgctcctgcgcatccttccaggcgcatgcctcctttgcaagcgcgcaggcgagataggtctttcccgtgcctgcaggcccgaagagcacgacgtcctggcctctcgtggcgaacccgcaggtcgcaagctcgcctgagagcacacggtcgagcccgcgctcctttgcatagtcgatgcggcgcacgtctgcctgcggatatctgaggttcgccctcttcacgaggttgtagatcttgtcggcaacatatcctgcatgcgccttaccgaccgccatctgcatcctctgctcgaagggcatccccatgcagacggaatcgtcctgggcaaggagcgcctcgagcagcccgtccgctcccatgtccctcatcttcctgcgcgtctgctgtccgatgttcatcatgagctgtaatcttttggtggacagggggattcagggactggcaacagatatgctctgtccagatacccacctaccaacaccagcagattgaagagatgagatgtcggtaagcgcaagcgagatagagaaggcaaagtcccgcacgaagccggcaccacccaaacactacactgaagaagtattgccttaaggctatcgactactacaggaaggcacgtaaggccaacccgaagaagagcatcaaaggatgcgccgcgaagcttgaggtcaacgacaagaccttaaacgactggatcatcaagcactcaaagaccaaaagggtgacccaggaaaggatcgacgatcacaagcagctcgacgcagtggacaggcgcatgcacgagctcgaaagcgaaaataagttcctaaaaagtggcagccttcttcgccagaagcctctgttgaaggacaggttttagctcatgctggagaagagggcaacctacagcgtctcgatgatggagcgcatactggaggtgagcagggctcacttctacagatggctcaaggccggaggcggtgaggacctatggggtcccctcaaggaagccatctgcgcgatatgggaggaaagcgacaggcgctttagctttcgcaaggtctggtccaagctcacaggagatccaaagttacgcaaaatttacagtgacgacccgctaccacgtgcgaaggtgcatggctaagctaggcatctgcggtatctgatccaatgcctccaagagaacgatactgcccacacctgatacccccgagcgccccgacctcacccggcgcgacttttcgtgtcttgtgccgacagccaagctcgtgggcgatacaacctatcgcaggaccacggcaggctttatatatctcgccgtcgtagacgatctgtgcacgcgcatggtcgtcggctggagcatacaggacaacatgagggcagggcttgtcgtctttgccctgaagatggcatattcgcgcggatacgtgaccggaggggccatattctaagcagtccaggcagccagtacataagctcagagctggccgcctgctcagccgcacacgacgtgaggctctccgtggggagaaccggaagctgccacgacaacgcgctcgccgaatcgcttttcgccacgctcaagaacgagtggtactaccataagcgcctcttagacgcatccacgaccaagcacaaggcacacgagtttaatcgagtcgtactacaaccgcttccgcccgcataagtccatagaagatcgcgtgcccgcagaggtgatgcaggagttcttcgagcgcctcgagagaggccttgcgtacgatccggaggcgatgcagaccgcatagaatctgagatttctctgtccattatattgacaggggtcaaggaagatatagaagatgctgcaaaagcaaggagaggcacatgccacccgctacagggtgtcttaaggctgatggagcttgcaggcatctgcccatgctgtacgctgtcgtctcctccggtaccctcctgggcatccagaaggttcctctatctcttgaagggcaaggcatcctgttccccaaccaggtgtggtccaccgacatccacctgtgtccagatcgaagggaagcaccttgtatcttaagctcgctcatcgactggtttagccgctacattgtctgctggaaggctctttgacaccatgcagaacacaggagatcgccacacgtgccaagcaggctttcagggagcatggggcaccctttaccatgaacttcgaccaggggagcgcttttggctctaaggaatacgtctttctgctcgcatccaaagggatatcccagagcatggacgaaagggcgagatagaaggacaacgctttggtagagagatggtttcagaccctcaagagcgaatgcctaaaggcagatggattcaccatacgcatagctgcgacacgccggaagaatggtacataagcggcatagccgaggctgaataggcccacagaggtggcgctgtaaaagccagggattcggaaggaatagggcttctgtgtctcactacctcagccaattcactccatgcagcggcaagcgacgggctcacgccgtgcttcgccgccgcccctaagagcgtctcctgctccttcgccgcctcgagcgcgacggccatcttgaagttcgtgctgtttgtcttccttgtcatcttcgacatctcttccttataatccgtgtcctctggacacatctttgtgggattcggaaggatggtcaaatccatgtctcagaatcggcagccatatcacggattgcagtgttacgttcagaaattcaaccgaccttttgaatatagagtgcataccaacaaagacggatagtggatggcttagataaaggtatatgctattaagttattagcttctgttgtttgaataacaggccagtgataattaaggggaagaggagaatattgtctcaagagcaaaacaaagctactgtacctcatcgtgccacacaacgtgtgctgtcaattttagatttacttgcccaagcaaaagaatctttaactttttcggaaatacagaagtcacttaatataccaaaaagtagtttgtcgccgatcctccacactatggttaatgcggagtatgttcaaagtaatgaagctgatgcaacatatagtgtcggtatccacgcttttatggcaggtaaagcctttgaacgttctaatgacgatttgacaatgttgcgcagggtaatgcaaggcatcgttgataaaactaacgaaacgtgtcaggtaggaatactagatcacaataaagtcttataccttgtgcgtattgatagtccgcaagtgattcggcttgtatcaagtcctggttatttactccccgcttactgtaccgctatcggaaaagtccttattagcgaatggagtgatgaacgcctcaaagagctggggccagaaccgtatgatagatacaccgataggacgataacgacacgtgaagcactttctgaggagctggaaaaggtcagagagtatggcattgcacgtgacagaagtgagatgacaaagggtgtacagtgtatagcagtatcgttaaaagtgcagggatctattaaatatggacttggacttacggtcccagactatcgtctcactgatgagaagcttcaagaatttaagcaagtattgaaagatgctcaaactcaattagaagcaatgctcatctgagcattcattttcttaatccgagagtagggaagcgtgtggataggatctctcacctgtaaccctgtggtgctgccattggcattgccaagcatagggaaacgatgattaattcggctcgatgaggccagtggggccacacgctgtatgacatcggcttaaaatgtctcgaaccacgcagtgcccatatccacataaatgcctatctgtcttctggatatggtatagctacatccacacattccagcatatccaaaagacagatatgggcagatagatgagctttcaagaccttaaatcctaaggtctaaggagaaagaccagacaagaggtgctcctggagcaaatggatgtaatcgttgtgtggcacagctggattgcactggtagataccagctaccactgacaggctcttgtcaggcatgtgcgcggtgcaaagacgatactttaggatgtatctggtgcaggtcatgtttgggctcttaagacgagggaacctaaggatgctatcctggattgccggccctggcagcgcttctgtgcacgtagacctcatgcaagagcaggtgccagatgcaacgacgagcgcgaagatgcgccatagccttaaagcggcagggactcggcaaagcttgtgctttacgcctgaacttagaacttaaaaaggcagggatcacggcgcggggcggctccatggtggatgtaactttcacctgggccttaaagcttaacgaagaacaaggaccatacacgcgacccttaaagcgcaccagtccaagaaagggggagcttggcgtatcggatacaaggcgcatatcggcgtggatgccgcaggtggccttgtgcatggtgtggagacgatcgcctagaatgtatccgacatatcctgtggcacatgcactcgtaagggagtatgacaggttctgctgcgcagactttaggctatagaggtatagcgaagcgcccttaaggacgcataaagacccacacctctcatctatgcgctaaagcgttgctaaggaagccttcgactagagaaggccttgcctgtgcactcttctccgagaagggcatcgagtccaggaaggcatccggccgctcaaaggtagaagcacccttcctcatcgtgaagcggcgcttctaccccttaaggaagcgctactaggggatagagaagatctcctgtatgctcgagtctttctcgcccctgcaaaccttacccatgtgcatcttttgccggcaggctgcacctcccggctctcagcgttgctcgatccgtcttggagccttcttgcggtgcatggggcaggacagatgtaaggatggcggctcctgcacgtgctagatgagcatccttccctgcctttcccacataccggcctagaaaagtcgtgtggccggtcccctctgacacgttatggggcattaatcatcgtttccttagcagttttgcgacgacaacgcatatagccctagggcataaagccacggcttagcggcgacatcgccagcggtcccgcagaggggtccatggaggatgggcagatctggttgggtgaggacgagaggcttttccgcactgatcgacgccatacacatcgactgccgcgccttatggggcaaggaagatataggctcttcgctacttatggtgggtagcactcctgcatcctcttgagggcgtggcctttgaacggtaggatttccggaaaggaaaagcttcggtcctaaggcgcgatatggatgcttgactagtaagttgagccctgtcaatataatggacagagaaatctcagattctatgcggtctgcatcgcctccggatcgtacgcaaggcctctctcgaggcgctcgaagaactcctgcatcacctctgcgggcacgcgatcttctatggacttatgcgggcggaagcggttgtagtacgactcgattaaactcgtgtgccttgtgcttggtcgtggatgcgtctaagaggcgcttatggtagtaccattcgtttttgagcgtggcgaaaagcgattcggcgagcgcattgtcgtggcagctttcggttctccccacggagagcctcacgtcgggtacggctgagcaggcggcgagctttgagcttatgtactggctgcctgggctgcttagaatatggcccctttggccacgtatccgcgcgaatatgccatcttcagggcaaagacgacaagccctgccctcatgttgtcctgtatgcttcagcccaccaccatgtgtgtgcacagatggtgtgcgacggtaagatatataaagcctgccgtggtcctgcgataggttgtatcgcccacgagcttggctgtcggaacgggacacgaaaagccgcaccgggtgagggcgggacgctcgggggtatcaggtgcgggcagtatcgtcctcttggaggcattggatcagatgccgcagatgcccaagcttagacatgcacctgcgcacgcggtagtgggtcgtcactgtaaattttgcgtactgcggatctcctgtgagcttggatcagacctagcaaaagctaaagcgcctgtcgctttcctcccatatctagcagatggcctccttgaggggaccccataggtcctcaccgcctttggccttgagccatctgtagaagtgagccctgctcacctccagtacgcgctccatcatcgagacgctgtaggttgccctcttctctagcatgagctaaaacctgtccttcaacagaggcttccggcgaagaaggctgcctcttttttaggaacttattctcgctttcgagctcgtgtatgcgcctgttcactgcgtcgagctgcttgtgctcgtcggtcctttcctgggtcacccttttggtctttgagtgcttgatgatccagtcgtttaaggtcttgtcgttgacctcaagcttcgcggcgcatcctctgatgctcttcttagggttggccttacgtgccttcctgtagtagtcgatagccttaaggcaatacttcttcagtgtagtgtttgggtgtttccggcttcgtgcgggactttgccttctctatctcgcttgcgctcagcgacatctcatctcttcaatctgctggtgttggtaagtgggtatctggacagagcatatctgctgccagtccctgaatcccactgtccaccaaaagattacagctcaacctgccctccgcgtcgcagccacgcagagcttgttcctcgagaggccgcgcttcctgctcccgtccgtattgagctgctcgtcggcgcgggctcgcggatagtacttctcgtcgatttcgacgtcgccgggcaccacgacatcgtcctggatcccgtccaagacgcagaacagcttcgccatccagtaggacagtgtggtctttggcctgcactcctcccttatcaggccgttcatgctctcgaacaagaaggtctggaccagaaattcgcaccgctcggacaccggagcctgtgtccctggaatatggtgccgtccatgggcgtgaacgtcctgccgcagccctggcagcgccatctacgggctccgttatcgtcctgccgcatcctccgatgcgcgccgagccgcagaaggggcagctgtcccgcacgtagccattgaagaaggcgccctcttgcttggcagagagcggcgagtgccggtacctgtacatgctcctgtgactctgcatgacggccatctcggcatagcgccgcttctcttcgcttgtggtggtagtcttagctggccgggtgggaggcggcgcctaggactaccacatcgcaagagcgccgccacccgccccgccattctcgcgggtcgatatgtggttagtccgattatagggcgtggagcccagagtccctgtcaggctgcacattctgcaaaggataattttcataagaataaatcagcctatggaggagctcgacgcccaatactcactgagcggctgtaatctctctgtaaatggaggatcgcttatggataccgtaaagaccgcatttgtgccccaccgcccaacgaagcgggtactcgatatccttgagacacttgcgaattccaagcagggaatgacgttgagtgaactctcacggacgacaaagatcgcaaagggctcattgagcccgattgtccacaccctcgctgagcgagacttccttcagttggaccccagatcacacacctacagcatcggactcaaggcgtacctgatcagccactccttctatcagcacgatgcgacgatcaaactcttaagaacacagatgcatgcagtggaggaaggctgcctggagacctgtcaagttgggatacgggagaacgacagagtcctctatattgcaaaggttgattctccccaaccgatccgcctgatctccgatgtgggcagacgccttcctttgcagtgcaccgcgattggcaaatcactcttgctcgattgcacaaaagaagagctccaggcgatcttcaaacatggcatgaaggctctcacggaggacagcatctcggatatcgacatattgtatgcgcagcttcggagctgccgcgagcggcgcatcacctcagagcatggagaggcactcgcttcggtccgctgtgtcgctacacccattcgcgtcgatcacatcatacagtatgcactgggtgtctcagttccggcgtatcggttcgacgatgaaaagaagcagaccgtgatcaagctcctcgatcaggcccgcaccaaactcgaggctgcgctcaacacctgaggatcggccaccatcgacgcggcatgaaaaacgcccccggactcaatccgagagcgtttcgctttcactctgtgaagtgacagtcattcgtctttctttccgacgagatcatgggtcacatcgaccaccttctcaaccgcgttcacgatgttttggtagccagtacagcgacaaaggtgacccgagagctgctttctgatctcatccctcgtataagtcttgccagcgttgtacatctccatcgcggacatgatgatgccagggatgcagaaaccgcactgaactgcaaactcatctacaaaggcctgctgaaccggattcaaggtaccatcctcccctgccagaccttcgatcgtcacgatatccttcccctgtgcccaatcggttagatagaggcaggagtccgttgcgacaccattaatcagcacagtgcaggcgccgcactcgccgacctcgcaaccgcgtttggtgccagtgagatgaaggcgatcacgcagggtatccaagagggattcacgtgggtcgtagccgacctggacaggcttcccgttgatcgtgcactccaaaatacgcatatccatagctattcagcccctccactctgagccgctttcacaagcgagcgcttcgacatttccttaatgagttggtagcgaaagtcctttgaagcgcgccaggaatcacgcggatgcgtatccttctgcgcaagctcaccgataatctctgcggcatccttcaccttcatgccgcgcaccttatcttccgtactgtgggcacggatcggggtcggagctgccacgccaaaggcgaggcgaatatcgtcgatggtctctttgtctgtgcccaacttcaccagacagcagcatcccatcgtcgcgatctcaagcgcttggcgtttgccgtacttgaagtaatagccactccatccctcgtagttcttcttcgggatacggatcttatagagcagttcatcgtgctttctgacgcagcggcccggacccgtgtaccactcttcgatcggcacagtacgcttgccggaagcgctcacgagatcgagctttgcgccgtacgccaacaacgtcgaaccggtatccgcagaggttgcagcagtacagacgttgccgcctatcgtgccggagacacgcaactgcggaccacccggggtgtcacaggcctgccctaacgtcggcacggtcttctgaatgatcgggttaaccgtgagcgaatggaagatggagagtggcccgatctccacggcgccatcgtccgccaaggtaacgccggtcagctcgtcctgcagcccgtggattgagaccaagtgcgctccggcatctttgccggaacggatcttgaccaggacgtcggtgccgccggcgataacctcagactgctcgtcggctgccagggcgcgcacagcgtcctcaacgctcgttgcttcatagagcgatgcgatatcgtacattagattaacccctcctttttgaagccctcagcgaggcgctgcggagtcattggcatgtgatagaacttgacgcctgtggcatccaggattgcgtcacggatcgctggcgccggggagatgatcggcgtctcaccgaccgccttgttgccgtacggtccggtcggctcatcacactcgacgttctctgccttcagatcaggcaagtccataaaggtcgggaccttgtagtccagcagcgtgttattgagcacgcgggcggtcttcgggtcgacttggacctcctcagagagcgcccagccgatggactgtcccatgccaccgtggatctgctgctcaacgagcttcgggttgatcacacggccgttgtcctgcacactgatgatcttgttgacggtaactttgccaagcggcatatcgaccgtaatgtcggcaaaagagcagccggtagcgagcgcctgggtgtgaatattgactgtggcataggtgctcagctgatcgttctggtcgaggttgtagtagcactcgagggcaagtgacggcaacgtggcaaccaccgcaccggtcgaatcatagattttgttgtcgtcgcgcagatcgagcgggagccccgcatttggatagatgcggtgtgcgaagccgaggatctttgtgcgcatcttctgcccggcctgcttgacagcagtgccggagacataggtctgacgggaggcgaaggcgccggggtcatacggcgtcacatcggtatcctggaaagacacgatgtggatactttcagacttgacaccaatcgcctctgcggccatctgggtgaagacggtgtcggctccctgaccgatctcggtggcgcccatctgcagctggaaggtaccatcctggttaagggtgatgcgggaggttgcggtctcaagcgcaaagggagcaacggcggtcttgtagatgaagaaggcgacaccgacaccgtggcggataggaccaatctcgttcgtgtactctttctttttcttatcccactcgatgtacgctttgcccttctccacgcactgcgggagcgcaaaggtgtgcgccgccatcacaccattcggggtgaactcatcgacgaagccttggcggacagcgttcttaaggcggaattcgacgccgtcccagccattgtcgtaggcgatatcccccatcaggcactccgccgcccagataccctctggcacgccgtaggcgcgcatagcaccggtgtggggaccgttagtatagacggtccaggcctcagagcgcgtcgccacttcctgacggtggtagagccaccggaaggagttgaccgagttcaaaaccagcgcatgaccgtggtggacatagccgccggtgttggagatcgcttcgattttacgggcatggagattcatatcatcgtcgtaagaggcttcgatgtcgaactccttcggctgcctgccggaggtatcccagaagagctcctcgcgagagatctccatacggacgcagcgtccaccgagctgctggcagatccaggcattcagcggctcgtagttgacatcctgtttggtgccgaagccgccgccgatgtagggcttgatcacacggacgttgccccagggtatacccaaagcttgaccgataacacggcgcataatgtgcgggatctgggtagaagccacgcagacgattttgtcgccttccccatagcagtaagagacgcaggtctcgaggtgcacctgggactgctcaccggttgaaggatggatcctgatgtagtggtacttcgggtcattgatcgcatcctcaacggccttgtagccatgtttggccagatcctcttcactcgtcactgccagtgagtggccgacgatgttgtccggcttaaggccctgaacggggtgctcggtgcccttcatcgattccttcgcgtcgtaaaccaccggccactcttcgtactcgaccttgatcttgcgcagtgcctgatcgcaggcgaccgtgttctgcgccactacgacggcgatgttgtccccgtagatatggatgcgggaatcgagcagcttgcggtccgccatatcgcgcttgctggcggcggagtccgcataccaggggtgtcccgcaaccggataggtccagtcagggacatcgaagcaggtaaagatcttcacgaccccgcagaccttctcagccgctgaggtatcgatcgacttcaccagcccattgccgatggtcgaatgcagaagctttgcatcgaggcagggtttggggcacagatcgtcagtgaacatcgcgcgtcctgtcaccttatcgtaggcgtcaacacgcttgagggaccttccgacctcccgatacttctccattgcttaccgctcctttctgatgagcaataaacttatcttgacagctcacagttttgcagagatgcaagggggaccgctcttttccttcggtgctaacgagaacgcttgtttagtaagttactattctcaatatttactggacacgataagcaaaaatcgattgctgacaaaaggcccgctcatcccctgattggaaacaagcgggctttagaagtcaacacactgtgtgttgctctggaacaggcaagcgttaacggtgcttatagggcgttccgtcgagcggtaatctgttctgcccgacgccgtccacctgacggtaggcgttgcggatagcaggcgccgcgccgatcgaggagatctcaccgatgcccttgccgccataggcgaccgggagcagctcatccttctccacatagatcgcgtggatgttcgggatctgtgtcgcgtgcggcaatcctaaggtgccgtatttgacctttggaacgcagtccttcaggacaaagttctcagttagcgcatagcccatcgacatgagcacaccgccctcgatctgtccttggattgcgatcgggttgataactttaccggagtcgtgcgcagcatagatattggagaccttacggttctcgtcgagcaccgcaagcgtcgtggagtaggcgtagcagatgtggctcttcggatacttcttgtgggcaccgagcttgtcggtcggctcaaagtactcataggcgaactggcagccctcaagcttcttgagcgcgccttcaggatccttcacggtctgggtgtgacccgctttcaaggtcttcggatcactgatcgtatacgtggtgccgtccgcaaaggtcatgtggatgccgtcgcccttggcgcttaccttgcccttcggcacttcctcaccgcgttcgaccttctccattgcgtcgcgcagcaagaatgccgcaccacggactgcctcgccagtgataacggtctgccgggatccggaggtggtaccagagtccggagcggcttcagtggagcactcaccgttgcggatcgcctcacgcggaaggccggtcgcctcagagagatcctgcataaagatcgtattgcagccctggccgatatcggaggtggcagagtagatgacggccttgccgttctccacgtggatgttcgcacggcctgcatccgggagtccgacgccgacgccggagttcttcattgcgcaggcgagacccgcatggtctttgttcttctcgtattcatctctgattgcgagcagggtctctttgagcgcggtggaacggtcagcgatctggccgttcgggaggacagcgcccggctcaattgcgttgttatagcggatcttccagcggtcaataccggctttatccgccagctcgtcgatcagagattccagcgcaaactcagtctggcatacgccgaagccacggaaggcgcccgcaggcgggttatttgtgtagtagccatagccacggatatcggtgttttgatacttgtacggaccaaccgagtgggtgcaggcacgctcgaggaccgggccacacagactcgcataggcgcccgtatcaaagtggatgtctgcatcgaggccggtgaagaggcccgccttatcgcagccgagcgtataggtgcagcgcatcgcatggcgcttcgggtgaaagttgatggactcctgacgggtcagtttcaccttcaccgtacggttgaagtggaaggctgccaaggccgcgaggtgctggacggagacgtcctccttgccgccgtaaccaccgccgacgagcatcgtctgaacgacgacacgctccggggtcttgtcccacccgaacatgtgggcgacctcttggcgggtatcgtaggcaccctggtcggtggagaggatcttgacaccgtttttgtacgggaaagcgactgcgcactccggctcgaggaaagcgtgctcggtgaacggggtctcaaaggtcccggtcacggtgtaggcggagttcctcagcgcctccttcgtgtcaccacgagtaatgtggcgctgctggcagatgttgttgtgcaggaccacatggttgccaaaagcattgaagcttgtgtggatcaatggggcatccggctttgccgcctcatcgatgttgcggaccggatcaagctcttcgtactcgacgtcgacgagcttcttggcccgctccaggatctccggagtctcagcgacgaccatgcacagcgcatcgcccatcgagcgggtgatgtcgccttcagcgataaagacatcccagtcgcggatcaggtggcccacctggtttactggcacatcctcagccctaaggacgccgactacacccgacagcgcttccgccttagtggtgtcaatctttaagaccttggcgcgcggatacttcgtgcgcacgcaggagccgtatgccatgtccggataatccttcacggtgacatcgtcggggaacttgccgtagcccaagaccttctcacggacatcgtttctgaaggccggaacaccgacgccgtacttgtcgcccttttcgagctcgtagtcgagcttttcctcaccgcgcaggaccttacctgcaaggttgataccctcaatgatcttcttgtagccggtgcaacggcagatattaccgttgatggctttcttgatgtcctgctcggtcgggttcgaattctttctcagcagcgccacaccgctcatcaccatgcctggcgtgcagaagccgcactgaacagcgccacgggcaccgaaggcatagacgaaagcttccttctcttcatgggtcagaccctcgacggtggtgatctctttaccgttggcgcacttcgtgttcagcacgcagctcttcatggctttgccatccacgagcacggtgcacgcgccgcaggtgccctcagagcagccatcctttacggagaggaggcccagatcatcgcgcagatagcgcagcatcgatttttgctctgtggtcgtatgctcgacgccgtttaccacaaaacggtactcatctgccatagtcacacctctttcagcagtagatcagcgcgctcgtcacaccaatctacctcagttaaaagaaccaaagaaaaagttaagggaacattgggttcgcctgaccagcgcttagcgctcaagcagatagccgtaggaatcacggacagtctggatcatcttgcgcacgttctcaggaaggccacagctctcgtcgtcgatgttgtagacagcgacctttccaccgaagcggacgagcatgccatcctcggtcttcaggaagccctcgttgtcagagtcatcaaagtcctcacggctccagaacagagtgagcttatccttgtacggacggcccgcataagggcagaacacggcgcagttgccgcactcgttgcacatgccatccatatggatgatctggcgctcgcgcatacccggaacgcggacagcgacgttagcgcgattcgggcagacctcaacgcaggtctcgcagacggtcggacagcccaagcagcgcggtccctctgccatcgtgcacttgtcaaacaggtgtccacgggaggcaagtggctcgtcgtagttaggattgatgttcttcgcagcctgtccgtcgaaggtggcgccggagagtacgtgtgcaacggtctcggcgtcagcctcaaccttcacaatcacagacggtccacggcgggcatcgccgattgcgtagacatggtcacgggaagtcttgaggttctcatcgaccaccgggcgacccttacggtcgacctcgatgttggaagcagtgaagacatcctgttcgacgcgctcgccgattgcggagatgatcgcagttgccgggacatcttgagtcttgccggtcggaaccgggcgacggcgtccggactcatcgggctcaccgagctccataacctcacaggtgaggatgccggccttctgggatttcggagcgagtagctcgaggaactcgacgccttcgtcgatggcctcctgcagctcttcctcatctgccggcatatagcggcggttacgacggtagaccaggcggacgttcttgaccccaaagacgcgctttgcagcgcgggcgacatccattgcggtgttgccgccgccgaccacgacgacatcggtgccgagctcgacggaggacggatccgctctgaaggcctccaggaattcaagggcatccaggagcttggcggagccatcggtctgatccttagagaggacgcccctgcccttagcccaggcgcccacggcgattacgacatcggtgtaaccctggtcgagcagctcatctgcgctcttgatgttcttgccagtctcgaagcgggcaccgtaggcacggcagagctccacatcgtgggcgattgcgccgtcgctgatacggaagccagggattacacggcgtggaacgccacctaggaccatagcgcgctcgaagacggtgacggagatgccgacacgggagaggaaggaagcgacggccaagccagccgggccgccaccgattacggcgacgtttttgccctcctgctcaccgcgcggtgcgagttccttgattacggtgtcaaagcccttctgagcagccagaagtttgtagtcacggatatgaacaaactcttcgtaatagttgcgcatgcagacgttgcagcagccatgcgggcacagcgtaccggtcatgaacggcagcgcgttgctctcgaggatgatgtgcagcgcttccgcgtagtctcccctattgcaagccatcagataccccgggatatcctgatggatcgggcactgctcgcggcacggcgctatgaagcagtcaagcagcgggagcggcttgtcgatgtggcgctccgggagcaatttgattgaatgccgcaactgcggagtgtatgggatctggtcaaccagtttgtcgagggctttcacgtcgacgccactgaatggcttgtcgtcgacgtcctcgaggatcttggcaatctgctgctgtctgccgtatccgcccggcttcagcaagtttgttgccatcgtcactggccagatgccagcatcgatgagaccgtaaatgttggtgacatccgcgccaccgcagtaggagatgcgcagctttccgccaaactcgtttgagagcatatccgccagggtcaaggacagcggatagagcgcgcagccggacatgtacatctcttcgctcgggagctctctgcgcgtcacatcgactgggaaggtgttggtcagcttgacaccgaagtcgaggccctgctcgtcggcgagcttctgcaggcgcttgaacatcgggattgcatccttccactgcaggtcctcgtcgaagtgatgcgaatcgaagatgatgtagtcaaagccgagcgagtcgaggagcttgcgggccttctcgtagcctacaagcgtcgggttgcacttgataaaggtgttgaggtgcttattctcgatcaagtgcgtggcgatacgctcgatctcctcaggcgggcagccgtgcagggtggattcagtgatggagtctgagacgtgcggcgtgatggactcgacgaaggccttatcgacgtgcttgaaacggccgaggttatcctcaagccactcgatcgcgcccttgaaggcctcggtgttggaggcatccatcaggttgtcgatgaagctgtcaaccttgggagtcttaattcccttcaggtcatagcccacggacatattgaagacgaagccgtccggatcgccaaaaccgaattccttggccagtaccttgcaggcgacccaagctttgatgtactcatcctgcgcctcaatcacggtgagctcagtggaccactcgcagttgtagccctcatcgtttgccagaatgcagggcttgttcacgcacttggaaagctcacggccatccatctgttggaccgtcttgagctcgaagaagcgtgccccagtcacataggccgcgataaggttctgtgccagctgggtgttcggtccagcggcggcgccgaacggggcctcaatcttctccttgaagatcggacgggctccgcccttgtggaagacgagcttgtcctcaccgaagatggtgccctggttctcatactcgttcaggatccagtccatcaggtgtgcaaatgagattgggcgcataatatcgctcatggttgttcctctccagatgtacctcccgcgggaacacgcatgcatatggcgccgcgggcagtccatacgcgctgaacagaaggcccctctcatgtccctctcaaatctctgctcagcctcagttgtagtacttacttagtactgacgtccattcaggtcgccccaaagacgctttgcctgctcattgcagaaggcgttgatcttctcctcgtcgaaagcgacaaacttgcggtccttgtagaggaccttgccgttcacgatcgtggtacggcactgtctgccctccaggccgaagagaatgtgaccgtcgatgttctcttcagagagcggggtgaaggtgttgtaatcgaagattgcgaggtccgcgcctgcgccttcacgcaggacgcccaagtcgcgcttgaagtacttgcttgccatcgccggattgttcttgaacagcatcgtcatgtcctcatcccaacccacgttcggcctgccgctctcgaggcgctgcacgcagatgaaggccttgagggagtcgagcatatcgtgggtgtaggcatcagtacccatgcacaccgggatgccacggcggaagaactcgagcaccggagcggtacccacggcgttgttcatgttggactcggggttgttcacaagccaggtgccggtttccttgatcaggtcgagctcagtcggggtcacatggatgcagtggccgagcatcgtgtccggccccagaagtccatggttgtagaggcgctccaccgggcggacgccatagtggttctccatcgaatcctcgacgtcgtttaagccctcggagacatggatgtggaagccagtcagaccgccgttggcctcacgcatcttgtccattgtctcatcggagagcgtgaatgtggcgtgtccaccgaacattgcgacgatcatgccggaatcctgcttggctgcccagcgcgcaaaatctgcgttctcagcgattgcctggtcgcacttttcctggccgtcgcgctcggagacttcatagcagaggcatgcacggatgccgagctcctggcaggcatccttgattgtgaacagggatcccgggatctcagcgtagcttgcatggtggtcgaagatcgccgtcacgccgttgcgcagggactccatgatcgtgacataggcgctcgccttggtctcatccatgtagagatgccggtcgatcgcccaccactgctgctccaggttctccaggaagttcgtggggttgcagcccttgattgcgaggccgcgggctaacccggaatagatgtgggtatggcagttaatcaggccaggcataatgataccgccctgggcatccaggcgttccgccttcggataggtccgctccaactcttcacggggaccgaccgcagcgatcgtgccaccatcaattgcgaccgctccatcctgaataaaaggcattgcatcgtcgcgggtgataactctaccgtttgttaccagcagcatagttttcctcccccagattcaaagtgtcgcagctcagctacgatgattcccgttacgggcgcagccctctccgaccgtgccggccgaacgttttgagtgagagtccgacaagctcactgtttatcactgtgcccaagctgacaacttgcttaagcagacttaccgttattgtacctaactttttttcaggtatgtttgtctttactatcccatatcccttcccggatcaaggcctcgcttagcccatcgggcagattctgggtgtgaatggttatgaagcatggaagaagtgaagggggtttcaaatcacgttatataagtgaaactacaacgtagagatacctgagcttctcaaccatca

SEQ ID NO: 346 - DNA, 4997 bp, Unknown
  Metagenome-assembled genome
tatgcgggacggcagaaaaggttgcccatccgcacgtgcagaagtctccaatccttacatctttccttccccatcaccgcagaagggcctccaagacgatcaagcgactactcttggagccgggaggtgcagcctgccgtgcaagatcacatgggtaaatgttgcaacaaaggacgagaaagactcgaagtggtgccatggtgcacctcttctctaaaaggagcttcgtatctcttcatatcttctctacctcttctctatccttgcttgtaacttcttcatcttcaggcatcttctctatatcttctgtagcgaagttcaggactgccttaaatccaaggtcactagagcgcgctgccggcccaaaaaagtcatgtggccggtcccctctaacacgttatggggcattaatcatcgtttccctaagggcaccgacttcggcaaggttacggacgaggaggtccagcatgcggtggagctgatctgcgacaggccgaggaaggtccttggatataggacagccaacgaggtctttagggagatgttgcactcagcttgacaatctgccgtccgaaatattgacacaggtcatcacccccccacggcagtgcttcgaggggcctctccaggaacaagatctgcataggcatctccgccaacgtgcacggggcatcgcttcatctggccgatgaatgtgggaagacgagtcggaagaggacatgggatgccttcggtgggtatatcgcgcaaggcaccgtgctcgtgtatgacagggaaaagtcgtagggcatcctcgcagagcgcttgggccttaggagtaagatgcagggcgctaaggcatgccgcaggttccccgacagggagaattcctaggacatggtcaaccaggaatgcaacctactcaagagtctcctgaggtcctacagcggcttcagggcagccgacatccagaggatggctcgacctttgatgagtcttctggaatgtcagcgacaccatggacgaggaggtcacttggatgctggggcgcgccatgtgctgccgagaagtgctcagatacagggacttctacgcaaggcaggtcatgtagccagcacagctatgcaaattgggcttgttctcgagaagggcgccaaggtggttattgccggacgtgacgaggagcgcagtgctaaagcgtttgaggaattgaaggcagtatccccgaatgtttctttccacagaaccgatgccagcgatcctaagcaagccaaggacctgattgattttgccgtgaagacctatgattccatcgatatcatatacaacaacactggtatcgacagtgtccatccggttgaccagatgggtgacgatgacttcaataacgttgtcaagtacgcagcccagcagatggagcaacaggaccatggtggggctattgtgagtacctcatcgatcgagggatctgtcggtgatccgaatctgccttcctacaacgcttctaagggcggcgtaaacctgctgacgcaatccgtcgccttgacgcttgccgagtataacatccgtgtgaacgccgtgaaccccggctatgtctatagtggcgcggtgaacggggaaaccaagggtaaggaaggcatggagcgtttggccgctttgcatccacttggtcggctcggtaagcctgaagagattgcccacggcgttatgtttctcgtcgagaacgaattcaccaccggtacgcacctctatattgacggcggctatcttgcccagtaatccaccgacgaagtaatgcggttgaatcgcatggattccatctcgtattgaagggcctcccattttgaatagatgggaggcctttctggtatgaggtgcctcagaatccggaggttgtgccctccgtatgggcagcgtccaatttagccgatttgctgtaacgctctgccttgcttcgtgggtatgctgaaagtaaccatagatatctcttgaatgaaaggacctaaaggatggcgaaagtgagagtcgcgacaatcggcagaagtcacattacagagctctttttggatgcgctgtctcaggtggagaaggctacatatgccgcagcatattcgcgcaagcttgaagatgcaaaagcctttgcggaggcacatggtgtctccctctggtttgattccctcgatgatctggcagaatcggatgaggtagacgccgtctacatcgcgacgccgaacgggctgcatgccaaacaggcaaaacagatgattgaagctggcaagcacgttctggtggagaagtcctttgcggcaaaccagaagctcggacaggagctcattgaccttgcccgtgaaaagcatgtcgtggcccttgaagcggcacgcaacacctttggcccaggaccggagaagctccaggagctgatcgagcgtgtgggaactccgagaaagggcaccatccgcttctcgaagattacctcacgtattgcaaagctgaaggcgggggagcgtgtcaacatcttcgatccgtacatggcagcaggctcactgatggatatcggcgtttatccacttgaagaggtgatgcagctcttcggtaagcctgaatcagtcaaagcgagtgcgcttacccacaaggtggagccaaaatgcgacaacgatccgtatacactgattgatcttgcgggagaggcgatcctaacctatccgttattccttattgatatttcctacggcaaggtgtccaacgattatctctcctcacagcttgaaggcgatgccggtacgcttttgtgggatgaggcatcattgccgtacaagttccgctttatcccatatgtgagctccggtgaggccttcggtagccggggtaacggtaaagctgaagatattaatctcgaggcaccaaagaacgatatggtctttgaagtacaggtctttgccaacgcagtactgggtgacaaagagaacgataagacagtgtttgagcaccagcagaacacgctcaatgtgcttgcagtatctgatgagatccgcagacagatcggtgttaagttcccacaagacgacgagtaacgctaacgatggaactttgatttgactgtcagggcaatgtgtgctttcggtgtagtaccgctcttgatctcaaggatcgctgggagatgctcttccagcataatgagggagagtgccagtgcggcaagcagcgaaagcacgtctgtgccccggatgagcaggataatgagataggagacaggaatcaccagagccccgacgcagaggtattcagaaccgagcaccgtggcaaagccgataaggctggcgatagttccccacacggggtcagagaagatgatcgtcgaacaggttgttgtgacccctttgccacccttgaagtggtgccaaatcgggaagttgtggccacaggtcacgcctaagccggatactagcatcagaggaagcgtgtggccgaagaaaatccaggtgagggacataccgagcacaaacttcaggatgtctcccgcaagtacgacgagggcccattttgtgcctagttcatgccccacgtttgccatgcctggattgccaacgcctacgtcgaagacgctcttgtgaaccacgtgacggcagacaacatcagcggtaaggaagttaccgcaggcataaccgatcaagagtgcaatcacgtattgcatggctactccttttgtataacagcttgacacacccggcaataggtggaatgagctcattttactatacgcggcagaacaaagccgccggaggaccttcttcctcgagcagcctcccctcgaacgactcctcgtctgagaacctctccaaaaagccccccatcaatgcttttgctctcgcattcgcgcctactcgagcacctgcagcccttcgccagctcttctttgcctctcggatgtattaaccttggatcctattgttacggttgaagacacaggaaactcctgcggttatggcggagggtcctcagtcattttagagctagggcgtttgttgtgggcccggagctcggctaggcagcgtagcctgttgccctctccttgctcctctttcagtcgcgttccggtccttccgctgcgctcgtccccttcagctttcctcggccctgtcctcccagggaagcgcaggctgcagggtcgggcccagcgccagcatgatcagcgctcagagggttgtcagtgtggacaaaatcgtatccgctggctatatggtgaccttgatcttgttgtgttactctcgacgcgccgtctgccggttttcgagattcatggcggctatcacggcgcaacgactgagaatcacttctatcgacgcgacgacgggcgcgacctgcagtagcggtgggccttaagacagctgtcgtgagcccttgtgctaatgcgcatcctttgcgcggaaaaaagatggccctcaagatcctccttgagcgtcccctgcacgtgcaagaggccctctgcgagctcaaatataagagacgataccttgccgagcgcttcaggtcctcagaggtctcgcgagcgcatagctgtccccttgatgcgaaggcctcagccgatgaggctgagcgctacgcctgccatgagaacagggaagtgccagcgcatctggcttctgacccgcgccctaggctgccggtctgctggcgcgcgcctgccattcgtcgcgcctcactgtcgagcgccttcgtttatccattcgacacagggagggtccagaccaatcttgaatgggggcagcgctttcctgaccagctcttcgatccattcgctggtctgccgttgacacgacctcgattcggctttttctgctcgtctgttcttgtgaggctctgtcagcgcgtccaggaaccaagagcgacagaaaatccttgttgatccctaatgtgacccagaagaggaatcccacatcatggtcgacaacgagcgttgaggtatctgtagcccttcttgtagtcgtatcgtcttatgcctttgtgcctcaggccgtcga

SEQ ID NO: 347 - DNA, 3042 bp, Unknown
  Metagenome-assembled genome
gggcgcatcgcgatgcagcgctcggaccttgccgcaagcgacgctagcatcctagcatctagtgtgctgtatggtcgtgatcgctcgactgcgagctttcagggcgcaggcacagcaagggcagccagcagcgcacaggcaagctgcgcatcacccatgacatctcgaagcagcttccagcaggagccggatagacgactgggagggcgataccgtggtagggaggtacctgccttatcacccaggtggaccaggtggatcgcatgagcggatatcttgccagcggcaaggcggccaggaaggccagggccgaggtcaacgaagccacgaagaaggcgcttgccggcgaggtcgtgctgaccgtcacgctcgacaggggcaaggagttcttagaggcagaagggctgcagcaggcgctgggggctcccgtatgcttctgccctccccaccatctttgggagagggggaccaacgagaacgccaacgggcttctcagggactgattttcgaagggcaagagcctagacgatgtcaccgacgaagtgcagagggtatacgattcgctcaaccaaagaccgcgcaagcgcctgaaatggaagtgtccctgggaggtctaccatcaccagtcgttgcacttgctctgaggattcgccataaaaagtcattgaatggtatctgttttgaagatttcttgtatggacacactggtccgcctcgctttaaacagggtgggatgtcaggctcctgcgaaaaaaatgagattacctcttgtattaaaggtatatctcgttaataatccggtctttgacacttaaccctacatagcttgcacataagggctggtagagatagctatttgatatccttgccagcctccttctttgtggtaatcgggcccttccggtgggtcttcctgacgatcttgttcatctgccgcacaggaacgatctcgaagtcggtcctgaagccgaaggcatcatggagcgcatcggttacctcggtcctcatgtagagggggcgccagccctcgcctgtaacctcctccatctgcatgcctcttaaggtgtcgacgatcacagggcagctgaacctgccgcccagcctcttctcgaggatccggtagatgagaagcgccaaaaagcaggtgaggaagtgggcctcgatgcggtccctgcgcgagaggaagacgggacgggcctcaaactcgcccttcatgatgcggaagcactcctcgacctgccagcgtccggcggcgagcttcacgatgcccaggacatcctcgtcgtcgagcgaggtagccaggccgtagaagccgtcccaggaggcctcctcctcgaccttcctatcgtcgatggagaggatgcacctctcggcgacttcgccctcctcggtcacggaggtggaggagacgaagcgcatggggtccttgagccccttgcgctgcctcttggccgtcccgtcctcacaggccctgcgcgcccgctccacctgcgccttcctgatggagctctggtaggcgcggtacctgagggagaaggtgacgatcaggttctgccccagctcctctccggtcgcagggtccttcagggacgtccacatcgtcttgtagaaggtcttagcgaagagggcccggcgcgtcttctcgggcgtgagggggtccactgccgccttccggacctggtcgaggtcgaacgtgcccgcctcgcctgtgcacgaccagcccttagggccgcgcacccagtccttgacctccttcctctggcccctgaggcagaccgtggtgacgaactggaggctgcctttgctgttgtgggcgcggttggccacactcgagagaccggcatccgtgcagacgatgaacttgggagaggccgccctcgccttcgagcctctcctcctaagggatgagggtgggctgctcggactcgttgcctgggtagaggtcaaaggccacgggaaggccgtctttgtccatcatgagccccatgccacagatcggttaggccggtgctccttggaggggccataccttctgaagtcgtcctcctcgctgatctcgaagtagtagttcgtgcagtcatagtacatcgtcttcaggcggcggctgagcatcttcctgctgttctcgaagaccctcctttggatctccccggaatgctttgcaaggaccgagagggcccggtagacctgatgggcatcgaaggcaggctgctcgaggagctccttggcgaattcggaggtggcccttttggatgagggctcgaggatccgtccatacacgagcctggagagtatcgagtccaggtcgtatcccgccctgctccgggaggcgatgtcccggcagatcccgtccagtccgagtgcggagtagatgtcctgcaggaagaggtagcccacgttggaggcgcgcctctcgtccggagctatctgcctcgcagggtcataggacaccgtgaccttgcgggtgagcccgcgctcctgctctgtcatccgccttgcctcttccctggcccagcccatcacgtccgtgcccggggggagcatcccctcaatctcggatctagtgcccagtctccttacgatctttgaggtggatctgccggttctcctgtcccgataggtcttggctatatagaaggtctcgttggtcttggtccttgttagctgaaccttcatatctttacccaatccacatgcaactgacaccaaatactacagatacgtctaccataaaccgacgtataagaaaagccacaaatcccaggtagatccagaaatttgtggcttgaattagttcgatgattgtcggctaagtgtcaaagtcccgcatctttgggagagggggaccaacgagaacgccaacgggcttctcagggactgattttcgaagggcaagagcctagacgatgtcaccgacgaagtgcagagggtatacgattcgctcaaccaaagaccgcgcaagcgcctgaaatggaagtgtccctgggaggtctaccatcaccagtcgttgcacttgctctgaggattcgccataaaaagtca

SEQ ID NO: 348 - DNA, 37036 bp, Unknown
  Metagenome-assembled genome
acctgtacagtaaggcacgggcccgatccggccgcttcggctgcctcttccgccgtgcagcctcttgtctcgagcgcctcgacgccagcctgcttcttcccgacgctgaacgatcttgccgctgccgtcttgcgctccacaggcgcgagctcgtcgatccagccgacaaggacctgagagcatcctgggtagccaagctcacggtgggtgaaggattgtatctgtcatgggagagatagtgctttacagcggagcgcttctgccaggctgcctttgcctgcctcccattccttataccatgccacaagttggacgcggctcggatatcccagctcgcgtagtgtggcgcctaccttgcctcgacctgacatagggctcgaccgctcttgtcctctcttggaggtgtacatctgtcctccagactagctactcggtacggatttccgttaccaccccgtctgtgctaatagaatcgtcccccgtatctgcggtcataaacgattcattacgattgtttgccgttgtgctcttttgggttgctcccgtctcagtcttctgtgagttgtttgtcatcttctatataggtgcagtcactcggattctctttgatgatctgtcgcaaacgggtgatgtagcgcttgaggatctccgagggtttacggtcacggcggataatgtagccgacccgcatggtaggggcatccaccaaaggaatcgagacgatgcctgactgcatctcgttggagagcacgccggttgagagggtatagccgtcaaagtgcgtaagcaggctcgttaaggtcccccggtcagagtaacgaatcgtcttcttgtgtgggagctgggctaagggttcctccgcatagtagaaggagttctggttgccctgctcgaaggaatagcggggatagctctcgagatccctcggtttgatcagcttcttggaagccaaaggatgctgctcacccacaaagacgtgcacatctgcatcgaagagcgggtggaaatcgcactgcgcatcctggaaggctttggtgagcacaagcttgttgaagtcatcgaggaagaggatgccgatctcggcgcggaagtcgcgcacgtcggagatgatctggccggtcgcggtttcccgcatcaccatatcgtaatcgtcctgcttgcactccctcactacgtccacaaaggcctggacagagaaggcgtagtgctgggctgaaactgcaaggtgtacattgggggtagagcctggagtaaggcggcggatcagcatgtctgcctgctcgaccacctgccgggcatagcccaaaagctcagtcccttcagatgtcaggtgtacaccgcggttagaacgggtaaagatctgtatagagaattcttcttcgagatcatggattgcggtcgagacattggattggacggtgtagagattgtgagcggcagcgttgatggagccgcattccgctacttcaatcaggtagcgcagctgttgtatggtcatcgatctatagctttcttcgtgcaggtttgacgatacatagggttatgtattagactactactgctaaagtttaatcgtagaaggaagtggggtggagttgtttcgccccgcttcctttgttatgtagtgcaaaaaggaggggagtatatgctgaccagtcctcaggagcaaaggatcatcgatgctctcgagccagaggctcacgcccatgggattgatattgtcgatgtctcgatcgtaggttccaaaggggctccgatcgtggatatcaggatcgaccacgccgatgaggctacgccgacgatcacactcgacgagataagcgcccaaagcgattggatcaacactgtgatcgatgcgctagatcccttcccaagctcctacacgcttgagatctcttcgccgggcatggagcgccccctgcgcaccccgcatgactttgagcggtttgccggcaagcaggttgcgatccagaccacgaacactgaaggtcgcaggcgctggagcggcacactcaaaggtttcgtggatgagcacgtggtgatcgtaagcgacgagggtgagaagtcattcacgctcgaggagctcaaaagctgcaccatcaaacccgacttcgacgcacacaaaggcaaaaaagattcgaataccaagaagaacaagaagagatagctgaaggggaggcaagcgctatggcgtctgaaatgatggaagcgctgagcgagctgtgcgaagagaagcacctcgatcagttggaactattggataatctggaaaaatcgttagcgaagagctacacggacatcatgcacctcgactggggcgcccgcgtcacaatcgacaagcagacgggtaagatctacgtctacaagcttgagccgatcgatgactcctggaacgatgagacgggtgagttcgaggacttcgaggagatcgacgtcacgccgaaggatacgagccgctttgcggcgcagcaggccaaggcggagatcaacaacatggtgagaaagcgggctcgcgaggacatctacgaggagttctccggacgaatcggtgacattatcaccggcaccgtgatccagaccaccccgagcttcacgatcgtcaagatccgtgacggggttgaggcggagctgccgtacttcgacacccgccggttcccgggcgagcgcaacgagcgcccgtttggggagcactatgcgcacaaccagcgtatcaaggcgatcatcgtcgacgtgcgtgacccgaactcgacgcagccacccgttcgcggtgagcgtcagcgtccacccattgtcatctcccgtacgcaccccaatctgatcgcaaagctctttgagcttgaagtgccggaggtctacgagaagaccgttgtcgtgaactcagttgcgcgtgacccgggcatccgctcaaaggtcgcagtctcgagcaacgatgaatatctggacgctgtgggcgcctgcgtgggaccccaaggcagccgtgtgcgcgcggtggtctctgaactcaggggcgagcgcgtcgatgtggtcctgtgggacgacgatccagccaagcgcgtcgccaatgccctgtcaccggccaaagtgtcaaaggcacttgttgatccgaatccggactccaactactgcacggtgatcgttccagatgaccagctttcgctcgctatcggcaaagaagggcagaatgcccgcctagctgcacggctcaccggctaccacattgatatcaagaatgagaccctcgctaagaacatcatcgccgaagcgcacgcaaagcagcatgaggaagcgccgacactgacagacgaagaggcagacaccgagaaggcccaccgttgtgagtatgtggggcccaatggtgtcagatgccgcaacatggcgcgccccggctctcgctactgcgggattcacgagaagctgatgaacgccgaggtatcggatgaccctgactcgctgatctaaggggtgtgggtagcagatcatttggtaccatcttgaataggctaagaaaggtgttttaatggcaaaaacccgtgtgcacgatttagcaaaagagttcggtatgaccagcaaggagatgctggcttacctgaagaaggagaagattcccgccaagtctgcttcctccacactccaagatgtctacgtgaaccttgtccgcaagaagctgaagccggtcgctgaggcccatgcgaaggagattgcggcggaaaagaaggaggagaagcaggtagaagctgccaaagaggcagaggaaaagaagagggctgaggctgagcgcatcgctgccgagaagcgccgtgcccacgagcgcgcgatcgagaagaagcgcaaggagcaggccgccaagaagaaggccgaggaagagcgcgtcgccgaggagaaggcgaaagccgaagaggccaagaagaaggccgaggataatgctccgaagtctatcccgtccttcacgagcctgcttgaccagatcgcccagcaggaaaaggtcctggagaagaagcaggaggagaaggccaaggagtcccaggagcacgagcgttcgaacggtaggcaccgttcgacccgctctgagcgctcagagcgcaatgaccgcggcaacaaccgcggcgggcgcaacaacgaggagcgcaatgatcactcccgctcaagaggtcgtcagggcttctcgatggacgagatccgccgccaggccaacgcgacgccctacagcaacgacgagcgtccgggcagccgtggcgagagcagacgtcgctccaagcgcaataagcgccgcaacaacgacgagagtgaagatcgctacgcacgtatggcacgcgctgcggaggagtacaaccgcgagcacgtcctcgaggaggcccgtgaggccgtggaggaagctacgcgtgagtccaccggccgccgtaagcgccgtaaggagcgccgcgtcaagcagaagaaggaggctgagaaggagaagaagatcgaagaggccaggaagaacgaccaggacctctctcagatcgacacgatcaaggtgccttccggtgcgaccgtcgctcagcttgccgacctcctgaaggtccctgccaacgatattatcaagcgcctgttcctgttggggacgccgctgacgatgacgcaaagtatgacggacgatcagatcgaactgatcgccgacgacttgggccgcgatgtgaaggtcatgacgaaagaggaggagaactccttcaccttctacgacgatccgaaggatctgaaacccagaccgcccgtggtcaccgtgatgggccacgtcgaccacggcaagacctcgcttttggatgcgatccgccacaccggcgtcgctgaggaggaggctggcggcatcacacaggcgatcggggcttcacaggtcaagattcacggccgtactatcaccttcatcgataccccgggccatgcaacctttaccgcaatgcgtgcccgtggcgcgaaggtcaccgatatcgttattctgatcgtcgctgccgacgacggcgtgatgccccagaccattgagtccatccaccacgcacaggccgccaaggtgccgatcatcgtcgcagtcaacaagatcgataagccgggcgcagacccgcagcgggtccgccagcagctcaccgagtatgggctcgtaccagaagagtggggcggcgatacgatgttctgcgacatctctgcaaagaagcgcatcggcattgacaacctgctcgagtccatcctgcttgaggcggatgtcctcgagctcaaagccaacccagataccttcgcctccggctatgtgctcgaggcaaagctcgataagggccgtggctccgtcgcaaccctcttgatcaaccgcggcaccctgcatgtgggtgactacatggtcgcaggcttggcctacggccgcgtccgcgcgatgctcgaccaacacggcaagccgctcaaagctgcgatgccttctgacccagttgaggtgttgggcctgcagcaggtaccggacgccggtgacgagttccgcatcttcgacgatgagcgcgatgcacgtggcttggctgagcagcgtcagctcaaggcccgtatcgaagagcagaacaaggcaaagcacgtcacccttgagaacctcttcgacacgatggaagagtccgaggtgaaggaactcaacctgatcgtgaaggctgacgtccagggctccattgaggcactggttgacggcctctctaagctcgatcagtctgaggtgcgcatcaacgtgatccactccgcggtcggcgcgatcaacgagaccgatgtgttgctggctgacgcctccaacgcgatcatcatcggcttcggtgtccgcccagatgcgaaggcgcgccaggcagctgagaaggccggcgtcgagatccgtacctacaaggtcatctatcaggccctcgaggatatcgacaaggcccgcatcggtatgctgaaaccgaccgagaaggaaatccagactgcaacgatcgaagtccgtcagacctataaggtcccgaaggtcggtgtcgctgcaggctgcatggtacaggaaggtgaggtcgctgccactgaccaagttcgtttagtgagagatggcatcgtggtgtatgatggcacgatcgcatcccttcgtcggtataaggatgaggtcaagagcgtcaaggccggcttcgaatgcggtatctcgctccaggacttccaggacatccatatcggcgatacactcgagagttacaagatcgtggaagtcaaatgcagcaagtaggtttgtatgaagcagaacagaaattctcgccgtatcaacgagcaggcgcgcgagaagttggcaaatattctgttgcttgatatcgccgaccctgacctcgcgctcgtcacggtgacgggcgctgaggtcgcgaccgacaagtccttcatgcgcgtgtatgtaagttgcgccgctgaccgctatgagagggttatggcagcgcttagccgcgcaaagggaagaatccgtacgctcttcagtcactccgtcaactggagacggaccccagagatcgaattcgtgatcgatacctcagcagatcaagcggaagaaattgctcgtgccctcaagaacatacccccgaccctgagcgttgagaaggatgaggatgggtaccccattgaggagagctcgtcttctgacgatgaatagggacattgtggaagaagtactcgaagcacagaaagtggctttcgctcagataacctccgctatcgagcaggcccagaccatcgcaatctgtgcccataccagcccggatggggatgcaatcggctcagggttagctttagcggcgatcctcagacagaaatatccccagaaagcagtcaccaacctgttggctgaccccgatccggtgcccaggatctatcagtttttgccgggaacggatcagatgaagcatgcggatgagtatcaggagaaccctgatctctttatcagcgtcgatctaccctgcgccaagcgtctggcgcaggcggaagcggtctttgaccgctcaaagcactcggtggagtttgatcaccatcctgcagacgagccgtttgcggagtatcactgcatccgcccggatgcggcagcaaccggcgtggtgattgcggagttcggccaatatctgggcatcacatttacttctgaggtcgccaatgatctcttttgcgcgattatgaccgataccggccggtttcagtaccaaaacaccaaccctgaggtctttgatatcgcctcactcttggtcgataatggggcagaccccgccgatgtttccctgcatgtctaccagagcttcaggcttgagtacctgcacctggagtcgatcgtcttaggccgtatcgtgacttttttgaacgggaggatcgcgtactcctatgccaccgcggatgatctgaagcgcaccggcgctcacctcgatgagtgtgatgggctgattgatgcggtgaggaccgtcgacggggcagaggtagcgctcttcctgaaggagctgcctgacggcaaaggggtacggggcaatctgcgctccaaaggtagcctcgatatctcagtcgttgcgcgtgagctcggcggaggtgggcacagagctgctgcgggcttcacggtggatggagacctcgatgaggcgctctctgcctgcctgccgcgcctgaaggcactgatgacgaacgatgccttttccgctcgtacaggcggtgtaagtgagtgaaacgggaacaaaatggattgaatcttctgcttgccgttgacaagccggagggcatatcctcgcacgatgtggtgaacgccgtgcgcagaagcctgggggagcggcgtgtcggccatgccggaacgttggatcctttagcctcgggccttatgatcgtgggcgtcggacaggcgacccgactgatgggcctgattaccgcaaccacaaagacctatatcgcgcagatcaagtttggcagcgctacttcaaccgatgatcgggaaggtgaggttatccggactgctcgggtacctgaggtactgaataaaactgcctttgcgcgacaggtgttagcaaatcttaagggaacacacgaacaggttccaccggcgtattccgccatctcagtcaacgggaagcgcgcctatgcgttggcccgcgaaggcaaacaggttgagctgagaccccgcacgatagagatcatcgatgcaaagctgctctcattggagcccgatgagagagggcccttttgggactgtctcttcacagtctcaaaagggacctatatccgcagcatcgcacgtgatctgggggagagtctcaataccgcagcttgcctcagtggcctcagacgcacgtcagtcggtccaatcacgctgcgggatgctcacactttgaaagatatcgaacaggcaggtgccctcagaatcgaaagcttcgccctcgacccggtcagcgcactacaggtacctgccgtggagctttcagaccaacagatcgagtatctgttacagggtaaggcacctcagatagatactgctgttgctgacggtagccgtatcgcctttgccggaaagcataagctgtggggcgtgtgggaatgcaaagggacttcattgaagtgtgtagcaaactttatgcagggaatcgtaggtgtggcatgaaccaagatacgttgccaaaaagcctactaggctaccccttgccgctgagtgctcaggcacaacacgagctcgtgcgaagctccctgtttggctcggagacgcttccaacctgtgaaaagcacgagtcagttatgctctacgcgtctgacctttcaatctttaatattccttgtgtatgcgccatcggggcctttgacggacttcataaaggacaccgagcgttgattgcgggtgcccgtaccgatgcacagaaacgtaatcttccctgtatcaccgtgatgtttgatccggacccctctgaggttctggaccctcaacgtcccgaaccacggcttctctcagttaccgacagaatcaggggcctccttgacctcggtgtagacggagtagtcctggtgagcttcactgctgaactggcggcgcagaccccggcggcgtttgtcgatcaccttcatcaacagctccagccggtagcgctccatgtgggagccaacttcagcttcggccagtatggcaaaggcaccgttgggacgctgcgtgagttggaggcgccgaagaatgtctcagtggtggtccaaccactcttgcaggagcagggccacactgttagtgctacgacgatccgtaccttattggcacagggagacctgagcagtgcggaaggactgctcagtcgctgccacttcattcggggtcatgtggtgcatggacgcggtgaaggcaggtcgatgggtttcccgaccgccaatgtcgtctgtgagccgctgagcgcactgccaaaagcaggggtgatcggaggctatgtcgtatccgacgaaggatgttgggcgtccgcgatcaatgtcggggcaccagtgagcttcacggacaaagctatgccgctctttctggaagccaaccttctcaatttctcgggggatctctacggaaaagaggtggcagttctcttctgcgtgtggctgcgcgcggagaggaaattccaggatatccgggaacttgagcgtgcggttcaaggcaatatttcctgggtacaaaacaacttagtctgttcatagtggggaggtctgacgttgattactgatgaagacaaagaacgcgtccggcaagcaacggatttcctttccctcgtgagtgaaacggtcgtcctcaaacagcgagggcaggacttctggggatgctgccccttccaccacgagaagaccccctcatttaagatcaaccctacgaccggcctgtggcactgctttggctgcggcgccggtggggatatgttcacctacgtaatgaagcgcgaaaacctctcatttcccgatgcgatccgctatctggcagatcgggcgggaattgaactcaaggaggagcagaacgtccaccatggcccgaaacgcagccgcctgctggagtgcctcgcggaaaccgaacgattctacgagatgatgctcttccgcggcaaaggggaaggaccagctgctgcccgtaaatactttgcgagccgtggcttcaattccccggtgtgcaagcgctggaacttaggctacgccccgggacactctgccctggtgcgtgacctcaaagcaaagggcttcacgacaccggagatggtaaaggcggacgtggcacgcgagcgtaacggacacgtgtatgaccgcttctttgaccgagtaatgttcccgatccacgacgagcaggggagaaccatcgccttcggcggcagaatcctgcaggcggcaaagcacgacgggatcgccaagtatatcaataccggcgataccccggtcttcaacaagcgcaagcacctctttgcgatcgataaagctcgtgacaccattgtcaaaacctctacggcgatcgtctgcgagggttacaccgacgtgattgcaatgcacgaagcgggctttactgatgtagttgcggcattgggcaccgctttctccctcgatcacatcaaggcactggaacgtctccgggtgcagaagatcatctgcatgttcgacggtgacgctgctgggcagcgggccgcagagcgtgcgatccaatacatcgataagaccaccgcagacctcgtctgcgtcgtgctgccgaacgggcaggaccccaaggagttcctctcctcgcataccgctgaggagatgcagcgtgagctcgacggggcacagccgctcatgagcttcgtgttccagaagcgccttcaaggctacaacctgagcattccggggcagcgcgtcaaagccctcgacgatatggcgacgcttttgtccccactcaagaactctccgctcctcgatggatacgccaatgatctggcggacgccttgggaatggatacgaaggaaaccaagcgccacattcagatgaagccggcgccaaaacaggataactaccagcagtggcagcagagaccgaaacatccgccgcttcctgcgaatgggccactctacgaggatgcggactactaccaggaagatgagtatgaggaacccgcgattgaggtgacacagacggtcgagcaaaacactatgcgcgctctctctgcggatgatcgccaacagatcgctgcagagcgggaattgctcgcgatgatcgcgcagcggcctgatctagcccgtgcctatgcggacacaattggtgatttcagctgggcggatgagcgcaaccaaaagctcgcttgggcgatgcttgcgactcctgaaggctccacgccacaacaggtggtggacgccgcggaagcggtagatccccaggcaccaaagatcctctcgggcggctcaatcgccgcgcaagaaggttgggacagtgaaaccaagatgggctttctggtcaatagctgcgatctgtactccgtcaaacggcagcttcggcagatccgctcgcaactgagacggacacaggataacctcacggacgcgaccaggaatctcatgaaccgggcgcagcagctgtcgcagcgggaatcggagatttctcagcaacttttgaagactcaacagtctcagtaagcgatattcgggtataaaattaaagttctgtctaaagggaaggaactacgtggctacgaagaaatctaaagaagatatccagttgtcagatgaactttctcaggttgtcgacaacttagtcgcccaggcaaataagaacgacaacacaatcagtgaagacgatattcagattgcaacccgcgatatcgatgtggacagcgatgagctgtctgatctgtatgacgtattgcgctccaaaggtgttgatattaccgctgacgagtccgaggtgccttctgatgaggatactgatgaggaggaggacgaggaggaagaggaggacgagctcgaagatgaggagagcgcggaggaagccaatcgccataaggaagccaaacaggtaaatgccgccctgcgtgcgaccgcaccgaaaggcaagaccaaaaagaagcgttcgaccagaagccgtaaccgcaggactgactcttcaaccgtgatgctcaccggcgatccggtccgtatgtacttgaaggaaatcggtaaggttgatcttttgaccgccgacgaagaggtccatctggccatgaagatcgaggcgggcactgatgcaaccgagaagctcgaggctgcagaggacggcgatatcgagctgacccgtaccgagcagcgccgcctgatgcgcattgagcaggtcggccttgaagcgaagcaacagctgatcagcgcaaacctgcgtctggttgtttcaatcgctaagcgctacgtcggccgtggcatgctcttcttggatctgattcaggaaggcaacttgggcttgatccgtgccgttgagaaattcgactacaccaagggcttcaagttctctacctatgcaacctggtggatccgtcaggcaattacgcgtgctatcgcagaccaagcccgtacgatccgtattccggttcacatggtcgagacgatcaacaaactcgtccgtgtccagcgtcagcttctgcaggagctggggcgcgatcctacgccggaggaaatcggcgaagagatgggcatgaccgctgaccgtgtccgtgagattcagaagatctctcaggagccggtatcccttgagacgccaatcggtgaggaagaggactcccagctcggtgacttcatcgaggattccggagcagtcgcacctcctgtggctgcaagtgattcgatgctgcgtgagcagctcgatcaggtgctcgatgggcttgccgaccgtgagcgcaaagtcatcaagcttcgctttggcctggaagatgggcacccgcgtacgctcgaagaagttggtcgtgaattcggcgtcacccgtgagcgtatccgtcagatcgagagcaagacgttggcaaagcttcgtcacccctctcgctccggccgcctgaaggactatatggaggagtagtgattactcgttcactctactggtgacacaaagcgtggggctgtcgttgaaagcagtcccacgcttttttacgttataggcgatgccattagtgtgataaggggcaacgctctctagatcttgagattcacgttgtaggtgctcttggcccaggaagcaaacgtatcagcgtccccatcgtagtgataggacttcatacccgctgcctcagcgcctgcgcagttgtcagcgttgtcgtctacgaagatgcagctgacaggatcaagctggtagcgcttgcacagtgtcgtatagatcaggggatcgggtttcatcatatgctcaaaggcggagaccacaaagccgtccattaccttcatggatgggatacggtccttctggcgccaccagcgtactccggcgttggagagcagatagcagccgcaacctgcgtcgtgcagcgctacgactacatcgttcatgtgttgcaggaccggctgatgctgttcccactccaggaagcccttgtgcatcggcttccacaggcgctcagggaccttggtgcgcgccagagcctccatcgtgtgctctgagatgactccggcatcgaggagcggccaggagggggatttatagagggcggcttcaatcagtctggtgtcatccggtgagtcgacgtataagttcgagaacagcctggtatcgaacttcatgaggacgccacccatatcgaagacaaagttgaatttatctgaagaggttttttgagaatctgtggccatatgcaatccgctttctcatcgagaggtttatacaattcatagtagcgttgtccgcaatggatacagtgattttttttcaagtggaccccacatttcgcacatcacaactccaaatcccaaataagcatgatttgagtagggtgaattaacattttgagtgcgacagggatagcgacagggcagaggttgttttttttttgttttttcttttatgggcaatccgaaggacactcccaaggcggcgatgttggtgtctaaagtcatcatcgaacgtcggagggggaaatgcattcactacactcatcttagcgacgctgagcacaaacaagattcgcaaagatcacgtcaggactactcacccgcagacatcgcaaaggaatcagaaaagatagctccaacgcaagacgcagcttgaaaggaacagaccacaggagaggcatttgggacgtgctgtgccctttgcaagctctgtgagcccggcttgacggtatgggctatcttgggctgttaattgtcacctttgattgtacctccctgctgcttcttatggtttcagcgatacaacgtaggcttgtgccacccttctactatgggataggtgtcacgattaattttgttgagcctctcttcctactgagccccccaatcgtttcttggtacacacctctctctttccttctccccccccagagcattcgtggggcagcaatctcttggtacgccgcttcgtgttgagctttggcggacccactaggcgcgcgaatctggtgtgccctggactctccccgcacccagccaaacgagcgactggaaagggaagcaccccaaaaaaagggggcagatctaggtctcagaagctcagaaaagctgaagggaggtctctctgcgcgcttgctgttgggtaaggagcaaacagaactgtcgtgggacccaacctctggtgcctgtggtcctgcccagagtgctccctttttgtagctgctcgtgggcagcaagggagtgtgcacctacccagctcagcgctcccttggaggggtttgcttcaaggacgatggacgcctggttgcgccaagcagctctcccggcagggctaaggtcagcaaaaaagccctgggaggggctaacagggcggcaaacgaggtctttaggagaagatggggcactcagcttgacaaattcgccatggttttgtcatcagtatgggaggacgcatcagaccaaaccaatttagagtgccgtcaccaaaaatagtgctcatacagtaggcaagactagttggttctagcttgcatgtccccgttgccaggggacagcttccaggtctcgcatcggttctcccgaaacgcctggttcgcgtttaatcggatcggcctagagtcaaccgcgcgggcggcgcccggaggcggacctacggcgcgcgttgcgtttagcgtcgccgggcacgcccggcgaagagtagtatgtgattgccgcgttcaaatccctgtgatggtacaggtcagcattcctcgcatcggttacggcgcttgacaggggcagctgtgcttttcatgacgctcgccgagaacgttcttgcgctgggaagaagcaactccaccaccgcccacctggacgcgttgcgctccgaattgctatattcgagctgccggcggaactcgccgaaggaggcttcggcgacgcctggcgaggtggtggttgcgcatcatcccggacacggtcagacctcgatcgccaccaaggccggtacgtccgaacgagaccggcggtgagcgtgttgcgtagcatacggagacgcgagtcggctatgcgcgcgttcgcccgcgcaccttgaggcgcgcgcgccgcgcctcgcgatcacttgcgcttgcgcgagaagctcccgcttgggctcgtttgagccccactgaggcgggtgtgtacgcgttgcggggttcggcacggaccggccgtaggacaacgtggcgagctcctgtcgacgccgaccgacggtctgccccgaacgggggccgggacgccacccggcctctcgaccgaaagcgaggcgtaccaccgtcccgccccctccgggagatcgtcatgcgcgtgaccttcgcgtcgccgacgcgccgcgcgacgtcctcgaagcagtggacgcgcccgacgcgcgggagcttgagcgccttggggtcgccgtcgatcgggccgaaggagcctgtggtgtacgagtaggagggcgcagccccgtccttggtcttgaaccttgggaagcccgcgcgccgccccttgcgctcgcccgccttggacgcggagtagttcttgagggcgcggccgagtgattccaggccggcgttgtaggcctctttgctgttctcgcgccaccagggggcaagcccgtccttgccggcgttccaccacctgcgcagggagtaataggaccaatcgggcctctttccggcctcgatctgggatttcacgtgagcgagggccgcgttgtacgcgaaccgcgcagcgccggcgtgggacagcagcgccctctcctggcgcggcgtggggtcgagggccaccttcatggcctcaagcatcgtcggccgccttcatggccgcctgggccttgtgcttggccacccgccttccgtagagccgggcgcagaaggacgtgagcacctcggtcatgtcgcgcaccaggtcgtcgtcgagctcggtgtcgtccaccaccacgacgcggcggccctgcgccgaaagggcgctctcgatcaggcccgcgttcatccgcgccaggcggtcgcggtgctcgacgatgatcgtccccacggtcgggtccgcgagaaggcggttcagcttgcgcctgcgctcgttcatgccgcttccggtctccttgacgacctcggggtgctcgactcccatgccgattgcgaacgccttgagtcggtccgcctgcctctgcaggtcgtccttttggtcgcccgacgagacgcgggcgtagcagaccgtcctacccgacggggctttcgcttcgttcctctcgtatttggggtcgtgtatgaggatgatccccgtcgaggtcttctcgaagggcacgggcattcgcccctcacggcaccacttccataccgtctggacattcaatccttctctttttgcccattcgcttgctctcatggataaatcataccatacgataacaagctattacaatcatttacctatactgctggtagcccccctgtctaatgccgctggtactgatctgtaggccgcagggtagttttccacagcagcgcgtacccagtgagaccaaattgggtctaaaggcatacacagaaaaagtgcatgaacagggcacgaagccccattcatgcacctcaaggtacaaaaataatttttatataaactctttcagataaaaatacttttcggtaaacgaagggaattacttcccgttttcaccaaatatcaacgaatcgaaggtgtaccaacccggctttttgtccacaagcttgcgtgctgccgtaagggcaccctccgcaaagatcacccggctggaagctcgatgcgtcaacgtcagctcctcgtcggtcccaaagaaatagacctcgtgggtcccggcgacggtaccaccgcgcaagctgtgtatgccgatctcgtccttcgggcgtggccccaccatgccttcacggccgtggaccagatgcttctcccccttggggtcaagcgcgtgtgccagcatcagcgcggtgcctgacggggcatcctgcttctgattgtggtggatctcgacgatctcttcgtcccagtcgccgaggtacttgcccacctcctcgcacatgcgccgcaggactgcgatacccagcgagaagttgccgctccacagcacggcgaccttgtcgctcaagctcttgagctgatctatatccgcatcggtaagaccggtggtgccacagagcacatcggcctgagtgcgtttggtgtagccgataatgccgggaagcatgcccggatgggagaaatccattacgagatcagcggtgggaagggtcttgagatcacccttattctcgatcccgacctgacccacaacctcaaagtcggacgcctcatcgagcaactctttgaccacattccccatttttccggtaccggagagtacaaccttagtcaagaagacccacctcctgcattgcgcgcttgagcttcgcgtgattctcttccttcatcggatagagcggcagacgatagttcggctttaagaagtccatatcagctaatgcctgtttcaccgggatcgggttgacctcacagaagagtgcgtggatcaagtccatgcatctgatctgggtggcgcgggcctcctcgaggttacccgctagaaagttcttgcacatctcgtggacttccttcggcataatgttcgcccatacagagatgacgccacgagcgcctaaggacatgagcggaatcacgaggtcatcgctgccggagaacatgccgaaatctttgttcagacagtgcgcgatatcggagacgtactcaagcgagccggaagcctccttgatcgccagggcattcggatgcttggagaggcgctctacgtttctcacagagatggaacagccggtccttcccgggatgttgtagaggatgcagggcagatcaactgcgtcgagcacggtcttgaagtggcggtacataccctcttcgttggtcttgttgtagtatggagtgatgatcaacaggccgtcgaccccgatctgctgcagggcgagggacttgttgtagctctcacgggtgcagttggagccggcgccgccgataatcggcgccgcaccgttcacgtgctcaaccgcaaactttgcgacagccaggtcctctgcgttcgtcatcgtcgccgattcccctgaggtgccgaggatcaggataccgtccgtaccattgttcacctggaattccaggatcttatcgagtgaggcatagtcaatcgatccgtcatcgttaaacggcgtgacaagtgccacgatagaaccggtcaagttcttcaagtccatggattgccttctttctttaggcccatctatacgcaaaaggtcgtcggcagcatctgtcggcgaccattccattcacaagtcatagcactcctgcatgctgcagacagtctccggcgtctttcgccgaagcccacagatagccggtgccccacctatctgctcggcggattctgcctcccgaaaggatctcagtccgccggttccccgatcgttcatctctccgcgcctctattaaatttataatactcatttttctgccttgcggggtatatatctgtaatggaaatataccggcaatgaaggcctctgttttagacacctgtccgttttatatctttgtgacgcatttttagagttggacatggtttattgggaagtaatttactaggaccttatttatggtagaaaagatccatccgcaccacgaatagctgggatttctttagaaagcatatacataagttaaataatagttatacgccataatgccgtaaaatctggttatatattaaatacgaagagatgaagaacgatgagatataacagcacaacgtctattaaagcagtagcggaagacgtattacatgcaaaagaaattgccaaaaaggcaggcaaaataaaaaagaacagcgacgtgaaagtcaacgaggatgaggccacccagtgcctcgatgcctttgagggcctctactcccagacgattcccctgttacgcgccctttcacagggaagcgcaacagtgctcctctacctcgacacgcaccacaacgatacctctgcggtgaaaattgcagatgaagtcggactgacgcgtccgcgtatcacacagatcatcgacgagttagagagcgacgggctcgctacgcgtgtgaaggattcacatgatgccaggaagatccgtgtcattatcacccgcaaaggcaagaaccgtgtccgttccacccgcaccttcttcctcgatattatgaagaacatgcaggtagtcctgggctctgaggatgcccaggagctgacgaggctcttggacaaggctgtctcggtctttagtggagccgaccccaatcaagaaggccaggaggatcaagagcaggaaagcgagtgatcacactcaggtctctaatgaagagctgtgatttgtcagcgttgcattgaacaatgggcagagcacacgctgtatagaggattgcagttacagcgggaagaacacaagcttctcccgctgttctttattggcacgtcttgacagcgtacaatatcttgcgcactttggcagcagcacacagctagccacaacaatccggattcttaggtaacagcatatagcacatgcgtttgcatcgagggaggaatgcccaatctatcaggcattcctccctctttctgtcttgatttcccgcctttccgccgctgtgatatagctatggtgttagatatgctgtaaggctccatgggaaggtattccgtgccggcaaagatccgcgcgatgaagccgaagggtaccatggtcaaggcgatatcgggccactactacgtctgcgagtactgaagcatacgagagggcaaaaggcgcaggacaaagatgggccgctgcatcggcaggatcaccgaggcggagggctacctcagcaatgcggggacgaaggtcgcaaacagcgagcttgcctgcgtcgagttcggccagtatgcggtcgcgatggactgctcgaagggcacgctcgctctgctcaggaagcatttcgcgcgtgcggacgccgacaggatatatgcctgcgccctcatccacttcgtcgagggcttccagcgcatgggggcgctcgcgaggctctacgagatgagcgtgctctcgctttaggatgcccgggctgaagatgggatacgatgcgctcgccggcctctacgaggacctcggcaggaggcaggggccgctcatctccttcgagcaggccctcgtcgagccgtgctcgggcgaggtggccgtggacggccacgtgataggctcgcgctcccttggcaactcgcttaccgagaaggggtacaggctctaaaagctcggcgagccgcaagtcagcatgcttatggcatatgacgtgcgcaccggcatgccgttgctgtcgcgcatgtataagggaggggatacagacgccgtctttgtgagggagctcttttggcaggcacatcttgcgggcatgctcttcctcgcggacaggggcttcctcagcaaggagaacctggccctcttcacgtcggacggccaaccagtacgtgatcgagctttccaagagtgacaggcgctgcagggcatcggtcgccctcgaggcgaaggagggctcccgggggcgcttcgtctggacgcgctacaggaaggcatgcgtcgtcgagtggcgcgacgacatgcttgcaggcaggcgcgctctgcacttttgcgacctcttacagcaggcgcagatccaggagagctacctcaggcacatggagatgggcacgtccggatacacgcaaggagaagctcgatgcgatgctgccctacatgggcgtgacgctgctgcagacgagcctcggggccggacgctctgcccaggacatatggtcgctctacaagaggcgctggtccatcgagactctcttcgactacttcaagaacggccagggggcggttgccctcggccagcaggactactgccgcgagcagggactggcgttcgtcctgctcgtgagcgccctcatcatgcgggaggtctctgacgccgcgcaggcatcggggctggggatgtctgtcggcgacatcctgctcgatgccaggatggtcaaggcatgcaggcgcttcggaaaatgggaggcgctcaactgcaagaagaagcggctcgagctcttctcgaagatgaacacgggcctggaggtcgtccccaggccgggcagcatacctaaaaatccggattgttgtggctagccagtatatgaagaaaggtaggttcttaccgatcccgttacggtgtgaagtgtcccgtagccatatctagcgaaaggacagtaagagccatacctgatgagtaccacagaaggacttaggcaagcagatcagaaaaagtgttgaggagatgctcgacaacatactcgatgaagaagtagaccagctgcttggggctaaaacgtatgagcgcttcgatgatgagggcaaggtatcgtgccgaccactgtaagcaaagcttacgccacttaggcactgttacgcccacggtgccaaagcctaaaggtgtagggtttgtctctgcggctataggggcgctatagcagaagagaagaatccatcgaggaggcgctggtggatatgtatctgggtggtgtttccaccagaggtgcccaaggcatacccgatgctttgtgggacacagcaggctcctctgctaccctatctagcctgactgaaaagagcgtatgtaggacgacagaagcttgaagaacaagaccgccgatgaggcactacctctgtatgtctttattgatgggatctacgctcctggggaggatccttttgagaatctcgctgttagaccataattgacctaacgcccctgtccttccaatagctccagaagggctgcttcatgtctatgagcgcacgcctggtatggacatacctgcctcctgcaagcttgcctgagagcgtatccttcttctcccgctcagaatgccttgccccagccccacttcgtggaaggacccatgcgaagaaaagcggaaactcgtacacgacttcgctgcatcgcattgacgaggataagaggctaagctcgccgtgcacggccttcttcgccacgctcgctgtgtgcttgaagaccccaagcgaggagagccacgcacgcatatcctgcatggtcgtcggtggcgacccataagctgtcgacgatacctgaaagggcgtctgtcagcttcccgtctgtgggcctgcccctgccgcagaggatggcatattcgtctcctaggtcatacgcgcagcactccacacagaccttcttgttcgatatgccacaggaatgcacaacatggccgtgcgtgtgcgtctccctcagcatctggatgttgggccttgccctgttgcctgtaagcgactcgtcgatgtagatcccgatcttttggcaggagacggtggatccatacctgaaggcgccaagcgctgcctgtatcacctcgaagagcctcatgcgcataaaaccacaatgtccttaaggctcacatggcagctttccgtaagctcctttaagcgtcatgcctgccaagcgtgccctttgcatacgcggcccatgtggcggctgtgggcttggacatagccaggacagatcttgtctttacaaagaaggtcttgcctcacgagcaacacttccatctcttaaggccacacgcgtcgtggcccttgcaatagaagctagccgatttgcacctcgggcacctcttgggtgttcccgcaagtgccgagcctgccatcttcttggctatgagcgccttcagcctctctaagagctcgcgcttctcggcgatccccatctttttgacctgctgcagtatcattggatccatccgggtcctttgatcctcgatgtctttgtttgatgacatgcattgtaggcaaaggctcggacacttttgggcccttctcaggtcaattatggtctaacagcgagctgtgtttttacgctgatttttatacctcacccatcttttgatatgtttctcccctactagggtcgagccactgcatgacggagatctcctggtcccaaagcccaccctacttgttgttgaaatatgaatggtagcatcaatttatttagatgtaatatatattattatatcatttcaatatctctgttacactgttgagatgcaataagcagtgctgcttagggggcggacctatcacatgaatgcacaggattgtttggacgagctcagatcaatcaaggatgtgtccttctcaaccgtcgatgagcaaggtcttccccacagccgcatcatcgacgtcatgatcgtaggagacaacaaactgtacttctgcacggcacgtggcaaagatttctatcagcagcttatgcacaaccctcatgttgcggttgtcgggctcaacaggaattggcagatgatccgtctcacaggtacggttcagcatctcgatgaccaaaagaaatggatcgatcgcatcttcgacgagaatccttcaatgaagaacgtgtatccaaaagacacccgctacatcctcgagccctttgtgatctcctcaggggcgactgagttcttcgatctcgggaaagagcccatccatcgcgagcgtttccccttcggcgacacgaagatccctggatatggttttctgatcaccgacagctgcatcggttgcggcacctgcaggaaaaactgcccccagaactgcattgaggtaggaaaacctttcgtaatccgtcaagaccattgcctgcactgtggctcctgctttgagaagtgcccggtcaaggcgatcgtacgacactgaaagtaggctttgcccatgatccaagacatgttttccctactggtaacccgatgggatttcttctccaacctgctgttggagcacattgagatctccttcattgcaatcgcaatcgcgattgtctttggcggtatcgtcggtatccttatcagcgaatatcagaaatcagccaagtggacactcggagtcatcaacttcgtctacacgatcccctccatctccatgctcggctttttgatccccttctccggtgtcggtgacaccaccgcgatcatcgcgcttacgatctatgcactgctgccaatggtgaggtccacccacaccggactcaccaatgtggatcccgacactatcgaagccgccaaaggcatgggctccacccgctggcagatcctcttccacatcaagctccccttagccatgcccgtcattatgtccggcatcaggaacatggtgacgatgaccattgctctggccggcatcgcttcctttatcggagccggtggcttaggtgttgcaatctatcgcggcatcactaccaataatgcggccatgacgctggcaggatccttgctcaccgcactccttgctttagtgatcgacgcgatcctgggctttgtcgagaaacgcatgcagaagcgctctaagaaagctaagcaccagaacaaagttatgggcttcactgctctgggcgtcgtcggtgccctcgtggccgccgctgtggttccccaacttatgcctcaagccacgatcaatatcgcgacaaaacccatgacggaacagtatatcttgggagagatgctcgatatcctgattgagcaggacaccgatctcaaagtgaacctcacccaaggtgtcggtggcggtacctccaacatcgagcccgctatggagaacggcgagttcgatatgtatccggaatacaccggcaccgcgtggaacatggtcttaaagaaccaggatgtctactccgaagataagttcgatcagctgagagccgcctacaacgatatgggtatgacctggacctcaatgttcggctttggcaacacctacggcttggccgtccgtaacgatattgccaaccaatacgacatcaagacctactcagatctggcacgggtggccccacagctcactttcggcgcggagtacgacttcttcgagcgtgaagacggctacgacgcgctgtgcgacacctacggccttaatttcggcaatacgatggatctggacatcggccttaagtatcaagccttagccgagaaccagatcgacgtgatggtggtcttcacaaccgatgggcaactcgccgacgcaaacgccagagtgttggaagacgatagacacttcttcccctcctacatgtgcggcatgattgtacgccagcaggtgttgcaggaccatccggagctacagggcgtcttcgacaggctgaccgggcagatatcgaatgacgatatggttcagatgaaccatgaggtggacgtagagaagaaagaaccaagggaggtggcctatgagttcctcaagtcaaggggcttactcaacaactaattcagggcagcaacctacgagtgataccgcaatcgagttccgccacgtatcaaaagcctacgggaacactcccgtgatcaaggacatgagcttcactgtcaaacggggtgacttcgtcacgatggtgggatcctcgggtggcggcaagaccaccacactcaagatgatcaatgcgcttctgaccccaacctccggcgatatctttgtcgatgggaagaacatcggggaccttgacccggtgcaactgcgccgcaacatcggctatgcgatccagggaagcgtgctcttccccaacatgaccgtggagcagaacatcgcctatgtcccgacgctcctgaatagacgggacaagcagcgcaccgcccgtaccgtacgcaagtggatgaagatcgtagggttagaggaatccatgctcgaccgctaccccgatgagctctcaggaggtcagcagcagcgcgtcggtatcgcccgggcactcgctgcctctccggacattctccttatggatgagcccttcggtgccgtcgatgagatcacccgtgcgagccttcaggatgagatcaagcggatccactgtgagacacacatcacgatcgtgtttgtcacccacgatatccaggaggcattgaagctcgccacaaaggtcatggtgatcgataacggcgttattcagcaatacgacacgccaaaggatatcgtgagccacccggcgaacgagtttgtgggccgcttggtgcagcgtgagcggcacacctgtctcttggatgatgaccatgtggcagattgcaaatacagcgaagcgtacaccgataagaaataatgtaatccctataaacttgacgagggtcccggacaaacccacgggacccccacttttcgagctcttgaccactgtataaagatccgagtacctttatcattcgcagggtctgcccttatctactatgatgaccgaagagcccatctgacctgtggacgatccctggaaaccgcgtcggcggggctccattcccaacccgaacggttctatacatgtaaatcttgagggcttacgtgagcggcaaaatgttaaaccactactcaataagcgacattttcgcaatgtcttcatgaagccgtctcgtagatggcccacattgtgttcacataaaaagagaggggcaaacccgcccagtcacggatttgcctccccctactcagagaggagcgcttgctcccctcttatttattatgccgtgccctacgcctcgagatgggacctcaacagctcattgaagcgcttcgggtttcccctgccttttgaggccttcatgcactgaccgaccagatagccgataactttcttgttaccgtcgtggtactggttcacctggtcggtgcagcggccgaggacctcttccacgatcggctccagcgcggagtcatcgctcacctggcgcataccctgtgcgtcgacaaccttctccggatccttgtcggttccatcgatgtcagcgagtacttcacgcgcctgcgcgaaggtgatctggtcggcggcaagcagctcagagatcgtgcggacctgtttggccctcagtttgttgtagctcgggaccaagttgaccattacgttggcaatggtggggatagccttctttttggcaccgtcaagcgcctcctcgaagaatgcggagacctcaggatcacctgctagctgttgggcatcagcggacttcagcccatagtccttctcatagcgcttgcacttggcatccgggagctccgggatctttgagtggcactcctcgatgaagtcatcggtcagatcaaacggagccaggtccgggtccggcatcagccgatagtcgtctgcggtctccttgacacgcattacaatcgtgcacttgcgggagggctcccagtgcctggtctcctgatagatcacgccaccttcctcaagcacctcagcctgacggcagatctcaaactcgagagcgtcatgcaggctcttgaaggagttgatattcttcatctcggtcttggtgccgagctctttggtacctcggcgacgcagtgagatgtttccatcgcagcgcatcgagcctgattccatggagcagtccgagatccccaaagtcttgaaggtctgctgcagcttctccatgaacagccgtgcctcttccggtgtacggagatccggctcagtgactagctcgatcagtggggtaccacaacggttgtaatcgataaaggactcagaggcgccactgatacgaccctcttcgccgccctcatgcaccatctttgcagcatcctcttccatgtggatacgctggatgcggatcggcacctgataggagccgtccttctcacgtttgatctcctctgatccatcggaggacatgtcctcccaaacagggcgctccttagcgccgtcgccggtcacattgaggcgcaggtgtccgtgcatgcagaaggcaaccgagccctgggtggtctggaagttcttcgacatatccggatagaagtagtgcttgcggtagaaggtcgagtgcttctggatctcgcagttcgtggcgaggccggccatcacaatagactggatagccttcttgtttgggaccggcagcgctcccggcatacccaagcagaccgggcatacattggtgttaggcggatcgtcgtggctcagcttgcagttgcagaacatcttggtgtccagggtcgtaagctcggtgtgaatctccagcccgatgaccgcctcccaatctttgaggacctcattcagtctcttcatttgagctcacctcccttacctgcaaaggcaggtgagacgacaccggctgcctgataactccgctcaaccgcacgcgcaaactgcagcagtcggctgtctgcaaaggcaggaccctgcagctgtacggaaaccggcagtttgctttcggtccccagaccgagcggcactgagataccgcagttgcccacgatgttgttggagatcgtgaacaggtcagaagcgtacatctgcgtcggatctgagatttccccgaatttaaaggcagtgcgcggcgtagcgggcatcaggatcacatcgcacctcttgtaagcctggacgtaatcatcggtgatcaacgttctgacctgctgcgcgggatagtagtacttgtcgtagacgccggaggacagtaagtaagcgccgagcatctgacggcgcttcgcctccaagccaaagccgtgtgagcggctctttgaggtctgctctgccaaggtctggcagttgggctcttggtatccgtagcggacgccgtcaaaacgggcgaggttcgagaacgcctcacagggggcgatcacgtagtacgccgcaattgcggaggcgatgttcggcagcgtgacctcaacgatctgcgcgctctgatcttgcagagctttcacggctcccccgacggcagccttgacctcaggagtgaggccttttacatccatcaattccggaacgataccgaccttcttgccctcaatcggatcttcgaggtgcttggtataatcgatcgcgcagtcctggctcgtcgaatcataggggtcacgaccctgggtggtcagcgcattgagtgctaaagcgacatccttgacgcagcgcccaaaaggtcccacctggtccagtgaggagccgaaggcgacgacgccgtaccggctcaccgcgccgtaggtgggcttcataccgacaacaccgcagagacttgccggctgtctgatggagccgccggtatcggagccgagcgctatcgtgacctcgccggaggacaccgcagcggcgctgccaccggaggagccacccggaacgcgctccaggtcccagggattgtgcgtcggatggaaggcggaggactcggttgaggagccaaaagcgaactcatccatgttggtcttgccaaccggaagcacgcccgcatcgagcatgcgctgcacgcaggtggcagtgaacatcgaatcgtagttctcaagcatcttggaggcgcaggtggttctggtccccttgaggtgcatgttgtccttgaaggcgatagggacccccgccaacatcggcaggtcctcaccctttgccttcttctcgtcgattgctttggcagcatcaagtgctagctccggcaccacctgcagaaaagcctgaacatctttctcacggttgtcgatcgcgtcgagcgaagccttcgcgacctccgtagcgctgaagtcccccctcctgatgccctcaacgatgtctgaggcgtaaagcttatcgaatgaacccattttaagcttcctcctcatcgccgaggatggacggcactctgaagtagcggtcgtgggtactccccgcgttgtgcatagcgtccttcagatcgagcgcacggtcatggtcgtcgaccacgtcttcacgcatcacattggagagatccccgatcggctgataggtgggcttcactccctccagatcatactcacggatcggctggagtaaccggaccgcctcattcatatagtcggtcatctcatccagctctttgtctgtcaaatggaaccgggcatattccgcgatggctgccacatcttctttacttaacggcatgggtctaaccatcctcccaactctgccattatttaacaatcaataccatagaagcattttaggacaaaagcatgcggtgttaggcgctcgcaactctcccgcaatgaaacaagcatcggccccctcctgaaagccgactgtgtctctattgtttcatcacatttactctgcctgcgggaataaaagacgcgatttcggtaaaatacctactagctagtaggaattaagagtaccttatgccttctgaatgtggccgctttctaaagcgttgcgttcaggactttctcttaaatacccctaacgctactatgaattagttcatatgctatgcaccgaactgcctttttagtataccggtgcgcacgaccatcgtggtctacacaaagtgcggatcacacgagttttgggagacgatatggcagatacattgcttgaggtttcgaacctctcggccggcacagaggacaaacccatcttgcaccacatcaatatcgaggtcagcgagggtaagactcacgtgctgatggggccgaacggcgcaggcaagtccacactcggccatgtaatcatgggcgatccgcaatacatcgtgcgtgaaggttcaatccatttcgacggaaaagatatcaccgatctcacgaccgataagcgctcactcgccggcatcttcctgtcctaccaatcccccgtcgaggtaccgggtgtgccgctgtacaccttcctgcgcaccattacgcagatgcgtccggagctcaagatgactgcgcgcaacttcaggaagcgcgtgaatgaggtcgcacaggagctcgatatggacgactccttcctcacccgtgagctcaacgtgggcttctccggcggcgagaagaagaagatcgagatgctccagcttttactcttgagaccgaaactggccatcctcgacgagaccgactccggcctcgacgttgacgcgctctccgtggtgtccaagggtattgaggcgtatcgccgtgactgtcagggcgcgcttctgatgatcacccacaatacccgcatcctggagaagctctctgtcgacaccacccacgtgatggtgaaaggacatctggtcgctgaaggcgacgcctcaatgatcaacgagatcgaccgtgagggctttggcaagtatgaggatgagctcgaagccgaaacgaagcaggaggcttaatagctgtgagtgagaagaaaaagacacaggtcgcggatattgaccgctccctgtatgactttgtgaagccggaggtgggctatgagcgctacaagaacggcctcaccccggatattgtgcgcgccatctccaagaagaaggacgagcctgagtggatgctcaacaagcgactcgaggcgctggagatcttccaggacaccccgatgccgggcaactggggcccctccatcgagcacttggacatggaccacatctctacgtatgtgaacccgaagaccaagcagaccaacgattgggacgacgtccccaaggacatcaaggacacctttgaacgtctgggcatcccacaggcggagcgtgagagcttagccggcgtcggcgcccagtacgactcagagattgtctaccacaacatgcgtgaggaggtcgccaagtacggcgtcgtctacacgacgattgaggatgcgatccacgacccgaagctcgagccgattgtaaagcagtacttcggtaccctgattccacccacggaccacaagttcgcggcactgcactacgcagtctggtcgggtggctcctttgtctatgtcccggccggtgtcaccgttgagtacccgctgcagagctacttccgcttgaacgccgcgggtgcaggccagtttgagcacacgctgatcatcgtcgagcccggcgccaacctgcactttatcgaaggctgctcggctccgaagtactacgccgccaacctgcacgccggcgcagtcgagctcttcgtgaaaggcggcgcgcgtctgcgctattccacgatcgagaactggtcgaagaacatgtacaacctgaacaccaagcgcgccacgatcggcaaagatgccaccatggaatgggtgtccggttccttcggctcacacgtgagctacctctatcccaccacgatcctggcaggtgacaactcgcactgcgagttcactggcatcaccttcgcgggcgccacgcaggacctcgatacgggctgcaaagtcatcctcaacggtaaggacaccactgcttcagtggataccaagtccatctctaaggacggcggcgccaacaccttcaggagctccgtcgtcgtaggcccgaaggcggacaacgcccgtgccacggtttcctgccagtcactgatgctcgacgatatctcccgctctgacacaatcccggcgatggatgtccgcaaccgcaccgcatccgtaggccacgaggccacgatcggcgcaatctcggatgacacgatcatgtacctgatgagccgcggctgctctgagcaggaagccagaacactcgtcgtgaacggctttgcaaacccggtctcaaaggagctgccgcttgagtacgccgttgagatgaacaatctgatcaagcttgaaatggaaggggcgattggctgatggcagcagcaatgaccgaaaccaccacgctcaaacatcttaatgtaccgcccaagcagacgtggaactatctgaagatcaacgacaccagcctcacggtgatcaagccgaaggagcagggtgaggtctttgcccgcctgccggagatgttcggacgcattgagtccggcatcggtcctgaggccgtgaagtggatcgagaacatggcgggcgactcccactacatcgaggtccccgcacaccgcccgaccgacaggccgatcgtcgtggactgcgacgcggacaagaccgatatcaaggataccgggatcatagtgagaaatcacgctaatgccacgatcgtgatgctctcccacggaaaacagggtagcaaggatacctccgccaacctgctgcgcatctatgcggaacacgacgcccacgtctctgtggtggagatcatggcgctgccggaagagcagcagcatatcgaaggcctcgcaatcgacgcccagcagaattccagaattgaggtgcgccagtatgcgctcggcggcggcaacgtcgtcgcaggcctggcgaccaatctggcccaagaccgcgcccgtctcgatcttgtgagccgctactttgtgcgcggccatgagaagctcgacttgaaccatgtcgctcgccagcgcggctgcgacaccaaggtcgagatgagcgcctccggcctgctgaccgactccgcacaaaagaccctgcgtgagacgatcgatctgatccacgggggcaaaggctccaagggcaacgagctggagacggtactcgtcgagggcgaccacatcgtgaacaagaccctgccggtcatcctgtgcgacgaggaagacgtccagggcaaccacggcgcctccatcggctccatcgggcctgagcagactgagtacttggctactcgcggcctcgcgggcaagcaggtctcccagctctttgcgactgcactcttcgacgacgcactgatccacgccccaggagccgcttcacagaaagccgtcggcgtccgcgcttctgatgttttaggtgagcgggcctttgaggattcccgtgagggcctcgctctagagaaagagggtgagtgatgtggcagccatagatattgccgccaatccatacaggaaagactttccattgctcgtgcagcaacccaacctcgcatttctcgacagcgctgcaaccacacagcgtccgaaggttgtgttggacgcccagcgtcacttctacgagacgatgaacgccaaccccctgcgtggcctttacaagctctcggttgaggcaaccgaagcaatcgataagacccgtaaggacatcgctgccttcatcggggcgaccgatgagaagggtaagccgcagggcaatgagatcgtctttacgcgcaacgcatcagaatcgttgaacctggttgcacacaccttgggaaagaagatcctgaaaccgggagacgaagttgtaatctccatcatggagcaccactccaacttgatcccctggcagcagatctgcaaggagaccggcgctaagctcgtctacctgcgcttggataaggatttcagaatcactcctgaagagattgagaagaagatcaccgacaaaaccaagatcgtctccgtaacccaactctccaacgtgttgggtgtctcccctgacatcaaggctatcgccaagcgtgcgcacgaagttggagcttacgtaggcgtcgacggcgcacagtcagtacctcatacgcaagtcaacgtccgcgatctcggaatcgactacctcgccttttccccgcacaagctggagggcccgatgggcatcggtgtgctctggggcaagatggatctgctgaactctatgccaccgttcctgaccggcggtgagatgatcgactccgtcaccgagcaggacgccgtatgggcaccggtaccgcagaagtttgaggccggcacccaggacgccgcaggcatctatgctaccgacgccgcaatcaagtacctcaccgatcaggacttcacgaaacttgaagcgcgtgagcatgccctcacccactacctggtggagcagctcgaagcgctgcccttcatccaaatcgtgggaccgagagatcctgaccgccacctcagcgtggtctccttcaacgtaaaggacatccacccgcacgacgtcgcatccctgcttgatatgaaggatgtggcgatccgcgccggtcaccactgcgcgcaaccgctcatgacctcaatgggtatatctagtagttgtagggcatctgtggctttctacaacgacaaaaaggatatcgaccagcttgtagatggcctcaactatgtttggcaggtattccatggaacaaaatgatttgtacagtgctgagttcatcgaccatatagcacatccggattacaagtatgagatgaaagacccgacgatgaagcacgagggtatcaacccctcctgtggcgatgatctggagctgtccgtgaaacttgacaaagatggaaagatcgccgaggccgcctacaccggccacggctgtgcggtcagccaggcttctgcggacatgatgagtgacctgatggtcggcaagacccctgaggaagccatcaagctctgtgacctctttaccgatatggtcaccggcaaagagaaggacgaaagtaagcttgaccagcttgaggaagctgcctcactcgagggcgtctcccacatgccggcgcgtgttaaatgcgctgagctctcctggagaacactcaaggagatgctcaaaggcaatactgagaaagcctcaacgactgaagatcaggaaggataaccatggctgccagcatgttttcaaccaagggccgctatgccctgcgtgctatggcagacctggcaatgcacagcgggtgggtctctctgggggacgtatccaagcggcagggtatctcccgtaagtacctggaacaggtgattgccgtaatgcacaaggtcggcttcgtcgagagccagcgtggcaagggcggcggttatcggttgactcgcaagcctgaagattataccttgggcgagatcatgcgggctgctgagggctcctccttggccccggtcgcctgccttgactgcttgaccggcgacatctgtccgcgcattcaatcctgccccactgtgatgatctaccgtgatctgggcaaggtgacctcacagtatctcgactccaagacgctgcgcgatgtgaccctctcctcaggcttcacgaagctcaccaaagagcagctcgaagagaaagaggaaaaggaggaacgcgaggagcaggaagagaaagccgccaaacagagggcgaagagcaaaaagaagcacaccgcttcaaagtaacgctacactcaatacttcaaagcgcattccaacgacctgagtttcggctcaggtcgtttttgtagctaccatatcggcgggtctccgacgcgactgacactgggctgtagagatactcacagccgcctctggtaactctcgaggaccccaaaacccgctatgacttcattcatacatcgcctgatagtacggacggacgccaagacatttttccggatcttagctgcatatgcgcaagctcaagcccctcctttgcataccccccaaacctgaagacagcgtcccctcaccacacaaggcaccttgagcttggtcaaacctaccacatcgattgtcagcatgtacaagacagctcttcgaacatcctcactgtgtaaatctagcccctcaaccagaaaaaaaaaaaaaaaaaaaaaaagcaatccatagccgaaaaggagtggcagaaaaggacattgagcagtgcacgaaaaagcctttggaacagcgggcattgatacagggggcctttttggtcctgtgggggacgccatcgagtgggcagcgtgtccccgacggcaggcatcggcccttttgtttcggggatagatgtggcaagaaagggtc

SEQ ID NO: 349 - DNA, 40802 bp, Unknown
  Metagenome-assembled genome
gctgccgccagcaggtcgtcgagcctgtagccctcctgcgcgagcgcatgcacggcctctgccttcgccctggtcagatccttccccttccggccagggaccgcagtttttttaggtacgccacctctgcctcgagctgctgaaccctgcgctcgagctgctgctcgcgcgtgagcggcctcgctgcggcccctgatcccttcgggcgtcccttgggcttcggcctcagcgcctcggcgcctccatcgcggtatgccctgcaccacctgtcgagcggggccagcgacatgatgccatagctggccatcgcatcgcccttggacatgccatcctcgacgacggccttcgcggccgcgaccttctgtccgtatgtataccttgcctgcttcccgtccatcgacagcagcgcctcgcttccgaacgccttccatatctgctgccattttctcacggtgctgcgcggcatggagagctccttcgccacgctcttgtatccacgtcctttctcgaagagctctgccgccttcttccttgcctcgatgtcgtgcttgaccctcagatcggtatgcatgaatatgcctcccatttcctatgtccaggaaatgggaggcagttcaccgcttgggtaactgctgcgatagtgccttgccactcttaaaggtgagatgtactagcgagaaggctttacaacaagaaaggatgccatacatgcgcaagttgaattcattgagagctactacaacagaaaacgtccccactcaacgatcaacaacaaaattccagcagaggtagtagatgctttctttgaaagaatgaaacggcagattgccaagctgagtgcaacatctccctaaagacctcgttggctatcctgtatttcaggacctttctcgctctgtcacagattagctccaccgcatgctgcacctcctcgtttgtgaccttgccgaagtcgctgcccttaggggaagaactcacacaggagcccgttggtgttcttaactgtcggcttttgccatagatggtgggggtcgcagaagtagagctgcacgcctcccaaggcctttgtgacatctgtatgccctgcgaactccttgcccctatccggaagtgagcgtcttaaggggacgtccctgtagcagcccgacctcggccttagagacgctcccgctgtcgtggtggcatcttctcgcggcaagcagcctcactgccctgtcggcaagcacaagcaggcacatgggccccgctgccacgagcgtgtcgtttccccactctccgaggcaagacctctcatcggcctcttgggcctatcctttacgctgcgtaagatctcgatcttacccctcgtcttaggcctcttgctgcgcaggtagcgccgcacctggccttgcgggccggatcccgacacctcgagagcggcggctatggacctcacggtagaatagtcggcaggctcacgacgcacctgccgccaccctcgagcctgagcctgccgtctatctgctccagggaccagtgtctgtccatgatgagtaagcgcaccttccgtgcgtgcgtagggtctgagcgcttccttttcggcctttatctgccgtgggcgggcagctgccctccttttgggcagcgcatgccctaaagcgcctgtgccgtgcgttcctcttgagcttgtggcagacgctggagctgtccctgccgatctctgccgcgatatagccgatggagcttccctctgcatgcagcgtggctatgtagtccctctcctgtaggcttgagatgcttgtagtggcacattccttccagctttcgacgttgatgtagataaccaacatcgtagccttccggagtgtgccacgcttgcattcagcgggctatcctgttgcattcagaatgctaatccgccgtccgaaatattgacacaggtcagacctatcgcgccctgtctttaagaacgccggcgctgcggctaagaggacagagatcttcggtgatgcgaaagacatagttgccctcggtgaggaccttgtcttcagcagctcgagcacagcagcagtcttcgtgctggacggcagccagaacggctggacggagtgggtcaacgagagcggacagacgctcgacttcatgtatcacggaaagaaggactgacatccatgaacaagcagcagctcgcggctaggatctgggctagcgccaaccagatgcgctcgaagatcgaggcctccgagtacaaggactacattctgggcttcatcttctacaagttcctctccgatcgggaggagcggttccttctcgacagcggcttcgacgatgactcacttcccacggtgagcgaggagaactccgaggtatttgcctatgtccagaacaacatgggttacttcatagcgcacaaggatctctactccacctgatcgcgaagggctcaaactttgacgtttctgacgtgagtgacgctctcttcgccttctcccacttggtgaagccctcgtacaaaatgtcttcgacaaggttttcgagactctccagaccggcctctccaagctcggcgacacctccggggcgcgcacgaaggccatcagcggcctcttgcagctcatccacgatatccccatggacggaaagcaggactacgacgtactcggctacatctacgagtatctgatcagcaattttgcggccaatgcgggcaagaaggcaggggagttctacacgccccacgaggtgagcctcctcatttcccaggtcgtggccatgaacctcgacggaaggcccgaaatcaagatttatgaccctgcgagtggatcggggcccctcatcaccatcggtgaggctgtgtcccaacaccttggcagccgcgactccatcaagtactacacccaggagctcaaggagaacacgtacaacctcacccgcatgaacctagtgatgagaggtatcagacctgaaaacattgcatgtcgctgcggtgacaccctggccgagaactggccctggttcgaggaggggcaccccgagagctacgagccgctcttcgccgatgccgtggtatccaactcgccctactcccagcgctgggaccctgcaatcgccgagggcgacccgcgcttcgacggttacggcgtggcgccaaagtccaaagccgactatgccttcctcctgcacgacctctaccatctcaagctcgatggggtaatgtgcatcgtcctgccccacggagtgctcttccggggcggcaaggaggagtgcatccgccgcgccctagtggagaacgagaacatcgacgccatcatcggcctgcccaccaacatcttctttggcacgggcatccccatcatcgagatggtgctcaagaggcgccgcgcatcagatgacatcctcatcatcgacgcctccgaaggcttcgtgaagggcggcaagcaggacaagctcagggcctgcgacatcaggtgcgtcgtggacgcctacgaaaggcgcactgacgttggccgcttctgtcgcgtcatctccaagcaggaggtgcgcgacaacggctataacctgaacatccctcgctacgtcgactcctccgagcagcctgagacctgggacatctatgccacgatgttcggcggcgtgcccacgagcgaggtggacgccctgcacgagtaccgggacgtgctcccgaatcttcgcgacgagctctttgagactcagaacagggccagcatgaggctcaaggcggacgacgtcgagaaggcggtgcgtggcaatgcctccgtacgggccttcctggacgcctttgacgagcgcttctctgacttcggaatctggctctacgacgagctcgtggacaagacgagcctcgtgcacctgcccacgcaggaggggcagattgcgaacgaggtcctcgggcggctcgacgacgtggcgctcgtcgaccgctacgacgcttaccaggtgatcgatgaggcgtggcagcagatttccaacgacatcgagataatccagactgaaggcttcgacgccgtgtgcaaggtgggccccaacatggtcaccaagaagggcggcaaggaagtggaggtgcaggatggctgggtcggccacgtactgcccttcgacctcgtccagcatacgcttcttgccgacgacttcgacaaattggagcaagccgagtcccgggcgtctgccatcgaccccgagctggcagagatcctggaaggcctctcggaggacgacaaggccgccctgggcgacgcccttagcgaggcaggggacgcattcgtcgcctccatgctcaaggcgatcgtccgcgagctcgggggcgaccccgacatggcgagcctcgcagatacggcagaccgggttcactcgcttctgaacgagcagaagaccctggagaagagcgccaagggcctggccgtaagccatgagtcaaagacgaaggagactatagaggggctctccgaccagcaggtccgcgacctgctcgatgagaagtgggacaggcctgtcgtggacgtcatctcttccccagcttgttctgccgtggaagggctcgtcaacagggtcaaggcgctcgcccagaagtacagcacgacgttcgcccaggttgacgaggagatctcgcatgaggaggacgagttcgcagggctttcgagcaagctcacgggcgatgactacggcatggtcggcatccgggagctttgcagcctgctgagaggtgacgcccggtgagccgcaatgtccccgagctccgcttcgtcggcttcgctgacccttgggaacagcgtaaactgggagacttcgctactaaggtgacgaggaaaaactcagatcttgccaccagcgagacgttcaccaactccgccgaactaagcgtggtgagccagcttgactacttcgaccatggtatcatgaagggcgagagcattggcaactacaccgtggtcgaacctgacgacttcgtgtacaacccgcgaatctcggtcgctgcacctgtgggtctcatcaacagaaaccgcctgggtagagctagagaaacgacgattaatgcctacgccggccgcgaaaggccacgtggctggtcctttctggcacatcattgggaattaatcatcgtttccctagagttatgtctccgctctatacggttttccggacagatgaaatcattgacaagtgcttcttggaacattatttcgagacgacgctttggcatggcttcatgaacttagagggaaactcgggggcacgctccaacagattttcgatagctgaaccggccttcttcgaaatgccgatttcttgcccgataaaggccgagcaacaggaaatctcatcattgctggaacacctcgactccctcatcacccttcatcagtgtaagctggacttgctccaaaaggtcgagaagttcctgctcgagaggatgttcgtctagacagtcagaaggaggattggtatggatcgcaagacgctcgtagaggaatcgattcactcgggcgagatggaaggcgcctacgtttccgcggaattccgcaaggacgccgacgagtacgtgaagggcaacattcccatagaggacctcatgcgacgcaccaagcggcgctgggactcaaagcgcaagaagggtgcaccccatgtcggatgagttcgtggatccctacatcgacccggagacgggggtactccgcaatctcgttggtgcgacctcgtacgacgagctggccaacgccgagggggaactcgtgtcatcccgcgctgctgagttcgtgagcaagttctcgcctcacgccgtagggacgcttgacgacctgaagatcatccaccattacctgttccaggacatctacgactgggccggggagatcaggaccgtggagatacggaagaacaaggaggggtcgcagtttttcctcccgtcggtgaacatacccatgggtattgcctggtccctgtccgagttggagaaggatgaccacttgagaggaatggaacgtgacgagttcgcacgacgtctcgcctaccactacgacaactacaacttcgtgcatccttttcgtgaggggaatggtcgcacgcagaggctcttctggacactcgtgtgccacgatgcgggatatgatctcatgtggaggtcggtgtcgggcgaggagaacgaccgggccagccgcgacgcggcggaagaatgcgactacggcggcctcatcgacatgttcttgaggatcgccattccgtgcgaccctaagattcccctcaatgcggggcttgtggatgccaggcaccttactggataagccaacggcccattatcagaaacaaggaaatcgggtaggttaaatggctgacacattcaaatccgaagccgccttcgaggacgtagtcgtgcagcgcctcaagccctacggctggacgggaggcgttctgcataaccccaccgagcaggacgtgctggacaactgggcccacatcctctacgagaacaacaagggtatcgaccagctcaacggctgccccctcacgcagggcgagatggggcagctcatggaatagatcacggccctgcgtactcccatgcgtctaaacggcttcatcaacggcagaagtgtcttcatcacccgcgacaaccccgacgataccctgcacttcggccgtgaggtgagcctctacgtctacgaccgacgcgacatcgctggcggcaggagcgtctaccagatcgccgaacagcccgtcttcgcccctaggtcggtccggctcaacagccggcggggcgacctgaccctgcttatcaacgggatgccgcttatccacgtggaactcaggtgtagcgggattccggtgacccaggcctgcaaccaaatagagaagtacgctcatgagggcgtcttcaccgggctcttctcgctcgtacaggtcttcgtagccatggagcctgccgagacgctctacttcgccaaccccggggaaggcggcgacttctccctcgattgtgtcgagttttgtggtgtaagagtagggccgcgccagtctcgatatcggcagcctcctgcgttggcgtaactttatgccgctctctcgtacttatcaatcaccagcttcatgatcaccctcacttcggagtgcgcctcctcgtccgcctccagctccttgatgcgcatctttgccctcttaagggagaaaacgggctctagtgactccttcgacatgaacagcctcccgcactcccactcggcgttaagcttgccgataatgccggcgagcagccgcatgaccgaccccgtcgacgggaacacctgcacgacccggcccctgcgcttgagcttgccgttcatgtgcttcatcacgttgttggtgcagatcttcaggcactgctgcctggggaaggacagatacgcgagggcggcaagctcggcgtccttgaccaccccggccgccgacggagcgtcctcccttagctcgtcgatgacgcgctgtcaggccctccccggagtcgatcctggcgagcacgtcgcgcttgacgtgcgcgaggccgcgctgccaggtcgcccagggcgtcggaggtgaccaggcacacgttgcgcacccagcgctcctgcaaaaacccgtaccaggaggtgtagctttttgaattcgcacacgtgaaccccacgaagtggcactgatcgtcgtcgccgacgccgatcgccacgatgaaggcctccctgcgccacgcgccagctcacgtaggtggcgttaaggaacagctaggcgaagcggagcggcgagcaccccctcgccagcaacgcatccaccttaccctctatcaccgcacacaggcgcaagagctggtccttggacagggagtccaccttctcgaccttgcgcgtggaggtggcggtgatatacatctcggccagcgcgcactcggtgcgcgatgcagcgcttgaagagctcggtcgggaagtacgaggcgctgtacagcttgggcaccatcagcgagagcgtcccgaccgcggtcgcgatagccgcagcgggtggtgccctcggccccgcacgcctcgtttgcctggatggacatgatctcgttgagtatggcggccatggtggtgttcatcatgtcgcacaggctcgaggcgctgtctaagaaaccgagcaggacctccttcagctgcgggtccccacgctgtatactgtttgagctgaccatcgtcgttcccttctgtcgtcatcgatgcaaccgacattctaggaccggcgatggtcttctcgtagcttccctctcatacaccacttttttcggcacaacccattctgacatcggggcatggatggcgcatgagtgcttctgaaagcctgccatcggcgtcttgcgcggcaggctgcacgggctttgtccctgcacgcatgctcaacgaccaaggatgtaaaggtcgtgagcatagcgccctcgaggatgcccaccttctgccgacttccgcacgaggaaaaacgacgggaacgactccatgaggctcacaagacatggcagatgcaggctccacagagtgcgggtgcccaccaaggagatagcagggctaaagggacgcgatgtgtgccctcggcgacctcaaggagcagcagaagaaggcacatcagcgcatgctcgccctgcttgccgccacgggattgtctgggaggagaggatgcccgcaggcagacaaaaagaagctttagggcaatgactttctgggcatagctgcgcccttatcaatccaggcttacaggcgacagagtcagcagatgcccgctgcgctgcgatgctggaaaggatacattcccttgcatcctcatgcacgctcgcccctgcccgcgaggcgctcctatgcctttcgggcatcggcttcaggtgcgcctttaccttctgcgcaaagatgtatgacttctccaggctctgttcggggaggaaggtcacatcctggctggggctctccccgtcacagtcgtcaagcgccgattgacgcaggctgactgatatatccaagtgcgcgcccaggctgctgagggcgctccttatgggatgtgcctgggcgtgcgcaagggcgaggcctactctttcgaagagctgccctgcgtcggtggatctacacatcagggagcatgcccggctgctctcggaggaggcagttgctcgagaagggcgtcttaccctgtagggccaatgtcaccacagcagccaagctgggaaggttcatgctcttcatcggccagcaggtaccggagcgggcctcaacccaggctgcatagcgccacgccgccatccacctaccccctctattgccttttgctgtcaatctccacgagagccatgaatgccgctgtatgcgcgagactcaagacagcagggacgcccgattctatgtgcaccggccatgccaacacgtacgcgcttagagcgtcccttagccgccatgttggaacatcgatgttgggaccgtgcatatgcacgctatctaaggatatgagaatgggcagggatgcccgcatgtctcatgttgcaggacgcgtccgcagcggcattcgtcgaatatccttcatccctgcagttcagaaagccttgtgggcgcctgtttcgcgatagcattgccacttgacaggggtttaggacatacgaggatcgaggtaaatgactgagtacctccagcataaccgcaggagttcctgtcgcctccaaaccgtacaatgaggatgcaaggttgatacatccgagagggcaaagaaagagatggcgaaggggcatgcaggcgctctgaacaggcgcgaatgcgagagcaaagagacattgatgggccttttgaagaagttctcagacgaggagtcgtgcgaggggaggcttatcgaggaagaaggtctccggcggctttgtctgcccggtgtgcgccaatacgtcctgctcgaaggtctgaggccgcgcgcacaagtggcagtgcacgaagtgctcgcaccaggtgagcgtgagcgcagggactattgatggaggggacccacctcgagctcaggaagtggttcgtgggcgatatggctcatgtccgcccagaaggcaaggatcagcgcctgcgccctgcaaaggcagataggctgcagcttaaagacggcagggcgggtccttgcagctgacacacacgaggtggacgacttctatatcggcgccaaggcaccaggcaaaagcgggcgcggcacaaagcagcagccgatgcttacagcggcaggcagagctcctgccccctgcgctgcgcaaaggggtgctcgaaagattgctggcgccaggtggggcatgaccagctctgccatacatcgaagataagggcggatggctggagcggcaaagcttgccggcctctcctcgttttgcgggctcgtctaaagggagtacgacagagcggacggggatgcatcccttcccatggtccacagggtgatatccaacttcaaggcctacgtggaaggcgccttctatggcctttccaaggcccacatgcactccttgcggactcactcagctaaagatacagccacagggatgtaagggatggctgcatggagctgctgcacgagatgtgcctcatccatgtcccactctttggcatcgcagccaccgcgacggtccagccgaagatgccttcgatcttgccttaagccgcttacagttcagggagcctaactatgttggaggtactcagccatttcgcggaattacgggttcgtggaaaggacgaaagaccaatggaaagcatagcagagcagctcataaacgttgtgatggacgtggaggcgaaggagatgtgctccgcctgcggcaacagtaggaacgcatagcgcccgaggaccctcagcacctgcgtgggaacgatgagccttaggatcccgggattgaggaaggaagctattttccggtacttcccgatgcactcaattgctgatcgcaaagactgttattgctagctgtgcgaataatcattgggacggcagattgtcaagctgagtgcaacatctccctaaagacctcgttggctgtcctgtatttcaggaccttcctcgccctgtcgcagatcagctccactgtatgctgcacctcctcgtttgtgaccttgccgaagtcgctgcccttaagggaagaacttgcgcaggagcctattggtgttcttaagatggtgggggtcgcagaagtagaactgcacgcctcaaagagcatctgtgacatctgcatgccctgcgaactgcttgccccacttaggcgtgagcgtcttaaggggacgtccctgcaaaagcccgacctcggccttagagacgcttccgctgacgtggtgacatcttctcgcgacaagcagccttgatgccctgtcggcaagcacgagcaggcacacggatcccgctgccacgagcgtgtcgtctacccactcgccgaggcgagacctcgcatcggcctgcttgggcctctcctttacggtatgtaagatctcgattttgcctttggtcttgggccccttgctgcgcaggtggcgccgcatcttgccttcggggccggatcccgacagctcgagggcggctatggacctgccggtaagaatagtcggcaggctcaacgacgcacctgccgccaccctcgagctgagatgtcgtctatctcctccagggaccagtgtctgtccatgatgagtaagcgcaccttctgcgtaagtgcagggtctgaaagccgccttttcgccctgcatctcctgtggcgctcatccgccctccttttgggcagcacaggccctaaagcgtccgtgccgtgcgttcctcttgagcttgtggcagacgctggagctgtccctgcctgcctctgccgcgatataggcaattgaccttcccttgtgccacgcagcgtggctatgcagtccccctcctgtaggcttacgatgcttgtagtggcacattccttccagctttcgacgttgattgagacaaccaacatcgtagccttccggagtgtgccacgcttgcattcagcgggccatcctgttgcactcagaatgctaatccgccgtccgaaatattgacacaggtcagccctcggaggtgtgcagttctacttctgcgacccccaccatctatggcagaagccgacagttaagaacaccaatgggctcctgcgcgagttcttcccctaagggcagcgacttcagcaaggtcacagacgaggaggtacagcatgcagtggagctgatctgtgacagagcgaggaaggtcctgaaatacaggacagccaacgaggtctttagggagatgttgcactcagcttgacaatctgccgtccgaaatattgacacaggtcaagcgtctttccggagactgcactgatgatgacggaatcgagctgggcaccgaggaactcgatgacattgatcagaaggttgtgcgtcatgggcctgtccatcgtgcggtgagagtcgctcacccccatgcctgttgctatggcttccacagggtcgatcttgttcggcagctgtgcgtcgtgtggaacctcttcgagaacacgggacttcagcgccaggagggaagccacgggacctccgcctactacaatcgtctgtatgcccatctgtatcaatgccatgctatcagcctcgttcatatgcttctttgcggagatatggtacctgtcttcaagcctttgccaagatgctgcgggaatgcacggtgtgccaatgcccgtgtggtttccacggtggcagacctttcctgctgctcgtaagagactcgtcgatatacatccagcctgtctggcacgagacagaagagctgtttcagagtggctgcaggactgtctccattgccttgaagcgagtccgtcaacagtgggatttaggattttcatgcaacccgcgttgcttctggacccaacgagaatactctttcgaagcgtctgtagaactctgtgcgtgtctgttggcagttacgggcgccccttgatatcagagactttccattcatacctgagtttcataggactctcgaggagttctgccggcatgcaataaaagagcgcggcagctgctcccaaagtaggaacgcttgccgcgcttcttgctataaatagagtgtcaagggaaggtgaatctgtccagcctatctgcccttatcccctgatgttactgattgcttgtattgtctgcggcttgcgaatctgcgttgcggtaggtgaagttgattgtatagtaatccttgccgaaagctgcattgtaaaggttcgtaatttccttctctgcattggttttcgcgtcgtccaggagtccccctgcagtagcttcctgctcacttctctcgatgcatttcttctggaaagcatcagactctccgatgcttatcggattaagaaggttgttgttctcttccagtacgcctgacagatccatattgggggtattcgagactatcgacggctggtcgagggtgacattgagtacgtttgaattctcggaatcctgttcaatggaggcggtcttcaggttaacgccggccttgagtgttccagagtagcggtaccagaagctgttctcggtgaaggggacatcgaacttgttgaagagatcacgattcgaatcggtgaccttgtcgacgtatgtatagtcctgtgacgcgctgacgagttcgccctgttcttgaacacgtgagaagacagcggtcggcgagagcgtctcgacctgtgcggccgtcccctttttggaggacatggcagaaatgtagtaaatgactgcgccacacgccactgctcctaataccaggccgatgaggaacatgaaaatgccgtgcttaatgttcttggccttggtagtcttggccggttcttcttgcgttgccatggtgggtctccttatctgtaaagtttccttctcactatatggcatgttattttcgcgaggatgtaaccatacgtgacgattttatctcagaactgcagggattcttgtatggaatttggaggtgccgacaaaaaaatctgtacatctgactcaaagattggagtgtcagaggtatcaagaagatcaaaagaaatgcttcattgaagaatatcggtgcaacggtcacttcattggcaaagcaatgcagacgctagggtatccacgtgataggaaaacagcgcacaagttcttgcaaggacacaatgtggattatgccctctgttgcaagaaggcggcgtgagtatctctcttagaggcctcggagcgatgctcgagtcggaaacttgataactcgacggtatcgttgaatattcgacaatacttgcatcgaatattcggtgaatatatcatcgagctaccgagttttattggacctgcgagagcagggggaggtccctatagcgatacccatcaactccaaggagctagtgagtggttccgttgtcgagtcgtctcgcatcgaggcaaaggaggacttcaatcccgagcgcgtcgtgcacacaatttgtgctttcgccaatgatatcgacaacatcggtggcggttacgtgctcataggggttgctgagaagaactctttgctccagttgccaccgaaggggatatcacgcgagcaggtcgacagcgtcctcaagaggctgttccagctatgtcgggagatcgagcctcactacgagcctatcgtggagcctaagcaggttgccgaggacaggtatgtaatcgtcatatggtgtcccggcggacagggtaggccatacaaggcgtacaagagcgtttacaagaaaggttcgaccgagaggctctactacattcgaaagatggccagcactactgtggccacgtccgaggaggagagagagttttactatgtgtccagcaccattcccttcgatgatcaggccaaccttgccgcttttcccagcgacctgagccttgcgttgatgcgtgatcacctaaaggaaattggaagcagcctctacgagcagtccgagcacgcaactcttgaagagcttgctgacgacctgcagctgctgtcagggccacctgagagccctcgtccgcgcaacgtcggtatcctcatgttttcggaccacatccatacgtattttcgttacgcgagaatcgaggtcgtcgatctgcccgaccccacgggtcagaatatggtcgagaaaaccttcaccggacctatccagcgacagctgcgagatgctcttacttacatcaaaaactacatgcttgagtccaagatcgtgaagttcgccgatagggcagagtctcagaccgtgttcaactatccctatgctgctgtagaagagatactctccaacgctgtgtaccaccggtcctacaaggtcagtgagccaatcacggtgcgaaagacgcctgacgcgctcgagatcaccagctatcccgaattcgaccgcagtatcaaggatagcgacatccagtctcgcaacattcgtgggcgcatctaccgtaaccgccgtatcggtgactttctcaaggagctccacctcatcgagggaaggaacacagggttccccacgacgtttagggctctggcggacaacggttctcccatgcccgacttccagatggacgagaatcgcaactacctctcggtaatactgcacgtccacccggcgttccagccgcaggaaagcaggagggacgcggggcggcgggaactggagcagcggatactcgacgcgctgccggaacgaccggtgctcatctctgagctcgcaaggctcctgggctataaaggcatcacgaagaggctctgtatcacggttgatgcgatgctgtcggagggaactcttcgatctgtgcgggacggtgccaggaacaggatcgccaggccatagagcagagatgggcgcaggagtctaccgcccgtcaaagctacgctccgttgctggaggtgacggtagcgggagagaaggaccttcctgcgccgcctgcatgaacttggccaccgcgccggccgtctgctcttgctgatcctcggcgctcacgatcaccgtgccgcctccgtcctgtgttccgtagtccccgaactgtgcgtggttgtcgccctcaatgaccacctcggtgtagtcgtctgggcgcaggccggcgtacacggtggccatggtgcctcccagcgagtgcctgcctacacaccagtgttggtagtggtatgcgccgctgtcaatcaccctgtcgactgcatccatgtccaggaaggcgaagttcaggggcgtgcgtaccaggaacacgtcggtgcccctctgggcgatggccaaaagctgggcggcgtaggtctcgcgctgcaccttgccgctggggtagaacaccagcgcgtcgtcgctgccggcaagtgccacctcggcccgtggtatcgcccaggagtacgcgctcgcgtatgtaaggaacactacaattgacacggtgatggcggtcaggacactgatcgcgacgcgtcgcagaatcgtccttggtctcggtagctttgtcctccgcgtgcacttcttggcgcctatgtattctctttcgcttgtaaagtcagctcgtggtatccgacccagatgattttgtgataacacagatgctctttttgactgcgagaaaccccgctatccgcaccttagatactcgaagacgaattcagcagtgtatttctttgcctatggccccaatgctaatggatagcaggggaaacgcgggcttggccaaagcatgggctgagacatccgaacgaacgccagagtgcgaagtgcccacaggggaggaccatgaggaatcgattactctcaggcagcttctgcgcggcactgtgataggtgtcatggggcttggggttacgagaaccctgggtgcctgctcgttcaacacagtcgacgaaagcgtcccggtggtatccgacagcggcgcgcaggccaccgatatcgtctctacggcaggcgtccccctgctggacctttcgaaccaggtgtagcttccgcagcttggactgggcacacgggtgcaggcgcttgagtccgactcgagtgagtccggccgtgaccgcctgaacgagactgtcagacagtcggtcgtcaccgcgctgtcggtagggatcaccacctggacacggcccatggctactacaacgagcgatgcgtgggacagggaatcatcgacagcggtgttccttgcgagcagatttggcttacgagcaagctttagcccagcgactacgctaacgcctttcgagctatcgacgaaaggcttgaccgtctgcaggtaaactacctcgatcgtctgtacctgcaccatccggctgacgactacatgggcacctggcgagtcttggaggacgcctatcgccacgacaagatgcgcgccctgggcatcagcaacttcgacaacctcccaggcgccttccagcaggttgtgaacaaggcacaggtaaagccacagatcatgcagatcgaatgccatccctacgcccagcgtcaccagacgcggtagctggcgtcacagtatgacatgcaggtgtatttcctgggccatgccgacccagccctgctgggcaacgacacgctcatcgacatagctcaggagtacaacaagagtgtggtacagacaatcttacgctggcacctgcaggagggcttctccgccatccctgggttcacgaatcccgaccacatccagaagcgtatcgacgtctttgacttcgagctcaccggcgacgacatggcgcgcatcagggcgttggaccggggagagggaggccggtacttcaacatcgactatcgcactgctggcatcttcttcatgtcgctgaacgagcagagggatgtatgggggtcctcttgctggagatctcgtacgcattcatgcggatggactttgacgtacaggagtaggaaccgtgggctactcgccagccgcgggcaggacgatcttctcgaggatttccttcagcatgccgtcgtcgttggtcgactgggcttggtagttcgccacctggtccaggccgtcgcgggcgttagcgacgcagacgccagcgctggcggtctcgaccatgctgacgtcgttagcggcgtcgcccacggctattgtgtcggcgaggtcgacgcccaggagctctgcgagctgttgaaggcttgcgcccttgtcgacgtccttggggttgaactccaggtagcgcccgatctgaaggtcgtggaggtgcccactttgaggtcagccggtatgcccttctcaatacaccacagctcatcggtgctgtcagagatgcagtagagcaccttcgcgatgggtacgtccttcaaaaagtcgagggtgggctcgtccatcagctcgtagtccatgtggttctggaggcagctgaccttctcgggctacagcctccaggcccagaccttgccggacacctcgcagaggtgcaggctgacgctgcccaggcccatgccgtagagaaagagcgcctccgccttctggtgtgacagcgtgtggtaggtgcgggcctggggtcaccgatgtggttcaggcaaccgccattgtagctataagataggggccctctagggaaacgatgattaatgcccatgctggccgcaaaaggccacgtggctggtccactttggcacatcattgagaattaatcatcgtttccctagagggactctcggtagcatgagccagcagctaaaataggtatgccgtgggtcaggtttctatactttttggtatctgaacgactacgagtaacgcctacgctagtttgtacttagatgccctagcctttccgacgcgtttgacagtgccgtctttgatgagggctcgtatagctgtgagcgtgcgatctcgggtgaggttgcacacgacctgtaattgcgcacgggagagttctgtgccactttgaagtgcccgcacgatatcttgttcatcttttgtgcccttgtgtgctgttacaaatggcagcataactgagatactctctggtccaatccgaaagcttggagtacatgatgtctcttcgtatgcggcttttattcgaggtattcctgaccccaaactctcaatgagctgcaggcgcaaaaacagtccggccaagatagggtttctaagaacggatactctgccttctcgatactcgaattcagttatgccagaaggaagtcctccaggggaagtgatggagacctgcccattgttgatggcgacttgtacatttgcgttgacatcccatgtcctgtggacgatggcattaacgtaggcttcacgaaacgcacgtgctggcactaattcccgccgctctctgcgggttctgtctatcacttcgacaacgcagtatgtctcgtaatagtctaaagctagttgatactgctggagaacagagacgccagagttgctggaacgggaggcaatcacatcaactgtcgagccatatctgacaaaatctgtgcctgggaaggaattcttatctgctacaagtgcggctgcgttggtataaccgtctctgttgagcaggcccagcgacttcagaacgttgccatctgtattctcgatgtttagagactctcgcaacgtggaatccaaaatcgaaaaagatagatcttgttgggaggagggaagcgagtcgaatgttctattttccccttctagcacgagacgagatagggcaagacgatctactggcgccgacgctgagtcgtttctgcaatacgccttgccatgatagaggtagggcttatctaagccctcttctactgtgagcgttacgatactcgattgcagatcgggaagtaggctgaaacggggtcgtggctcaattgaatcattaattttgttttctatatccaagcaagcttgaatcggattgacaagaggcgcaggggagccatcgtcatcgatgccaaagattattttcccgcgcccatagttggcatatgcgcttactgtttttagaaatgatgatgtgatggcagctttatattcaagactcggtccctcacggttcatggatgctcctatctactggggatagcatcgtagagaatcatagcatacgatagctacgataaagcgcatcgtagctatcgtatgcctacgaaaccgagattcgtatgaaagtggagaaagacagtacagggtatttactgctgcgtggcgatcctagggaaacgatgattaatgccccataacgtgtcagaggggaccaaccacgcagcctttctaggtctgcatgcggaaaaggatgcccatccagcacgtgcaggagccgccatcctggcatttgtcctgccccatgcaccgcaagaaggctccaagacggatcaggcgacgctgagagccggaaaacgcagcctgccggcagaagatgcacatgggtaaggtttgcaagggtgaggcagacatcgagtgtgcaggagttcttctctatccctttgtagcgtgtcttcaagtgcccgaatcgtggattggctacacttagctggacgctttcatgagagacataagatacgagagaaaggagtcccgcaatggcagactccaggtatctaagaaagttccacgagagaagttcaagcgtcagatggttaagctctacaacaacggcaagtcgatgtctaagatactgaaggagtgctcgaccttgcattgttgggtgagggcgatccataagagcggctccaccagggtcgcctgcaagtaggacccctaaggagcaagagctcatcgagcctgcagggggaaacaggcagctcagagggaagaaagatcattttaaaacaggcggcgttgatattcgcactaaggtagccatgacagaggaaagctccgatcactacccgatatctgcgcaatgctgaattgacctgcatccttaagcgcgccttcgacgctcacgtaccgcaacacccaccttacaggcgagctggcctacgtgtgcgtgctttgcatctggcacctgagtctgtctgcaccttgagctggacatctgccatatcggcgatcacatatccggcgcaaggaagcttatgaagtcagcctttgtaagcgtggtgttttcgctctttgccaaagatgagctccacatcaagtgcggctttaggttcgacagtgcggcgataggcgagctcttcgagatcatgcaatcgaggtgcaagaagggcttccctgtgacagcgctatcgtcgagtccaccaacaagatacagaaagccgagtttgtctactgcaagagcttcgagagcttctatgagctgcaagctgagcgcttaggtgtggtggtacagctacgagcagatgcacttaaagctaagttagatgagcccgatcgagttcaggggagagtccctcacgattccgtccaaatagatgttgccaatccaaccctcccgagacaagcgcctagggaaacgatgattaatgcctatgccggctgcgaaaggccacgtggctggtcctttctggcacatcatcgggaattaatcattgtttccctaggagcttgcagaggctcatgggcttgagctcgtatcggaggagatgtatctcgcactcgaagaggtagaaccactcgacgagaagacgacgagctagatcctgagacctcgggatatgcgggagcagggagctgctctcttcggatccaggagatacggccgtactttcatctgctgcaatggcgccgatgtctactatgcgtcgcgcggcttcagagcctgcctgccgcttggataggcgagattagaatagcgaaccatgaagaagggtacccgcctctgcggacgctcaacgtgtgcgctacggcatgtcgcggatcctagaacttgatgggcggagtctgtcgggctgccgcatctcctaccttgaagccttcgcgcttttggaaggaggagccagcaacgatgttgctcggggaggcctgggctgcactgttgtaggagagcatgcaatcgttgtagctctggcgagcatagaagacacggttctcggcgtcgatgagctctgcctggagctgctggaagtttgcattggccttgaggttgggataggcctcggagacggcgaagagctggcggaggaccgcagtgagttagttgtcggcagcaaggcgctcgctggtcgtcgtggtgctcgtcgttagtgacacgtgctgccaccacggcctcaagcgtctcggactcgtgcttcgcatagcctttgacggtctccacgaggttcgggatctggagctgggtgtcgattgtctgcagcgcattgttgcactggctgttcttctcgacgatgccattgcgtagagtgatgaaccagatagcgaggataatgacgattgcagcgatgataagtgcggctgccgtcgaacgtcctttctgaccgggacaccgcgtgatgcagtacctgtgacatacaacaggtagctgcattgcaaaaatgacggggaggggaatttgaaccctcaagatggctaggccgcctggcggttttcaagaccgctgcattcaaccgccctgccatctctccgtgggcgtttaacatcgtgctccaaacagcatgtcttcagaacaggcatctgctgtaggggagttctgtgcagattcctgaatccgctcagtgaaaattgctggccgttcgcaggctgaactgaagcgattccgagaaggggctcgatgttgtgcttataaacaaaaaatatgtttataatatctatatgctcggctttgaagcagtatttttgactgcttgaatacagagaaatggtgggaggaggctacaataaggatcctaaaattcgagattgacggtgacaggctttacaaggatggaaaattctcgatggatctctatgcgaccgatcgcgttgcacagccaagagatgggagtgcgttgcgtggtgtcatgcgtttaggcaattcgaatatctatacgcagaatgtcatcgcgctttccggtataaatgcttccggcaagactaccactatcaacctgctgaggatggttgctgattacctctctgtgtcttctgacatgcgttacgatcggtattcctctgcgacaattccggcaaagctaaataaaagctttggactgaaggcaatattttggcacagggacaagtactatgcgctggacgcagaacttggcagaggcgcggcagattcgatagtcccttatgtcatccaagacgaaaggctctacagatttaaaaagccgtatccgacaaaaaaagaactagctacgtttgatggcttcattgctcaatccgagctgctaatacatcgtgccgcgcaggataatgaacctggtgcactttctgctgcagagaagacgttcctgcaggacaacatgagtgtcgtttccgcaattattggcaaacgcgtgaagaagtacgggattgttacagggcatctcgaggaaaaatcatatgcaacacccttggtcaatgccttcgatggaagtatcgagtctcttggatgggatccggagagcgaagtatatcgtctcaagttctacggagagccagaacgtcagcttagccgcaatgccgcagagagccagctttcaagcggcaccttggttggtgccgctctcgttcagcatgcaatctatgttctcaatcatggtggcatcatgattgtggatgagattgagaggggactcaacaagtctttggtcgagactatcatgaacatctttctctctcccacaatcaacaagaatggcgctcagctcgtcttcacgacgcactatccggaaatcattgatgggctacccaggaaagacgacgtgtacctgctggtacgcgatgagtcctataggacagaggtcgtcaaatattctgaccgggtccaccgcatcgagaacaagaagagcgaggtcatcctctcgaaccttatcaagggctccatgcccagctatcccaaggtacgcgatcttatggcttatctccttgcttctgtgaaggacggtgtcaatgaatcatagataatggctaaggacttgcggcacagttaggctccataaactgtaagctgcttagacaactttggctgcagtgtggatgtggttgcgatgtctgcgagcgggatgtgtataaggcacatcccgtcgaggagatcgacaccaagcatcgaaagaatccctgtggctgtatctttagctgagtaagtcggcatacgacttgtatatgggccttcgaaaggctatggaacgctccttcgacatatgccttgatattcgagatgattctgtgggccccggggaagtgaggtgtcatcgtctgagctgtcgtattttttctggacgagcccgcagaagcaatccagccctgccgatatctcgcttccaggcatcggcacagatcttggacatatgacagaggtggtcgtgttcgaactgttaccaggaatctgtgcagcgcaggacgcagcagccctgtccatcgcagtaagcataggctgcttgctttgtgccgcatcccctcgtgccttttgatcttacttctatgtagaagtcgtcgactgctgcgcattcagcagaaaggacgctggaggcacttcgatcttgctatggcacagcggatccttaccagtacgtgtccggctgtcttgtagctgcatcctgcctggcgctgatccctgcctttctgactggttatgaaccacatcgcgacgaaccacttcctcagggcaagatggatgcccctccgtcatcgttcctgcgctcacgctgagctggtgtgagcaccttcgtacactgccacttgtgcgcatgatcccgcaccttcgagcagctcgtggggccgcagatagggcatacgaacccttgcgggaacttctcctcgataagcctttgctcgcaggacttgctcgtctgagaacctctccagaagctccatcaaaggtccttctgctctcacattccttcatgcttaagtgcgcctgcatgctccttggccatatcttcccccgatctttcggatgcatcaacccttcatctatagtatgcagttcgaaaccgacaggaagtgttgggcttatgcttaaagtcctcagccattatggattatttgctggatggagctacagtcgcagctgcgcttgttttaaacttttatactcagaacaatacagccctgtagagccagcggaagaacgagaatacgagtccgagcagtctccttgcatgattgcatgattgtccacttctgtcggacggctactctacctcgtctgggacaatggcatcgtatcaggataggaattcgtaactagtgcgagccgtactcatcagtggggacacacttctcgagcaaacgttgtagttccttagagcacctgttcaggtattccgaggccttgtccttgttcttggctgccttgcggtcggattccctgcccctcgacttttctgcctccagctcttccttcgccttgtcagcaatattgtctatctggttcttggcacggcggatgaaggaggttacggagggggagtctgtgggtaggttgctgcagaaggtgagtagtttggcgcactcgtccaacacgaacttctcggatatgggggacccaactgacaccaggcctgctacgcccacgcccgctgcagtcccgagcagtgtgccaccgcccgcaattatggcagtcccgcctgccatacccaggcctcccgcggcaagagatccgccgcccacggccgcgaggctcgcactggtgagcgcagctcccgacagccctacgaccgcctcaccggcgagggctgacgcaatcaccggcgcgagcgcgtatgcgaggccccccgtcgccacaccgaggagggtagcggctccgatctctgccgccaccttctttgtactacccgagagggatccgacgtagctccggtacttcttcaggatgtcgtctatacgcttctggcttaccacgtcctgcgaactggagaagcccttctttgtgtagtcaaccgtgtatttgatacccttcagcttgcgcttccacgtgtcgtcgaaagggtagtagggcctgaagagacagagctcgagggtgagcaacgtcagccaggcggggtcgcttgagcctgcagcgcctaccgccgcgtcgagttcgctccgcgcgccggcctcgtcgaggaagtattcgtcggcatcagcacccatccgctcggtctgtgcgctcttgaatgcgcggagccactcgagcttggtggcctttagcttctcgtccttcgtcgcaagtgcgtccttctcggtcgcgatggcctggtacgagagcaagatacgggcctgcctcgagctcagcgcgaggagcttgaagtcgcgcgtgaacgccatgtcctcctcggccttgtgctcgaggtagcctcggaggtcgtcggcgatgtcattggcgtcgcccccgatggcgactaccattcgggcgattccgacgaagttgacgttcaacaacatctctctggcaaataccgggacgctgccaccgaactttgcgccggcctccgcgcaggcgatgcccaggttcgtgaagacaaagaccgagctcgatatggtcagcatcctcctgagggatctggtgccggagggcacgacgcgggacccgtcgatgcggctcaggtcgcccagcgatcgggcgtcgatcctcttcagctcccttgcgagcctcgtcaggaagtaatgaccccttacgagacactcgttggctatgacggatttcgcctgcgaaagggcctggtcggcaaggccgacctcggtgcggaggtccaacctgacagggtttccgtccttgtcgcggacagcagtgccgttgaacagcttcgagatccactgcgatagggtgatctcctgctcctcgtagctgacccgcgcgttgcggaacagggacagcgatgagagctccttcatcgcggaaaggattgggccggggatgccggtgccctccatgatcgagctgctcgaccccgccatgtcgctcacgaggtggaggctccagttgatcgtcccgaacaggatcttctcggggaagtccctcccgacgagcgccccgtcgggaaggtcgaacgatgcaaatgacccgtcggtcagggttccgtagcccctcccggtgaactgggtgaggatggacgtgatgaggcctacgggtgagggatggtgggagaagtctctcaggtggtgctgcagcccgcctccgaactcgggcgtcagcttgtctgcggccagggggaacttccgctcgaggaagcgtatcgcgtcctcgaggcctcccttcccgagcccctctgatttggcgacctggacgacgaagtcctcgactttggccttcccccagctgtgggccctggagatatcgaaccgcttctgccacaggacgttcagcgcacccatggaggcaccgatggccgctgccgcgatgcagtcctgccggtccgcggcgtccacgttgttgtcgaactcgatgttaagaaggtcggtatcggcttgcatgtctgtgccggttgtcgcagacggcagtgcaggtactgtctcgaggttgaactgtatttcgatcttctcgtcgtccaactcgctcatcctgagctccttcactgtacccatagttgttgatgtaaattatcgaatggatgtataagagattcttcattcagtaaacggtgtcttggaacctgttccacagcatgagcggcctcacacttggccggcgctcagatccgaaagggattgagggaacaattcctttgagatgcaaggtagtgtcggcgcaattgcaaccgcgatattattgtcagtgttggtgtaatgccccctcctgcccggtgcaagaaggccgtcctggatccggaatgctaggcgctattctatgccgtttccatcccgtccgcaagctcgaggttggcgtctattgacctgtgtcaatatttcggatggcagattgtcaagctgagtgcaacatctccctaaagacctcgttggctatcctgtatttcaggaccttcctcgccctgtcacagataagctccaccgcatgctgcacctcctcgtttgtgaccttgctgaagtcgctgcccttaggggaagaactctagcaggagcccgttggtgttcttaactgttagcttctgccatagatggtgggggtcgcagaagtagaactgcacgcctcaaagggcctttgtgacatctgcatgccctgcgaactgcttgccccacttaggagtgagtgtctcgagcggacgtccctgtagcagcccgacctcggccttgaagacgctcttgctgtcgtgctggctctcttcgcggcaagcagcctcactgccctgtcggcaagcacaagcaggcacacgggtctcgctgccacgagcgtgtcgtctgccccctctccgaggcaagacctctcatcggcctcttgggcctcttctttacgctgtgtaagatcctgatcttgcccctggtcttaggcctcttgctgcgcaggtggcgccgcaccttgccttcgggaccggatcccggcaggtcgagggcgcctgtatggacctcacggtaaaatagtcggcaggctcaatgacgcacctgccgccaccctcgagcctgagatatagtctatctcctccagggaccagtgtctgtccatgatgagtaagcgcaccttccgtgcaagtgcagggtctgaaagccgccttttcgccctgcatctcctgcggcgttcatccgccctccttttgggcagcacatgccctaaagcggccgtgacggctgtttctcttgagcttgtggcagacactggagctgtccctgccgatctctgccgcgatatagacaattgaccttcccttgtgccacgccgctcggctatgcagtccctctcctgtaggcttgagatgcttgtagtggcacattccttcctgctttcgacgttgacttggataaccaacatcgtagccttccggagtgtgccacgcttgcatccagcgggccatcctgttgcacttagaatgctaatccgccgtccgaaatattgacacaggtcatgttgtcctgtatgcttcagcccaccaccatgtgtgtgcacagatcgtgtgcgacggcgagatatataaagcctgccgtggtcctgcgataggttgtatcacccgcgagcttggctgtcggcacaagacacgaaaagtcgcgccgggtgagggcgctgcgctcgggggtatcagatgcgggcagcgtcgttctcttggaggcattggatcagatgccgcctatcccagttcagccatgcaccttcgcacgcggtagtgggtcgtgcctgtaaattttgcgtaactttggatctcctgtgagcttggatcagacctagcaaaagctaaagcgcctgtcgctttcctcccatatcgcgcagatggcctccttgaggggaccccataggtcctcaccgcctttggccttgagccatctgtagaagtgagccctgctcacctccagtacgcgctccatcatcgagacgctgtaggttgccctcttctccagcatgagctaaaacctgtccttcaacagaggcttccggcgaagaaggctgccactttttaggaacttattctcgctctcgagctcgtgtatgcgcctgttcactgcgtcgagctgcttgtgctcgtcggtcctttcctgggtcacccttttggtctttgagtgcttgatgatccagtcgtttaaggtcttgtcgttgacctcaagcttcgcggcgcatcctctgatgctcttcttagggttggccttacgtgccttcctgtagtagtcgatagccttaaggcaatacttcttcagtgtagtgtttgggtgtttccggcttcgtgcgggactttgccttctctatctcgcttgcgctcaccgacatctcatctcttcaatctgctggtgttggtaggtgggtatctggacagagcatatctgttgccagtccctgaaccctactgtccaccaaaagattacagctcataccttgtcggcggcaaggccagccaggaagccagggtcgaggttaacgaagccacgaagaaggcgcttgccggcgaggtcgtgctgaccgtgacgctcgacaggggcaaggagttcttagatgcagaagggctgcgggaggcgctgggggctcctggctgcttctgccatcctcaccatctttgggagagggggaccaacgagaacaccaacggccttctcagggattggttttcgaagggggtggattagcattctaagtgcaacaggatggcccgccgaatgcaagcgtggcacactccggaaggctacgatgttggttgtctcaatcaacgtcgcaagctagaaggaatgtgccactacaagcatcttagctctcaggagagggactgcatagccgagctgcgtggcacaagggaaggtcaattgtctatatcgcggcagagatcggcagggacagctccagtgtctgccacaagctcaagagaaacagccgtcacggccgctttagggcatgtgctgcccaaaaggagggcggatgagcgccgcaggagatgcagggcgaaaaggcggctttcagaccctgcgcttacgcagaaggtgcgcttactcatcatggacagacactggtccctggaggagatagactatatctcaggctcgagggtggcggcaggtgcaccgttgagcctgccgactattctaccgtgaggtccatagccgccgccctcgacctgccgggatccggtcccgaaggcaagatgcggcgccacctgcgcagcaagaggcctaagaccaggggcaagatcaggatctcgcacaccgtggatgagaggccaaagcaggccgatgtaggctcacctcggagactggggaaacgacacgctcgtggcagcaggacccgtgtgcctgcttatgcttgccgacagggcagtgaggctgcttgccgcgaagagagccagcacgacagcaagagcgtcttcaaggccgaggtcgggctgctacagggacgtccgctcgagacactcactcctaagtggggcaagcagttcgcagggcatgcagatgtcacaaaggccctttgaggcgtgcagttctacttctgcgacccccaccatctatggcagaagctaacagttaagaacaccaacgggctcctgctagagttcttcccctaagggcagcgacttcagcaaggtcacaaacgaggaggtgcagcatgcggtggagcttatctgtgacagggcgaggaaggtcctgaaataggctcttcgctacttatggtgggtagcacttctgcatccccttgagggcgtggcctttaaacggcagtattttccccgacaggtggctgcgttcctaaggtgcgatatggatgtttaaggcaggcatgctggcaagtctctttaagaggtcccagggggcttagggacgaatgagagctctgcgatgtctggtttaaggagcgcgagggagcgcaagataagctccatgtgagggtagcccacaggaagggccaggtggtggagtgccccgtatgccacaggaagtgcggcacctgtgacacgcgcgagaggaccttgtggcatctcagcatccggcaatacgatacgatcgtgcactgcaccgtgcccagggccgactgccccaaagacggcgtgcatgccacaaggatgccctgaaaggtgcggccgaagacgcacttcacagcgctctttaaggcacaggtgataagtgatggcgctctttggcatgagcgtgacgccggtcgcgcagcagctgcacgagacagcccacgcgcatatggaggctgctgggcaaggccgtcgacgaggcgagggatgccgccgactactcggatgtcgtgcgcgtaggcatagacgacaccgccaaaaggtgcaaccaaagctacatcagcatcatggccaacctcgacggtcagcgtgccatagccgtcacgcaggacagggacaagggggccttaggcaggctctgagacgagcttaaggagcacaggcggggaccgcacgaaggtcttagaggtcacgcgcgacatggcttaaggcctattcgctcggagtggcggcggagatgccccaggccgcacagagcgtggacagcttccatgtggtgcagctcctgatgagggcgacagaccatgtgaggtgcgcagagcggcgcgagtcggcggagaagcgctggcagctcgcagggacgaagtacgtatggctgaagaagaaggagtcgctcacaaagctccagctcgccaagagggaggagctcgaccctgcgaagacccatctcagggaggcacgcgcctgccagatgggagaggcgctgcaggacgtgtactcatgcgctgacagaaaatcggcggccagggccccagagcgcctctgctcgtggatggcgcactccaatgtccggaagatgaagagcgtggcgaggaccctcaggaaggagcgggaggggatcctcaactggtggaagagaggatccaccaactcgttcctggaaggcctcaactccgtcgtgcagtccgtccgtagcatcgccaggggcttcaggagcatcacctacttcaggacgatgatcttcctcaggctgggccgtttggacttcacagcccagaagaagctggcatacgctacccactagaaacagcgaagagccctgaaatacaggatagccaacgaggtctttagggagatgttgcactcagcttgacaatctgccatccgaaatattgacacaggtcagggggcctagcgctcacatttcggttcacacattgtgcagatgcctcagatttttgcaccagcctcaccaaacgcagaggcaatggcaacgccaatgccaatgccatgcgatgctccggtgacgagagcggtctttccctctaagctgcacatccctttactttccattaacagtctcctttcgaaaagctttcgtttcgatgaaatcgattgagaaaaaataaatcgaccagttggtttctattgaattatgaaaaacgaaagaattcgaaagaaagtaagctataaatagctaaattcttcggaactaagtcatttcgataatccgtctaatgctaataataacgcactaaaatctgaataatagcagataaaagccctgttagtgattttataaagtaagggccatcaaacatatttaaagcttttactacttaagaaccgtttacgaacgaaaatataccgttgacctacggtacaaggttttgcatctcgtaaggtccgatagtaatgatcgcgagctgaaacagacgggagaagccaatggaactcaaggaactgcttgatgaagacatcatcgaacttaatctcaaagctacgacaaaggatgaagtgctgcatgagctctctaagcttcttctggcacatggatacatagacgatgtcgaaggctttgttgcagacatctatgcacgtgaggcagaaggaattaccggcatgggtgaccatatcgcgatacctcatggtattagtcctcatgccaagaagattggaatcgcgattggcaggacctcttcgatggtcgagtgggagagctatgacgacgagcctgtcaatttgattttcctgttctgtgtttacggcgatgaaaattccgggacttatacaacgaagctccaggcggaagccgagcttgcaagacgtttgggtagtgctggggttattgatcagctccagcacgtcaaatcaaagggagagctggtggatgtactgacgaagtagctatagagtctacacaggggttcaagagaggatgaacgtcatgaagattgtcggagttactgcctgcacagcaggaattgcgcacacgtacatcgtcgcgcagaagattcaggaagccgctgaagctgctggccaccagtgcaagattgagacacagggtacaatcggcgcggagaatgtcctgaccgaggatgagattcgcgatgctaacgtcgtaattatctgccatgacatcgctgtcgataagagccgcttcaagggtaagcgagttgtcgatatccccatcaaagtcgctatgaagaatcccaagagtctaattgcgacgattgagaagaagctcaacgagtaatcgttgtgttttgaagcaagcaaaggcaagaggagagagaaagaagggggggagttcttatggcagagaagaagaagttcgagattcagaagccggtcatgacgggcatttcctacatgattcctatggttgtggcaggcggtattctcggtgctctggcaaagggcttcggcggttacaccatcggttcactttatgacactacgggttgggcaacaccattctctggcatggagccatttacatggcagggcttctggtggggcaccaacatgcttggcacctatgcaatgaatttcgcggtagctgttcttactgcaggcattgcttacgctattgctgaacgtccgggcattgttcccggtttcatcattggctacacctcggccatgtcaaaggctggcttccttggtggccttctcatgggcttcgtcattggctactttgtcctgtggatgaagacgtggaagctaccgaagtgggctgttggtcttatgccggtattcattatcccggttgtttctacgcttgtttgcggtggcatattcctctgcttcatcgttcgtccgcttgcatctgtcatgacggctttcgagggctggattgtctccctcaatggcggatctaaggctgttatcggtgctgtcattggcgcttgcatgggcttcgatatgggcggcgttgtcaacaagacggcttccatggctgcaaatggtctcggtgccgatggcgtctatggtcctatgtctgcaaagattatcggcggtatgactcctccctgtggtgtcttcattgctagcctgcttgccaagaacaagttcagccaggcagagcgcgatacagcaatcaccgcattcccgatgggcctctgctttatcactgaaggcgttcttcccttcgcagctgcagatcctcttcgcttcattcctgcttcgatggttggctctggtgtcgctggcgctatcgcggttggcgtgggtgtcgaatcggtcgccggccacggtggaatcttcgtcttcccgatgatggccaatccactctgggcagttatcgctcttgtcgtcggctcgtttgttaccggcatcatctacgcaatcatcaagaagaagccggaagaggaggagggtgccgaggaggagattgttgacctcgacatcgacttctaatccgaagccttaaaggctgattcaacctcaaagaggaagagagtttaagctcatgctagtttctatgaagagcatcctcgatcatgctaatgagtataactacggtgtcatggcagtgaatagcatcaacatcgagatggtgcgtgccgtgattactgcggctgaggaggagcgctcgcctatcatcgttcagatgggtcctgggcagattgcaaagcacgctcatcttgacgaaattgttcctgtcgtcaaagagcttgcgaacaaggctaccgtacctgttgcctacaacctcgaccatggctccaagctcgaggatgaaattcgcgcaatccaatatggattcacaaatgtcatgattgatgcctcatctcttccctttgagaagaatgtcaaggagacttcaactgttgtaagtctcgctcatccgatgggcatctccgttgaaggtgagcttggccatgtcggacaggctgctgatggtgacggacgcactgataacatgtacaccaatgttgcccaggcgcgcaagtttgtagatcgcacaaagattgatgctcttgccgttgctattggaactgcccatggcaactatccgaagggatatgtgcccgtcctcgacttcaaccgtcttgccgagctcaaggatgagctccagatgccgcttgtccttcacggcggctccggatcgggtgaagagaatctccgcaaggcagttgcgggaggcatcaacaagattaatgtctgcactgatgccttccatgccgcaaaggatgccatgaccgatcttcttgctgaggatccgaaggctgatttcttggctcttcagatggcggcagaggctggtgtgaagaagttcgtgaagaactacattcatatcatcggatctaatgatcagtacgtttatggcggagcctattcggattcgaaggaatagctcctacaggggtgcggtacatctgtaccgcaccccttattctaaaaacgttaggaagcaggatagacaatgaagattgcactgattaacgagttctcgcaggcatccaagaacgaaatcattctctcgactctgaagaaggttgttgagcctctcgggcatacggtctataacacgggcatgcagcaggtcaacaacccgaatgatcttccgtcggactatacgcctgagaacccgcgcctgacttatctgcacattggcatccaggcagtgctcctgctcaattcaaaagccgttgactttgtcgtgactggctgtggcactggccagggtgctcttatgagctgtaatatgtatccaggggttgtctgcggctactgcatcgagccgaccgatgcgtatctgttccttcagattaacgatggcaatgctctttcgattccgtatgcaaagggctttggctggggcgcagagatcaatcttgagaacatctttacgagggccttcagctcgccgaagggtatgggctatcctgcagaccgcaaggagtcacagaatcgcaacgtcaagcttcttgatgatgtgaagaggcgtgttgcgaagtcgcttccggatatcatccgtgcactcgatcccgagatggttaagactgctctcacgggtcatttccttgattgcttctatgccaattgccagaatccggagctcgaggcgcttgttagggaatttgccgagtagaagctggctgacaaacagtctgctgtacacgagacgtgatgcgacgatgccataggtttaggcgtcggcgcatatgtcttattaggagagatgacgatgcaaatctcagaggtgatacagcttatatctgcagcaataggaattggtctgcttgcgaaagttcgcgtttcgtttgcaaccagagctgcaaaggattctagtgttgctgcttctaaccaggtagaaaacaggactaggattgctcctttgatttgtatcggggttgcgctcgcactcgttttctttcccttctagctttcattgcatcggaggttctcatgaatctgttcagctatgattcgacgcgaccgctcgacatcattttccttggcaggattgctcttgatttcaatcctgcatacagtgatgttgtcaaagaggagttcaagcctctcaaggatatgcactatttcgaaatgttcattggtgggtctccggcgaatatagctgttgggattacacaccatggaatgaaggcaggcttctttgcaaaggtctcggacgatcaattcggagactatgcattggactacttcaatcgtttgggtgtcgatacatctcatatcactcgttgtactcacggtgaaaagcttggccttacattcactgaaatgctgagttcctcgaagtcggatattctcatgtatcgaaatgacgctgccgacttgaagctcagcgttgaggatatcgatgctgactatattgccaaggcgaaagcgattcttatttcaggtacagcgcttgccgccagtccatccagggaggcggctctcaaagcggtcctacttgcgaagagacttggaacaaaggtcatatttgatattgactatcgcccatataactgggagaacggtgacacgatttccatctactattctgccgttgcgaaagaagcggacatcatcatgggctcgcgcgaagagttcgacttgactgagcatctcgtatcgcctggcatggatgacaaacagagcgcatctttctggcaaagcagaagcgcaaagattgtagtcatcaagcatgggatgcaaggatcgacggcatacacgagcgatggcaagagctattccataaagccattcccagtagaagccagaaagggcttcggaggaggagacggttatggttctggtttcctctatggccttttccagggatgggatattgcgcgatgccttgaattcggctccgccgaagcatccatgatggtaagaagtaataattgctcagattctctgccgactgctaaagaggtggccgatttcatcaaggacgaaaaagaacgttacggtgagatggtggctcgtacttaatacttcctcaataggcttggcttgtgacagggaatgtcattccaatgcggcagacaaggaatccaagctgattcatcagattatgaggattttgatttattgcgtaggcttgctcctgctggcagcaggcattgtcgttcaaacaaagagcggattaggggttgctgcactgacgtgctttgcaaccgcagctgcggcggtcatgcacgtgacacttggatcgatggtctttgtgacctatgtaatctacgttgctgtacaggcttggattacgcgcaaacttcaggctgaaaattcttctcgaattgctgttctcggcgatgatgggtatcctagtggattttctgtcggctctgttcatgtttgctccaaccaatatgttccagcaggtcattcttatgctgcttgggcttgtggtcacggcggtaggagttagcacggttgtaggcatggatatagtgtccaatgcgcctgatggtcttgtacaatccatagccgatagcttgggggaaagattcggaagcgtaaaggtgattttcgatacgagccacatagcggcatccttgctgctttcaatatgtgcgctcggtaaccttgctggctttggtctgacaatagtggtatctgccctgtttctcgggcacgttatcaatgttgtcaataggttcctccagcagccactttatgtcctggcatttggaaactagtgaagataggaagtgcattttatggcacgcgaatttctcgcaccaaagaagatcgtcaatggtgaaggtgctctagctgacgcggcttcctctattgctggctgtgggtcgaaggcacttatcgttacagatttcgttatgaagaagcttggcaacctacagatgctgacagaggtgcttgatgcatccggagtgcagtattcggtttacgacgaagtcaattcggaaccgacagacagcatggtctatgagggggtcaagcgctttgattcggaaagatgcaacttttgattgctcttggcggcggttctccgatggataccatgaaggcaatcgcgcttatgaatggctatgaaggcaagatttctgatttcatgggcaagaaatttgagaagtcaacttgcccaatggtggcaattcctacaactgcaggaacaagtttggaagcaacacagtttacaatcattacggatactaccgctcaggtgaagatgcttatcacaagcgaatcgctcattcccgatattgctgtgattgattcagcatttacaaagagcgctccacatggagttacggcgtccacgggcttggatgccctctgccatgcaatcgagtcttatacttcgcgaaaagctcagccattatctgaagtattctttctgtctgcggcaaaacttatattcgaaaatcttggcaaatgctgtgagacgccagatgatatgagcgcgcgttctgcaatgtctttggctgcgctccaggctggcattggtttcaacaattcgtccgttaccattattcatggaatgtcgagacccattggtactttgttccatgtacctcacggtctttcgaatgctttgctgatggaagcatgcttctgtttagctgctgaaggtgcactggacaagttcgctgcagttgcccggtattgcggaatttcaagcgatgtggatgatagagcggctgccgaatctttgattggcagaattcatgaactgctgcttgaactccagattccaactatgtccgagattggcatcgaacgggatgcatattacaacgcactcgaaaagatggctgatgatgctcttgcgagtggaagcccgcagaatacttggaggcagccgggtaagcaggacatcattgatctctataaagaagtctacagatagggtacttcatggatttgacagttcttgctgctcttgttatcgtactgattgcattccttgtcgcgcgcggagtgcagctttggccttcatataaagggaccatttaccaggagctgttttctagctttcttgagtacttctggcgaatgagatttcagcatgatctgtcatcgtcttcgtatctcaagagcaagattggaaatcatcgcattgtttacaatgcgatccttggcaagaaaggttctaaacttgcggacttcgtgacagtgttcagcgagcatggctttgtgtcaatctgctcgatgccatacaagggcgatatcagctcttcagctggccagggcaaatggaaagtgatgcaacagggcaagactgtgaggataccctctccattggttttgatggcgcagcaaaagcaattcctgagcaagaccataggtggagatattcccatcaattatgtgattgcttttcagaatggctctaccttcgagcatgtgaattcgtccatatcagtggtgacatctaaggatgccattgaagagctttgcaacatgcgtgaaggcggagtaggccctgatgaggtaaacaatgcgttcgaagcgtttagataatatgaagtgacctcacattagtagcaacgtggatttgccgctatacgataggtgttcaacataaagtaagctggtttgacacatacaaaagcagatcaccaatgaatagagtactcaa

SEQ ID NO: 350 - DNA, 31853 bp, Unknown
  Metagenome-assembled genome
ctgtcttctttccttttcagtttaaatctttctctctgttagaccacgattgacctgagaagggtccagtgttgtccgggcctttgcctacaatgcatgtcaccaaacaaagacatcgagaaacggaagggccggactcaatgatactgcagcagatcgagaagatgggcatcgctaagaaaatggcaggatccgctcttgcaggtgagcccaagagatgcttaaggtgcacatctgcagacctcttctgtaaggggcactctgcacaaggccatcatggaagtgttgctcatgtggcaggaccttctcagcgaagataggatcggccacagcgatatcgaagcttttcaccaccgcagggacaaagtatgcaaaagacacgcttgtgggcatgttacttaaactagcttacgaagaactgccatgtgagccttaaggacatcgtgggttccatgcacatgaggctctttgaggtagtggggtctgccctgaagccacccagaagcgcccatatcgtctgctgccaggcagaggggctctcccttgacgagttgcttgcgggcagcagggcaaggtcggatgtgcagatgcgcgatagcacacaggccacggttatgccgtgcactcaagcggcatatcaagtctgaaggtctgcaaagagtgctaagcgagccgggggagcgaatatgcaacacttcgcaggaggctcaccgagtcgaagctaaaggttgccctttcaggtatcgccaacagctcctgggtcgcaacagacaaccatgcaagatatagcgtgcatcctttccttactcggcgttgttgagtacacgccaagcgtggtgaaggagtctagggacagcgagaagcggccttgtcaatgcgatgcagcgaaggctcaggcaagttcttgctttccctctatggggtgtcgacgaaatggctgcagtgcttgcctcgcctgcttgctgtggacaaagcagacgaaacattcgaagcaggacagcaaggcgatgctctcaggacagcccacagaaggcagctatgtacacacgaggcacgcttgtcgacatgccccagcctctctgggactggtggaaggcaagggtcgatgtcaatggtggtcttacagagagaagtctttttagaagggcgaatccccactccgagtgcaacagggaaatacaagctagccgcccaggcgtgacctatgatggtgcttgcaaagacatgcatcattgcaggtaccatggacggctacagccatcttagcatcgcgaagcgcgaggacatcatggtttgctggaagggccataagggcatcagccagatacgagggagctcggacgggacaagttgaccatatcccacaagatcaggcgcaacggatggcaggggccttccggaaggccctgccgggcatcgagtgcgcaaaggcgtgcagacgtaaagcagctgtgctgcaggcgccccagactcatggacggcccgcataggcgctctctggtcgtgcagctcatgctgaggagatagcgggccgcatcgcgatggagcgcccggaccttgccgcaagcgacgctagcatctagcgtgctgtgtagtcgggactcctcgactgcgagctttcaggggcgcaggaaagccacaaggctgctcagccatcacggcaagtgcaggcacagcaagggtggccaaaagcgcacaggcaagctgcgcatcacccacgacatctcgaagcggtcagaagaggctttcggcaggagacggatcggcgactgggagggcgatactgtggcaggaagacagggaggtacctgccttatcacccaggtggatcgcatgagcggataccttgtcggcggcaaggcggccagaaaggccagggccgcggtcaacgaagccacgaagaaggcgtttgccggcgaggtcgtgctgaccgtcacgctcgacaggggcaaggagttcttagatgcagaagggctgcagcaggcgctgggggctcccgtatgcttctgccatccccaccatctttgggagagagggaccaacgagaacactaacgggcttctcagggactggttttcgaagggcaaaagcctcgacgatgtcgacgacagaaaggtgcaggaggtgtacgattcactcaactaaagaccgcgcaagcgcctggagtggaggtgtccctgggaggtctaccatcaccagtcgttgcacttgctctgaggattcgccagccaaaagtacagcaaactgtggcttgatagccacccataattcacctgttgtctagactgttagaatgaaaataatcccacttacaataaaagttacaactgttatttccagttgaggatagtgaagccgcaccgtctggctatcttgcgcatggttttatccggggtcacggcataccccttgcgagctgcagaaagcatggcttcatctgagaaatggtcgccgtaggcgtaggcgatttcccactttctcgggccgtaaaccttgtcggcccactgcttgatcgcgcgcggttttgccgccccttcggtgacctcaccggatactttaccggtataatggccctcactgtcgatctccatatcagtggcgatcacctcatctgtccggagtactttttgcgcacactgtgcgatagtgttaaacgttgcagaaactaacactgtcacgcagccctcgcggtggcggcgttcgatctccttgatcgcctgcggacggtagcggggcagcagggactcatcgtggaagtccaccatgattttctggatttcttcccgtgggcactgggagagcgcatcaaagatgacttcgcgggcttcattttgccgatacgggagatgaagcttgtagcggaccccccaccaactgagacggaaaccccggcgaaaccctaaatagtgccggtggttgagatagatcgcgaagagggcgcctgactgaccgctgatacaagttccgtcgtaatcgaataccgcaagctgcacgcagctagaacttgtatttggggtatcccccataggttgccctcccactagaaccattacatatcgctatgcatatcgtttacagtctgttctccatcttatatttcggacggcgtgcatctgccctcaaatggattttgaacataccgaatgcttttttaccgttgtacaaaaagaggctcccgtaggagcctctgaacatgcaatggcgggatatgcgggacttgaacccgcggcctccgacgtgacaggccggcgctctaaccagctgagctaataccccctacagtgcgaaatttattgtacacagagggtggggctcacgtctagtcaaaattgcaaaaagtttgagattcaggcccaactttttggcctctgaaccaaaagaacagctcatagaccaaatcaacaatcaaaatgaatctaacacatcggagagattagccgagatctacatcggtctcaccggaatcggtctggaccgaaagcgtcgagccgttgagcgaggcagattggatcgtcccgttccccgaaaccggattgccgtcagcatccgccaccggcgacggtacggagccatcggccggaacataggacagcacgtcccaggtgccgcctgagaggttctcagggataatgaaggcgccattgtagtggacgaaggacaccggggtgccgtttaagtctacgagcttcgcctgcacgttcccgctgtcgtcgagccgtgccagcgaccaggtgtcaccgtcctgcaccaacccatagttctggtcacggtaggagataacgtcattcgcctgaacctgctcctgctcccgcacctgattgttgtccccttggtttgcctgctgtgcagcgtcaaagaagctgttcatcgcgacgacgatgaggacgacgattgcgacagcagcgatgccgatgccaatgaagagcttgcagttcttcttgtagtgttgggtctcatgctcgacatggggacggttcttcccctgcaaccggaagcttcccgtcttatccgcttctctgagctgggtccgcgccgctttggccgcattctcggcgttatcgcggttcgtaaggactgcgccttcatcggcgctcagtttcctgaaagatcccgtcttcgccggatcgaccccgattggctgcggagctccatcgggcatcaggggatcctcccccacgatcggacgcccggaatttctggtaggggcgttgacatatcccgaaacactggggtcaaagcctgtcggcgattgtgtgccacgacacgtcgaacgggcatgacggggggtatgcttactttcgtgatcgttatttgtgctgaaaggcatgatttggctctcctaccctctcgaaagatcaaacgattgtgtcgcccgaaggaattcgagccccgtcacttcggtcgacatatctatattggtccgtatgaggtccatcgtcaaacacaaccgatggtacaggtgttctttgaccacaatatatagaaaacaatggtctatccacaaaccctgaaatctcagatgttacggcgttcctcgatagcgtggccaagggtcacttcatccgcgtactccaagtctccgccgacgggcaagccgctggcgagcctgctgaccgtgaggtccaggggcttgatcgtgcggctcagatagctcgcggtcgtctcaccctcgacattgggactcatagcaaggatgacttccttgacgctgccgtccgccaggcgcttgaggagctcccgcacatggagctgttcaggcccgatcttgtccatcgggctgatgacgcccccgaggacgtgatacaggccgtgatagctcccggtacgttcgatagcggtcacatcgcgcggctcggacaccacgcagatggtgctgcggtccctcgtcgggtctgcacagatcgcacaggtgtcgccggtcgcatagttaaagcagatcgggcagaagtggacctcctctttgacctcacggatcgcatccgcgaggcgatcggcgtcggtcttgctctcctcgagcaagaagtaggcgatgcgctgcgctgacttcggcccgatgcccggcagcttaccgagctcatccaaaagccgtgtgagtgcgtgaccgtcatgctctgctgctgttgccatgactaaaacattcccgggatattgaggccgccggtgatgtcacctaatttactcgttgcaagctcctgagcgcttgcaagcgcgtcgttaactgccgccatgatcatatcctgcagaagctccacatccccgtctttcaggacctcaggatcgatcgtgatggaggtgatcttcatgtcgcctgttgcagtgactttcacggttccaccaccagcgcttgcggtgacctctttgtccttgaggctatcttccgcagaagcgagctgctcctgcatctgacgggcctgcttcataatctcattcatgtccagttgtgccatggttgcacgctccttaccttgcctgccacaataggatcaaccctcactggcaggcttaccggttgttaccgttgttcttcttggtatcgtctggggaaggcttgatcaccacattgatacctttcccaaagacattttccagcatatctgccaaatcctgaggaattccatcagcttcctgtataggtaccccaggcttcacatcctgtttcttatgttgggtcggataatccgttgtactcacgtgctgcggttggggcgccttctgaacaggctgagccgactcaggggctgctgcgaccggtggagcttgatcatagtccctcggttcgtagtcgaccggttcttcagcggctgcatcctcccacggtgcctgttcttcctgcggtttgctttcagtattcacaggcgcaggggctggttttggctcaggttggggttcaggcgccggtggctgaggccgtggttgcggtatgggctcttgcggagccggttggctgtatggtacaggctcctgaggatctggttggctgttcgacggtgcaggcttggaagccgcgggggcctgaggcggctgaaccggttgtggtgcctgccttacggggtttgctgcccgctgcgtacgtggctttgactgtgaggtctttttggtctgctcgacatactgcggcaccctgttgccaaagaccgcactgatcgtaggacggacgacggagtcgacatcttttctggtgagcatgttcagcgagaaggaagatcccggcgggaactcaatcgttaaggtctgcccatcatccgccaccgcatgggcattcgccagcaaggtcgcctttgccgcatcctgctgtctcaggcgggacacaacctgattccaagcccgctggagtctggctgcatctaagcgcgacgtagtatgcggtgtcaaagcgcttgttgcctgtggagccgcctggcgctgtgccggcgctgtgggctgacgacaggcctgacgtgtttggtggggacgcggctgtggtgcctgtggacggctacctggtcttgcaggtgttgtcggttgcggagtcacgggctcaggagcccgttgcggcatcgctcctggaaccgagagcgcctgaactgctttttccagttcatcgacacgctcagccagaccttcgagcgtcagatcgccctgcggccgggcaatctttgtcatcgcaatctccaactcgaggcgctggtttgtcgccgtcctcatctcattggagacatcgcccaagactgcaaggatccgcgccagacggtcggaggagccaaacagcttcgcttcccgctccagttcctttggatccaccgctgagtccaacaccgcagtctgatcggtccctacgagcgacacgacatagatatcacggatgacacgtgcgagctcacgcacaaactgtaggaggtcttccccatcgtccacaagatgtgcgatctcctcaaacaacgtggggacatcgcgttgggcgatagcggtgacgacgctctcgagggttttgctcgtgacctcaccgagggcgctcttgaccgcctccaccgagatgtcgtcgtcgttgaagaccgagatctgttcgagcatgcccagagcatcgcgcattccgccccgcgcatgttgggcaatgagtgctagggcttcaggatcactttggaagtgctcctgcttgcagacataggaaagcctatcctcgatctccgtaggtgaaagcacatggaagtcaaagcgctgcacacgcgagaggatcgtggcggggatcttttgggggtcggtggtgcacaggataaagaccacatactcaggcggttcctccaaggtcttcagcagcgcgttgaaggcctgagtcgtgagcatatggacctcgtcgataatgtagaccttgtagtggccctggaccggagcgaagttcacgcggttgatgatctcatcgcgcacattgtccacaccggtacggcttgccgcatcgagctcgtagacgtcgggatggcgtccttcggcaatgaggcgacactgttcacaggtaccatcggggagttggcggggtcctttctcacacagcagcgccttggccacgattcgtgccatcgtcgtcttgccggtgccccggggaccacagaagagataggcgtgcgtcaccctcccctcgagcacggcgtgctcaagggtcgagacgacgtgctgttgccccacaacgtcttgaaaggtcaacggacgatattttctgtagagtgactccatctagactcccatataaaaaatattcaaaaggtagagtttaagtatatacgccctcaggctgacaaagaactatcaccttcgacgctccactctaccaaggccgctctacaaaccaaaaaggagcacatggatacgctccacgtgctccttcacatacaggcattaccggatggtaaggctatttgacagctttctctgtttccttctctgcctcagcgtcctcctcagcgatgagtctagccttcacgtcgacgcccctaacgctcattgcgtcagcgtagaccttcttgcccgttggatgctcctcaagccagagctccttagccttcggcgcccaggcctttgcatacggtgcggtacgcttgcacagatcgtcagcggactcaggtgcagcgtaatcggagttgtgtgcgccggactccttgacgaacttcgggagcaggtaggggttctcgagcatcgggcacggctgcagcatgttgtcgttccacggatagtacttgcggtactcctggaagaccggctgatgcaggcagtcaagccagctcatatcacggatgttggcgttggagtagtggatgaagacgcacggctccacatcgccacgggcgttgacatggcagtacgcacggcctcctgcgatgcagccagcaacgtactcaccgtcgttctggaagtccatcgcgaagatcggcttgccgccggtgacgccgcggatctcacggatgcggtgcagcatgtactcacgctgctcgacggtcggcatcaagtcagcattggcaccgtcgccgacgggcatgtagtggaagtaccaggcatagcggcagcccttgctgatcagaagatcgatgaactcatcggagctgacgcgctcgacattctcacgagtgtagcaggtagaggtgccatagagcaggccgtacttgtgcatcagatcgaaggcgtccataacctcctggaaggaacccttgccacggcgtgcatcgttgaccgtcggctcataggactcgatggagacggagaagacgatgttgccgagctcctgcactttctggcagaacttatcgtcgatgagcgatgcgttcgtgaagatgttgaagagcgaggtgttgtgcttctcggcaagcttcaagatatctgccttgcggaccaacggctcaccaccggtgagcatgaagaggtgggtgccgagtgcctcagcctcgctcagaagcttgtccatctcgtcgtaggtcaggttgagctgatgtccatagtcagcagcccagcagccgatgcagtgcttgttgcaggcgctcgtcgggtcgaacagaacgatccaaggcacgttgcactggtatttattagcattttcggtggtattgcgcaagccacggaacgccgcctcatagccgccattcaggattgcggtgtggagcacgtgggggttggtgttgtcgataatgtcgaacaggaacttctcccacttggatcccgggtacagtgctgccttcatgccacgggtagcgcctgggttcgtgtctttcagaagcttggcagccatattgataaaggagtcgatctttttgtcacgatcgggtcctgaaacactcttgatggcttgatccaaagcgaagctgaaagctttccgctctgcggtatgcgctagcttagattgcatttccactctcctttttacttgcgcagaatcagccatactttttagaaaaaatatttttgacgctgattcaattttctgactatgtactttactccctttgtgcgtatgaaatacctaactccatattcacaacagatttttgacgcaagttcaaattttaagtatacccacacatctaagctctgcgcaggcacaccttaaaatgtcttcagccaccccaatttctcaacattctcacggatatgggcacaggccttgtgccacttctcctcttcctcactgtcaaaggtcggcacgaagatcttctcgacaccgctctttccgatcacggtcggcagcgacgcccagacgccgctctccccatagacatcctcaatgcgggtggagaccggggtgatcagtttggtatcgttgaggatcgcctttacaatctcagtggcgctattggcgattgagtactcggtacagcccttgccgccgattgtgacatagccaccacgacgggcctgctcttccagatcctccctgtcgagcgtgatgtcggcctgcttctcaacctcatcaggtctcaggcaccccaagctcacatggctccagcaggcaaactcgcccaggccgtgctcaccgagcatccaggcattgatgcttgaggggccgtagcccgtggttgcggagatcgcgtggcgcagacgcagggaatccagcgtcgtgccggagccgatcaccttgtgccagtcgtaatggccgctctcctgccacagcgcctcagccaccacatcattcgggtttgcaacgctgacccagacacctttgaagccggcacccataacgcgcttggcaaaggttttcacctcgtcggtagtcactttcagctcaccgtcgcggccgttacgggctgcggaaatgtggccggcggcgttgacgataacgtcacagtccgccagctcctcatagtggtcatcacactcaaacacctttgcggagtgcggatagaaggccattgcgtcctgaaggtcattgacctgcgccttgcagaacctgtcgtttccctctttgtcacacagatacagctcagatacgagcccctgagccagaagggcatttgcgacatgctctcccacgtggtttacgccgatgattccgaccttggtaatgctcatgttcactcttttctcttctccaccactggcgctacgtcctcttcacgaagaaagtccgcacaagatttttacgctcaacgctagggcagcattgcgcacttcgtacgcctcttcttatatagtgtagtgatagtttgcgcacatgataggcgcaatccctctctttcagaggactaacgacagagaggcgctaaggttacacgccaagcaccaaaggagctttcccatgggatacaagacctacacctgctcgcttgaccgccactgcggagactgcgaatggcttgccatcccctatcccatacagctcaaacgcaaacaggcttccctcgaagagagctttacctccacgctgcaagaatccggcggcacgcttgcctccattgtcgggatggacactctgatccattaccgcgttgacaatcccgtaaactacagtttacgggatttcggcgtggcccatgtcttaatcgacgtgaatttgctggggtgttgccaaaacacacagttgccgctctgctggcttttgcttgtgtgtaatgtttacggcagcgttgatgtctgcactcaccaagatgctatccttgggttcgctataggccgcctgtaatgtgcttgcctaagaaaaggtgtgcttacttgtcagcgggcttgtattcgatccccacccatataggatgctttggacgtgtaggtctctttctgctgtatgtatcggtatgtaagctagcgtttggacaacctacagagaatctgtatgaacgcttgatcattctttctgccgtgattacttcctgcttgcatcccatgctggatccaacaatcagtgtgtctgtgttcttctctatgcacaggttggcgatggtgcgtgccgctttgagcatgcagtctcgcacacgccgactctctttgtcggccgcctgtcagatttgcctgtgtctagtcggcttttcagatacgccaagtgtgtgttgcaatagtggttggctgacttgagttatcgcctgccaaccaagcgcccatggccggaggtgacgtacggcgagattgtcagcttctatatccactcccataacacagcactcattcaagctaaggggatgttgggctttaagcacatattggattttgaaagcagctgttggctgtttagagagggtacccttgatatagtgcccatccaaacgttcgacatggcccggataggtctgtagaagctgcctgtgagcgggcagtctctacaacccgttcgtgggaagtatcagcaagaacacactaccttttgccctgtagtgtgagatcaacacttgagagtagctgtagttgccactcttgtatcttctcaatagtgcaggggatgctttcaagctataggcgacaccctttatcgtgtgcttggccccttcggcttgcaacatcttgtaggtatcgttggttttgcacagatgatagttggcctttcagctgaaaagcccgcctgcaatgaagagatgctgccttgtttgatacaaagccttgctgtagaggttgttcgcatataggcaaaggcatttcaacttgcgatagtggttggcactgagatggcagctgtagttggtttgcactccatactgcatgcttgtcttacctgcctaaatatcgatggcttgctgtatgcaatatattcactgacacctaagagtgggaagtaccaccttgaacagtcactgtgagcacaaaacccttcgagatacctgctttgctgccacctcatcctttccaccaactatcgaaggaagacactcatcgcttaggtgatgatcacaaacatcacttaactctcactaaaatcgctctgcagcacaccatccaaatactccacatgcaaaccgacaaagaccatatccactacatgatccacctactgcctaagcgagttcgtgcgtactttgtatgcacttaccgccttccacataagggaggcccacacatcatagttgtgccatgtctgctggcatgaacatacgttctgatcaagtggacagctcatcgccaccacaggtgaagtcagcaccgaaaccctcaaacacttgagagctaaggcagacatgattggacggcatttcatcccgcgaactgaagttccacaggttttcataccacaaatcttctacaacgcgcttggaaagtctgacaagactgcggacagtgtggcttttgtagaactgatgctggagattattctggatacgctgagagagacttcggttgtcggcaatccggaagatgggaatccaggcataaatcctcatatacggaagctgttggacactctcggtgatgaggagctttcggctgtggaaattatgcgtcggcttggactttcacacagaccgaccttccggaagaattatctgaaccctgcattggagcgggatatgtggaaattttataccgacaagtcgaaacagtcagaaccagagatgcaaaaagagatagctagtccagttatgcatctaagaaagtgactaagctaccgaccaaatatagcaatcgccatcagagttgagactgcggatttcagacctgtttccccaacctaacccacttgaagcagcgaggaagaaagggatgtacagggccaggcatataaataaggtaaccgattcctccctcgacctttcactttgcacgtaaagtcgcttgttgttcatctgaaaatgccgcttgacttttcccgtggttaacgggaacggcgttttgacatcatttgatgcctcagccatcttgaggtgtttgttgtgctgtatgacgagagagggagcgaccggtagtgtatgagaaccatatagcccgatataaagcgcgtggatgttttctgaaacatccacgcgcgcttatcgtacagaagtgagcggttgcgttacttctctttgacgtctcccgccatcagccggtcgtacatgactttgttggcagctagctcttctgtatcatcgagcggctccaaccccgctgtcccgtacttacgctcgagtgcccgggagagcagccagtcggcgacgccgggatttttgggcagcaacggaccatggatataggtaccgaggacattcttgtacacaacaccctcaagcccggtgatcccgtcgttgccgttgccatacagcaccttacctaagggcttcacgccctcaccgaggtgggttctccccgcatggttctcatagcccacaatcggctgaggggagatggagctttgcacaacaatgttgccgataaggcgcggatctccgtgatcggtgtagaggtccaccaaggataggccctctaccttctccttctccgtcaggtaggaggaccccaacagctggtagccaccgcagaccgctgcgagcacgccaccgtcctcgacataggcctccagttcctgctgttgcctcagcagccaatcacacacgatccgctgttcgcggtcagagccaccaccgataaacacaatgtcaaccccagtaaaatcaggggcactccctacatggacctggcggatatccgcggtaagcccgcgccactccagccgcttcttaaggcacaggatattgcctgagtcgccgtagagattgagaagctccggatacagatggcagatcgtaagacccttttgcgtactactcatgtctctctcccatcttctccagctcagctttcttgggccacagcgccgagtagttgcacagcacatagagcggatggtccttgggactctgcgccagctgcgccaggatgtctttgatgtcctggtaaatcggagcatcgatgcccgcatacttcagccgcacctgtacatcgcttgcccggtgtccccctgcgaaaactttaaggtcctgctctgagagtagccgctcgaaatcgacatcccaaatccaggagatatctttgccgtcattgaagttgtcgttgatcacaaagaagactgctttgggacatgtatccgtctgcaaaagcgagatattctggttaaagccggtcggattcttcgccaaattgaggatcacctctctgccacccaccacaaaatgctgaagccgtccgttctccggatggtacgtgttcagcgtcttttggaagacacccggatcaacgcctacaaggtgtgccgccgtggccgctgcaagcaggttgtagaccatatagacgccgccgaatgtagccgcaatgcgcgttttgaggtggctgcgcagcgagaagtcaaaggagacgccctgtgaggccaccttgacgccggtcgccacatagtcgagcttcggtcgttggaagtcaccgttggggcagtaaaaatccccgagctgcgcataggtccgatagttatagttgagcggggcgccgcacacctggcagaagcgcgcttccggcacccggtccggcggaaggtgtagatcctccccgatgccaaacgcaatgaccttggtccccactctgtgggccctcgtcgcgataccgacgcagagcggatcatcaccgtctactacaagcgtggtgtcaggtgaagctgcaagcgcccgcacaatcgtatcctgcacacggtcgatctcaccggcccggtcaagctggtcgcggaagagattgagcaggatgagatacttaggcttcagctgcggcagaatctggatcgtcgaaagctcatcagcctcgatgatgccccaatcggcctggctacccggaagcagcgcagaagcaacgcctggcgccatgttggcacccgcgcggttgcagaggaccgaaaaccctgacttttccgccgcattggcaatcagattcgtcgtggtagtcttgccattcgtgccgcagaccacgacggagccatagcggagcttgtgtgagaggtccgcaattatctgcggatcaacggaaagcgcaacgcgccccggcaattgggacgcattgtggtgaaaaacggaacgcaacccccaggtgcagagtctgcctaccccggttgcaaacgatgaacgtagactcatgtattgtgtctccctccacagcagaggagatgtatcgcggcatatagagtataggcacgcaggaatatgcttgcgtggcactccatcaccgtagcatgatctgctggttggctgagcttacttactggatcggatcgataacaacacggcgcgaagaaggttcgaggtgcacacgaccctgtgcaagcgcctcgataacgtcaggatagagctcgtgctcgatctcatggatgtgcgcctccagctcatcgacgctccatccctcctcaacgttcagagcccgctgcgcgatgatcgaccctgaatcatagtcactgttggcaaaatggactgtgacgccggtcaccttgacaccgtagtcataggcgtcctgaatcgcgtgggcgcccttaaagctcggcaaaagcgccggatggatgttgaggacgcagttcgggaaggctgcaagaatcggatcgtgtacctttcgcatgtatcccgccatcaccacgtactctacgtggtgctgcttgagctcggtggcaatcacgaggtccgcctgctcaggattcgcatagatcgacttatccagcgtcagcgtctggatgcctgccttctcagcccgcttgagccccttcgcatcggggcgggaggagacgacaagctcgatcgtggcatcgagcgtgccttcctgaatcctgtcgatcatggcctgcagattggtgccattaccgctgatcagtacgccgagcttgatcggcttgatctctttgctcatcgatacaccaccttgccttcgcccgggacgcacttccccatcacaaacggatggagctcttccttgttgaggaggtctataaccttgtctttgtcccgctcagcgcacagcagactcataccgacacccatgttgaaggtcctataggcctcttcgagggtcaaccccgctgccttcacacagtaggtgatgatgggcgggacatcccaatcaggacctgcctccccaccgcggttgacgagcgcattcaagttggacggcagcgcacgattgaggttttccgtgatgccaccgccggtgatgtgcgccatcgcgtgaatcggggcgccggcacgcaggacctccaccagtttgcctgcgtagatggtcgtcggtctcatcaccgcgtcagcaagggattcccccagttccgcgacgggctgctcaagctcctcgacgctcttcccctcgatcgctactttgcgcaccagagaatagccgttggagtggatgcctgagctcgtaagaccgatgatgaggtcaccatcctggacaagcgcggggcccaacatcttggcgcggtcgacgataccgacggcaaagcctgccatgtcgtaatccgtgggcttcataacgccgggatgctctgccatctcaccaccgatcagggcgcatccgctcattgcacagccatcagcgatgcctttgacgatctgggcgacatgctctgccttgagcttaccgatagcgatgtaatcaaggaagaagagaggctcagcgccgagcggcacaatatcgtccacacacatggcgaccagatcctggccgacggtgtcgtggcggtccagcagctgcgcgatcgccaacttggtgccgactccgtcggtaccggaaaccagcacgggatcatccatcgacttataggatttgagggagaagcaggagccgaagccacccaatcctccgatgacttcagggcgggtagtgcgcgctacatcctttttgatcaagtcgacggcacgggccccttcatcgacatcgacgcctgcgtccacataactgatatgcgtatttgctgtcatgcgttatcctcctcatggtattcatggacaaagtccgctatctgcatccgggctccccttgggggcttcgtcaggttgtgtggacgatatccggtcaggaagcgctcgcttgagaagtcatccgggattgataccggatagtctccggtgaagcacgcggtgcagtatcctcctttagggcacgcgtgcacgagccccttgaccgacaggaaatgcagggagtctgccccgatgtacttgcagacctgctcttcactgtatcgggcagagatcagctgatcctgggtcccggtatcgatcccatagaagcagggccacttcacttcgggcgcagcgatcctcacatggatctcttttgcttcggcttcgcgcagcatcttgacgatctgctttgaggtggtgcccctcacgattgagtcatcgaccatcaccagacgcttacctgcaacgttgtcacgcagcgcattgagcttcaggtgcacaccaagctgacgcagctcctgggtcggctgaatgaaggtacgcgctatgtagcggttcttgatcaggccttccccgtagggaaggcccaactcgtgggcgtatccctccgcaggtggaaggccgctgtcagggacaccgaataccatgtctgcagccaccggagcctcccgcgccaattgacgacccatctcgtagcgcatgctgtagattgagctgccgtcgacataggaatccgggcgtgaaaaatagacatcttcaaagatacagcgcgcctgctgccgcggttttacacctttctcagagatcagcccatcatccgagatgcggacgatctcaccgggtgcaatatcacgcagatacttggcgccgaccatatcgagggcgcaggtttccgaggccaccacatagtcatcgtgtcccaaaagccctaagacgagcggacggatcccgttggggtcacggaaagcgtagagcgcattctccctgagcagaacgatcgcatacccaccatcgatcatccgcattgcacagcggatgccttcgcgcagatggtgcgtttgggttgtaaagtaccctacgagctgggcagcgacctctgagtccgtattggaacggaagaagacgttacgctcgatcaactcgcgcctcagctcatcggtattcaccaaggtgccattgtgtgccagcgctatgatcgtcgtcccgatggtcgagaggtgcggctgtgccgattcccagctcttggcccccgccgtgccatagcgcacatgaccgattgcgactttgccgcgcatggctgcaaggtctgcatcggtaaagacagaatcgacgagtccgaggtcttttctgactaggacagtctccccattgcccaccgcgatgccggcagattcctggccacggtgctgcagcgcacgaaggccaaaggcagtgaggcgggcgacgtctcggttcggtccccagatgccaaaaacgccgcactcctcgtacagatggtccatatcgtttgggttctcccccatcgtgtctccctatctgtcacaaccaccatatggtcgatgcaaccgtctacgagtcctgtgcctcagactttgggacacagatcaaaatcgttcgattcggattagttaagccatgatcatagttacaggtgataagtgtcagcacatggtcagcgtgcccgatgaccgacagagcatcctggcgtgaggcagatgccttatcgagcaaatcggcgaggtactgacggaatgcatcggtggtatcgaaattcagttggcggacattgccgtcgcttgccacggtcttatagaccaggagcggttccagctcatagtaggtattgttctcgtccacataccacacagtgggatgcgaatcgaaggtagcctggtcgaccatatcggataccgctttaaacatggagccgtcgagcaggtgatgcccatagatgagcgtctgctgatcgagcatgcccggctcttggttttggtaatccataaagacctgcccgcccagactgtactcgccggtcgcagtgtggcgcaggtaggtatcgttggtggcaccctgatagaccgggtagtcgatcaccgtgccggggatcttgatccagccgacgacatctgaattgatcgcttcgaggcccgcccaatcgataacaggggcatcggactcattccccgattcatagacggcgagctgttcgttgacctcctcctgctgctggtagcgctcatgctgctgccagaataagtagcctgccagtgcaatcaggacgataccggcgatcagaaggatgattgagagtacctgtaagacagggtgcttgtaggtcttctcctgcttttcgcctttgcgctttctcattttcggattctggttggcaccattggtgactacatggtcactgtcagcgagcgacttatacccctcgcggattgtggtgccctcagccccggcgctgtaaggattttgggtctgtgcgtacccatcctcctcattgtcgtacacattggccgcctgctgcccctgttcggcagcagcggcatctccatagttaggtttctctttggcaaagtggcgtgccatacctggttccctaactgctctatgaaagcttcttgttgagatacgcggcagctgcagatttgtcgaagcttcccttggtttccctgtttagcacacccatcattttgcccatgtcgcgtttcgtcgtggcaccgagctgttgtatcagggtatcaatcttgtcttcgagttcttttcctgaaagtacgtggatcagtgaacctaagatatctgcctgcttggagagctcagcgatacgcttagcatggctcttagctccgcccctcttgagaccatcgatctcctgcccagtcaccttctgcagtttctgcactgcagcagcgatatcagcctcagtggcgtcacggcgctcatcgatctcaacttgcttaatagcctggtgcacctggcgcaggatcgaggtcctgaccttatcgtgcgccttcattgaatttttgatctcagttaagagttcttcctttgtcaacgctatctacttctttctgtttaagcttcagccatctttttcttcatagcggcgatcttctcacggtactcaggcatcgttgcacctaaaatctgcgtcgcatagatagccgcattcttggcaccgccgattgccacacaggcaacgggcacaccggagggcatctgaaccatagacagaagtgagtccatgccacccaaatcggaggtcttctgcggaacaccgatgatcggaagcgtcgtataggctgccacgacgccacccaagtgcgccgccttgccggctgcggcgataatgaccttgagcccccgctcctctgcggtcgtcgcccacttctgcaccttcagcggtgcgcggtgcgctgaggcgatctcgagctcataggggacgccgaactcttcgagctctttggtgcaggctcccatagtcggcaaatctgacttggaacctacgatgataccgacaagcggcttttctgccatgaaaatcaaacctccctgttcagtcggtggacacccctgcgccaccggtaatagttattcacccgtcggcatcgacgtatctgacgtcgaactgtcagccgttgtgcccgaatcggatgaggactgcctatccgaggaactggatgaattggtatcggtgttggtggtgatattagcctcattgttgccgagccccaggatttcctgaggcgaccacgtcgtgatctcagaacgcagcttactctgaatatcttcgtccataccggcgatcgtgcaggtgaaattcacacggccgttcgcggaggtggatttcctccagatgaacgtcatgaacgaatcaaggttaccgttcggcttcaggaagccgaagagggctgaacgctggatcttcccattctcatcacggtggacctgcacgtgatagaccacggtatcgacatgctggttgagcagcgcattgactgcgaaggcggttgcctgaatctgggaacctgcgaaacactccattgagtcacgggagctctcgtcgataacggtaacctcgacacggccagattgctcggaagcttcctgtacggtgaagtcctcagggaactgggtaaagccgttaccccattcgacgccgccgcgcagcgcgctggcgaccgttctgacgctgacctcttcggagaggttggcggtgttcattcttcggacgatgccgcaacccacctgtgacaggacaatcaccgcgagcacgaccacgataaagataaccgcgaccttggtgatcgacttctcaacggtatcccccgatgcgtcgtcgccggaaagcggatcgacatcgaccccatgccctttatggctcctgcgggaacgttgccgacgagccttttcctcattgctgtggccagtctcgtcaactttcttaaaaagctcttctgcctgttgtccgctgagagcatttctctgctttatgggcatgtgtactcccgttttcttggtgcaatggcgccggttgttaaaggtaggtaggcagagccgtttcgtgcgcatgcatctacacgcacagagactctgcaccacatagtatcagtatatgcgagaagggcggcaaacaacaaaacatggtggatctgcggccaaacactacagcacggtttttgaacaatcaaggcaccgtccccacgtaggaaccgtgccttggttgtgtctaccacaaatgcttattcctgcttgtcaggcgtcagccgatggaggacggaatcgcagatcagtgcacccaccaccgtctttgcatcttcgattctgccgtcgagcaccgcacttaccagctcagacacatcgaccagatccacgttgataaactcatcgtcgtccggatcgctccgtgcgaggctgagaccggtagccatatagatgtggatcagctcatccgcaaaacccgcagaggtagcgatagtggtcaggtaggccatcttctttgcggcgaatccggtttcctctctgagctcacggtgcgcgcagtccaacggatcctcgccggggtccagtttgcccgcggggatttccacggttacccgtcccagagccgccctgaactggcggaccaggcagatatgcccgtcatccgtcagcgcgacgacggcgacggcgccggggtgcctgaccacatcttgctcccctctcgatccgtttggcagcgtcactgtcagtttgtcgacattgaagagcgtgccggtatagacgacatcctcggagtcgatggtctcttccaggcctttgtcacgggggtcatcttcccccaacaccaggtcacgtttctccggggcacccgaggtgtgatcgtggtgcgaccgttccccatcgacggtataggcatcggtcactctacccagcgagtccagcgcctcattcctcgctgaatctatatcagattgagaaggaaggttctcttgtagcttcttgtttgatcccatgctttgtctctctttgtttagagctgttctcttcctttgatcgctttgataccgatatcgtggcgataggtcttcccttcaaaccagatcttgtcgcaggcctcataggcgcggttacgggcatcctcaaaggtcggtgcaagcgcggtgacatcgaggacgcggccaccagccgtcacgagatttccctcgtcatcgagcgcggttcccgcatggtagacgaagacgccgttcattgcgtcggcatccttcacgccgtagatacgctttccgacctcatagtgtcccggatagccggcactcgtgaggacgacgctcacagcccaatcgttgtcccagctcaccatgtccgggctcagagttcccttgtcgcaggccaggaaggcttcaacgaggtcgcccctcatgcgtgggagcacgacttgggtttcagggtcgccgaagcgcgcgttgaactcgaggaccctagatccgcctttagtgagcatgaagccaccatacaggcagcctgtataggggataccctcgcttctcagctcatcgatgaccttttgctccattgaaaccatctggtcaagctcgccgggcaacagaatcggcaccggggaatagacgcccatgccaccggtgttggggccacgatccccgtcatatgcgcgtttgtgatcttggctcgtcgccagcggaactaaggccttgccgtcgctcagtgccagcagcgagcattcaggcccttggagcatctcttcgataacaaccgtgtagccggcctggccaaactgtcccgcgaagcagttcttgacgccctgaagggcttcttcagttgtctgggcaaccacgacgcccttgcctgccgcaaggccatcggccttcacgacacaggggccgccgatcgattgcacatagtcaaggcaggcctgctcatcagtgaagctcttgtacttcgcggtcggcacgcctgcacgctgcatgatctccttggcgaaccgcttggaaccctccaggcgggcagcggctttatcgggaccaaagaccggaatattctttgcgcggaccgcgtctgcgacgccctccacaagcggggcttccgggccgattattacaaggccgatatcgtggccagaggcaaactcagcgacagcctcaggagattcaatatcgagctccactttttcggccagatcgtacatgcctccgttgccgggagccacgtagagcttccctgcatgcggggattcagccagtttcttcagcagcgcatgctcacgcccaccggagcccaacagcaaaatattgagggttgtattgctcgccacgtttcatctctcctttgccaactacgtaggaagggtgcctggagcacccttcctacctgtcatatccgattaattccagtaacggttgatggtctgctcacgatccggaccaacggtgatgatggagatcctcacgccggcaagctgctcaagaaagtcgatgtagtccttggcctcacgcggcagctggtagaaattgcgcacattggagatgtcgcatttccaacctggcagcgtctcatagaccggctttgcatggtagaacacgctctggtgctccgggacggtgtgataggtctttccgccgcactcgtaggcgacgcagaccttgatctcatccagacagcccaatacgtcgagcttggtgatcgccagatcggttaagccgttgacacgagcagcatagttgacaacgacggagtcgtaccagccgcagcgacgctttcgcccggtcgtcacgccgtactcgtggccgacctcaccgagcttatcccccgtctcatcgaagagctccgtcgggaaggggcctgaaccgacacgggtgaggtacgcctttgcgacgcccaagacacggctgatgcgggtcggtcctactccagagccggtcaccgcgccgccggcggtgcagttggagctcgtcacgaacggataggtgccgtggtcgatatcgagcatcgttgcctgcgcaccctcgaagaggatgttcttcccggcatcaagctggtcattgaggaagcgggagctctcgataatgtagggcttcaagcgctccgcatagggcaggtaggtctcacagatctgatcgaccgtgtaggtcggcaggccgtataccttctctagaatcggattggtgtaggcaagcgccgcctcaagcttctcacgaaagatgtgtccatcgagcatatcctgcatacgcagaccggtgcggttcatcttgtccatgtagcaggggccgacgccgcgtttggtcgtgccgatcaggttcttgccgagctttttctcgtgtgcgccgtccagatccttgtgatagggcatcacgatatgggcattgccggagatcttcagatcctcgcaggagataccctgcttctcgagcatatccatctcgttgagcaggacctcaggatccacaatgcagccgttgccgataaccgggtagacgcctttgtacatgacgcccgaaggtacctgatgcagtgcgagcttgtggccacccgcgatgaccgtatggcccgcgttagcgcctccagcgtatctgcaaactacatcgaaatccccagagattagatcggtgaccttgcccttgccttcgtcgccccactgtgtgccgacaagcactgatgctggcatgtgaatcctcccccagacggtagtttcaactgatctgtgcctcacgatcttaaggacttctccagtatacggcagcagacaccctatgtgcgccaataaggcgcgtgcacagggtgtcagcacaccagcagtagctacggctcgtggtgctggtcgacttccacgaacttcgtggagcctcccaggaaggtcagcggcaccaccccgagcgggcctgaacggttcttcgcgatgatgaagttcgtaatgtttttgtccggacggtcgttgcgggctgcctcctcctccgtcatcgaccgatcgagaaggataacgatatcggcgtcctgctcgatagcaccagactcgcgcaggtcggagagctgcggggtcttaccggtacgcgactccacctgacgggagagctgcgagagcgcgaccaccggtacatgtagatcctttgccatgatcttaatgccgcgcgacatctcggagacctcggtggcgcggctgtcggagcgcctgccgcccgaaggcggggaaacgagctggaggtagtcgatgatgaccagcgcattgccctctttaccgtgcagcatacgccgcgctttagctctgatctcggtgatcgtcgtacccggcgtatcgtcaatcataatgtcaagctgcgagaggtcctgcgttgcctgcagcacctgttcccactgattgtcgcggatattgccggcgcggatgtccgtcagcttgatgcgcgcctgagccgctagcaaacgctgcgcgatttcggctttactcatctcgagtgagaagagggcgacgctcgtgccgtcggccgccgcattgaccgccaggttcagggcaaacgaggtcttgccgacgcctgggcgtgcgccgattacgatcatctgtccggggcgcagccccaagagctgccggtcgatcccgcgataacccgttttgacaccgaggagcttggtgtcctgcttggccatctcgcccaactcgttgtagagttcccccatcacctgttccatggtggagtactcacttttaacgtcggactccgtggcatccagaatcagcttctctgattgatcaacaacctcctggacgtcttcaggcgcatcgtaggcgagcgccgtcacattggaagcggcgttgatcagcctcctcagcgtgctgtcacgtttgaggatttccgcatggtggcgccaactggccagggaaaatgagttacccgccaactcgacaagataggcacttccgccggcccgctgaagctgattcttggatttgaggtaatcggcaagggtaaccgggtcagcctgctccccttcgttaaagagatcacggattgcccagaagatcatacggttcgagggcacgtagaaatcgtcctctgtaagatcgagcagcgcatcctgacgggcgtcttccgagaggatcatcgccgaaagcacggaggcctctgctgcccggtcctgaggcatgccagcctgcgacaggcgcgcagcatcatcgtgtatacccggcatatcttctggattgggcatcgtctctccttccctcgccgccgggggagatacatcacaagtactctctatctatatatgtatatgggcaagcattactatactgcccaccacgctcaccggtggcggaccttcagccttagcctgtctgctaaggattacaacacagatcttaaagactcaaacaatcagcacgatcgagggcctgcctacctgcaaagccccctcttgagcgtcataacactcaaaagggggctcacccataacccataggcaaggcttattctgcaggcagtattactgctcagcaggcgcttctgcagcttcctcagccggcttctcagccccagcgttctcgccctcgtctgcctcagaggcctcggtctcttcctcgggctccttctcgtcaacgcccacgagcacagtcagctcagcgttgatatcgcggtagaggttgatggcgatctggtgacggccaactgtcttgatagcggcagcatgctcaatacgcttgcggtcgacctcgacgttgagctgctctttgattgcgtcagcgatcatcgaggtagtgacggagccaaacagctgtccgtcgtcgccgattctcgcctcgacggtaacagatttgccgtcaagcgtctgcttgagcgcgttagcatcagcaatacgctttgcttcgcgctctgcaatgttgtgacggcgctcctcaagttgcttaatattgccaggggtagccggctgggccattctgttcgggaacagatagttctctgcgtagccctgagcgacatcgacgatatcgccttcgccgcccttgcccctgagctcacccataaggatgactttcattgggacactccttaaatcatagcttcaggcttgcccatcgggcttgtcctttttcggccaatcccgaaagtgggcaagtccatcaacaaagccgaagacactcattacgaaaaatgaatactcaagctggataccgaagatgaaagccagcgcctggccgaacttcccgacaccgtgcgatgccaagaaccacaccatcagtgccaaaccctggagcaccacaaagaagcgggcgccctgcatcaggttgaggccgataaagacgacctcccggggcatctgcgtcccattgcgctgggcaatgtagatcgcaaaccccacaaccatgattgcgaggatccacgtcggtgcctcaaaggtgcggaactgtaccttgtactcagacccaaacgtgaccgagtgtgtgaacatcacgacacccaaccaagcgcagaatccgtagaccacagcgaccacaccgtagagtaacggccagtagagcgataagctctcgcggacccggtcagccatagcctgcatctgtgggtccccgcccacattcgctgcggatacagcctcattgatcaacgaggccatattctgggatagggtcgtgccggtggctgcagagctaactgcgtcacttccaatgagcattgcgacagccgccgcactggtcagtgcaacggtgttcccattgaggcgcttttttgcggtgagcagcccgaaggcaaacccaaccagcgtcggtaccaccacatcgccaactcttaggctcggcaccagaagggcgatcgcgacactcggtgcaagcaacgagatcagtgcagcaaggatccgcttccagcctttttgataggtgcacaggcacgtcccataggctccggcaaaacttgccagcaccgggatataccctgcgactgcacctgcagccagacaccagaacaccccaaagcgcaacggctcaggagcctgattatccgacggctttgtgtcatacggcacaagtccgcctcccatgttcagatgtctgtctctctcatcatccacgttcgcattaactccgctcgagtactcgtcgcgcattagtcgtgatcgcgattgcggccacgaccacgattggatactacgctcaccgcatacggaagcagtgccatctcacgggcacgcttgatagcgattgcgagagcacgctggtgctgcgtgcatgcgccagtcacacgacgcggcttgatcttgctacggtcagtcgtgtacttacggagaagctggacatctttatagtcgatatagtccactccatccttgcagaactgacaatatttacggtgctgttggcgctgataatcttgagacttgtcctttgacttcctcaagtgtcaatcacctgatttctttgcttaaagttactagaacggtatgtcctcgtcgtagacatcggacgaaggcggtgcctgcgtcggacgatcctgagagggccctcctgttgaaggcttcggggccggggcagcaaagctttcgctttgatttctgctgccgtaggcaggcgcctggtctgagccaccataggaagagctctggttgtatgaagcgtccccattcccatttctacgtgagctcataaagtcaagatcgttcacgatgacttcgatcctgctgcggcgctggccatcagtctcccacgaagagtagcgaagcttgccatcgatacaaaccttcgtgcctttggtgagatatcgagcaaggctgtcggcacgagtcccgaacatgacgcaatcgataaagttagggtaatcctcccactcaccggaagcgttgcgtctccgatcattgaccgctactccaaaggtcagtaccgaagtaccactcgcagtagccctgagctcaccgtcgcgtgtcaggttgccggaaatcgtgactctgttgatgctcattcttctcactacctctcaaaaggtgagtcttccccacctatcccatgactaatccttgtcaggacgggccacaatcatgtgacgcttgactgcatcgttgatgcgcaggatacgatcgagctctgcgatatcggacgcattagcatggaaattgatgagggtgtagtcaccctcggtaaggccgtcaatctcgtaagcaagtttacgcttgccccagttatcgacgtcgtcgactttgccaccgttggcggtgatagctacctcggcacgcttcataacacccgcgcgtgtctgctcatcggtagctggatcgacgaaaaacaatagttcataagccttcatgaacgctcaccccctctggacaaatgactcagggttaaagaaggatagccccaagtaggataggcctgacgatttatagtaacacatcgatatttgtttgcctatattcccacatttcaatgagcccattcctgcacacgaccagtgtagaggaggcctctgacagaaatatcagacttacaatcagtggtcatacagacaagcaccgctatgtctgcctgtcagaagaactcaatcgcctctcatcaacccgaactatttctgcggatgatctgtgtcctcagggggccgtggcatcggaagggtcgcagtctgtgtttcctcatcacctgcctcagccgtccgttggagacgtacatccggtgcctgctgaggagtttcggccaggtttacagggactgcttccccaacagggtttgcaggggtttcttcctgaggcgcctcttggttttctgcctgcggattgcgaggtgctgcctcagcctgcttcttatcggctgccgcggtcggaagcggatcgcctgaacccttccagttggcgacctcaaactgccgcatccagagccctacggcattgatactcaccatgcggaccacattgtcgagcagcccatacgcgtaggcggcaaggatcaaacccggggccagcgtggtgacggatagaagcattcgcaggattgcaccgggataggtgccgctcatcagccccatgagtgcataaccgatgccggaaagatttgaagccgcaatgctcagggcaaggagcgttccaactcccatcgccatcacgtgccccagaaaatagaagccggcgataacgagaagattgccgaagtcatgcttcagcatgtcccagacccggttgatctggtagccggcggagaaccgctgatagatcaccgcacgcaggcaagcgacgcattcgatggtcacccaaatcgccgccagggcaagctcgaagagcccgggtgtcgttttgggattgtccgggaagataaacatgccgatcagcagcgcgaccagaaaataccctaatccagcgacaaagacgcgccagccgctccggatgcatttgccgcaagacacacgttcctgcttgggataggtatcaaggccccaagcggtgagccgggcccactcaaaccggtacccctgaacccccaggtagcccaccaccggcaccaccagagcaagtggaattactagcagcggtttataccatcctttgtcatgggaaagcatctcccacgagcgcgtgatgtagcgatctcttgtataggccatagcttcctcgctcaatatggttggctctatagcttcgtcagttatctacacctcatcttattacccgcaccactgcacaaaggcgacgtcactatgtaaattacatatcgcacggcatataccgaaagatcaaaagaacctggagggtgaggtatatatcaatgtatcaatggtgtgacctcaaataaaaatggcggagagggtgagattcgaactcacgtacctcaaatagaggtaaacggttttcgagaccgccgcattcggccactctgccacctctccatttacaaaacgtggcgcccccagcgggacgccacagacattggctggcggagagtctgggatttgaacccaggatacgctttagacgtatacacgatttccaatcgtgctccttcggccactcggacaactctccctaaaaccgcataggaaagtgtacaatacttgcaccgtatttaccaccatt

SEQ ID NO: 351 - DNA, 12061 bp, Unknown
  Metagenome-assembled genome
accgatcgtgctcaccggctcacagcagcccatggcggcaccgttcaccgatgcgcagctcaacgtctaccaatcaattatctttgcgctcaatccctgttccttcgacgtgaacgtcgtcttcgggggccaggtgatcgcaggcacccgcgcccacaagcagcggaccatgagcttcaacgccttctcctcgatgaactatccggtgctcgcctacatcaggagggacaaggtggtctggtttggactgatggagcctgaccctgcggcacgcacaaggcgggcactcaagcgctacaccaagctcgacgagcgggtgatcgtcttgaagcttaccccggagctcaaaccctcaatcctggggcttctgaaagacgactacgatgcggtgatcctcgagaccttcggggtcggcggcattcctgactacaaccaccacgccttccggcgtgcgatctttgagtggactgactctggcaagactgtcgtactcaccacccaagtccccgaagagggcctcaacttaggggtctacgaagtcggccacgccttcgcccaccacccggggatcctccaaggggaagacatgaccaccgagacgatcgtcgcgaagactatgtgggcgttgggacagagccgtgagcgtgagacgatcgaaagcctcttttcacaggtgatcaaccacgaccacaccccgacgagctgagatcgtgtcaatcggatgttttcccacacgaacagggcttgttctcaccatatcgatgcctgttcaaagttttaggtggtatacaatagtgcaaaacttgtatctggctaagaggaatcccaactcgtcgccaagcaggtaagaaggttttcgtacagtggtaaaggagtagtggcgccatgtcttctgagcctgagagcatccgtaaagttaacatcattggccatcttcatccggataccgacagtatctgcgcggctatcagctatgcctatctgaaaaaccagctcggcgacacctactacgaagcgcgccgcgccggcgctatcaaccgtgagacgcagttcgtcctgaagcacttcggcttcacggagccttcgctcatcacctcggtgcgcccgcagatcaaagatatcacggtacagagtgtccccggtatcgataaggagatgtccctctttacggcctggaacacgatgcaggagggcaaatccgataccctgagcatcaccgacaatgagaacaacctgtcaggcatcatcgcggtcaaagatattgcgaatgccaacatggatatcttcgataacaaggtgatcagcgaagcgcgcacccggtatcgcaacatcgtagagaccctcaagggtgagctgatcctgggcgaccccgacgacaccgtcgaccaaggccgcgtctgcgtcggcacctctccggagatgatggaagggctcgtcgagccgggcgatatggtgctcgtcaccaaccgctatgagacccagcgcttcgcggtggagtcccatgcgggctgtctcattatctgcaacggcgcccacccgagccatgtggtgcaggaagccgccaaggacaacggctgttccatcattaccaccccctatgacacctacgcggctgcccgcctgatctcgatgtccatcccggtgcgcgccaagatgctccccgttgacaaggtgctgcacttctctgtcaacaccacagtcgacgatgcgagaaaaacgatgtccacgagccgccaccggttcttcccggtgctcgatgaggacggcaactacgccggcatggtgagcggtcccaacctgctctcccccagaagaaagcacgtgatcttggtcgaccacaacgagcgcagccaggcggtcgacggccttgagcaggcaaccatcatggagatcatcgaccaccaccgtatcggcagcattgagaccgactccccggcactcttcagaaacgagcctgtgggctgcacctgcacgatcatctacagcatctaccaggagcagagtgtcgagatcccgaagcggatcgcgggcttgatgctgagcgctatcctctccgacaccctggccttccgctcccccacctgtacgccgcgtgacgtctacgtgggcaagcagctcgcaaagatcgcggatgtagacatcgattcctatgcggaccagatgttcgacgcaggcgccgacctgaccgggcgcaccgccgaggaagttttctcgagcgacttcaaagtcttcagccgtgggcatgcccgcttcggcgtcggccagtcttcgttcatgacaaaagcgagccgtaaggctgccgaggaccttgtcggtccgtatctgccacagggtgccgaggccaacgatctgccgatagtgttctacatgttcaccgacgtcaagtcgcagaccaccgagtttatgtactccggtccgaacaccgatgagatcgtggagcgcgccttcaacgtgaagaccaaggaccacatggccgtgcttccgggtgtcgtgagccgcaagaaacaggtgattccggcattgatgacaacaatccagtcgatgcaggaagacagagcctagtctccaactgagggaacattgattctgagagcgcctcgcttttcctaagcaaggcgctctcttctgttctgcaatcagggtattcatgggtcttatctggttcgccccacaacgttcgctgccatagcccgcagacaaccacatatatgaagaactctcggtaagaccacgattgacctcggcccttgccttccaccagtcccagaggggctgggacctgtcgacaagcgcgtctcgcgtgtacatagttgccttccgcaagctggcctgagagcatcgccttgctgtcctgtgcagcatgcctcgcctgctttgtccacaggaagcaggcgagacaagtgctgcagccattttgtcgacaccccatggaatgggagcaagaacttgtctgagccttcgctgcatcgcattggtaaggctgctctcgccgtgcctggactccttggtaaatgtggccgtgtagcttcgtgatcccgagtaagggaaggatgcgcgccatatcctgcatagttatctgttacgacccagaagctgtcggtgatgcctgaaagggcaacctttagctttacgcatcgggtgggccttcccctcccgtaaagcgttgtatattcgtctctaaggtcatctgtggcacacgctgcgcagaccttctcgttcgatattgtgcatgaatgcacaacatggccgtggcctgtgtgcctttagggtatctgcacatgcgacctttccctgttgtccgcaagcgactcgccgagatagagcctgcctggcaacaacagacggcatgggcgctcctgggtgactgaagcggcgcctgcatcacctcgaagtgcctgatgcgcatgggacctacgaggtccttaaggcccacatgacaggcaaagggaagctccttaagtgtcatgcctgcaagggtgccttttgcatacgttgcccctgtggcggcgaagggcttcgacgccgagatggcagattctgtcttggctaagaaggtccttccgcacgacctgcacttctatctttggaggctatatcaaacgtacctcttgcggcagaagtcggccgattcgtatcttgggcaccccttgggtttacctgcaagcgcagaccccgccatctccttagcgatgagggccttgagcttctctgagagctcgcgcttctttgcgatgcctatctcgtctacgtgctgcagtatcattgagtccggcccttccgcttctcgatgcctttgtttggcggcatgcattgtagacgggggtccggacacttttaggtccttctcaggtcaatcgtggtctaacagcgagataaagaattacagggagtcattggatgcacaagctgcataaaggacatgcacggatgccgaaaaacttcaacctcgaggagcgccttaaccgctatgctgcggcaattgaaaccaagccggagcactttgcagggcattgggctcaagcttgccatcctctggacgacggagaggcgtataaaaaggtcgtactcgacctcggctgcggcaaaggcacttttgcctgcggcatggctgcgatgcatcctgacatcctctttatcggaatggacaccgagcccgtctgtatcgcctatgcagcgcagaatgtctgtgagcaccacctcaccaatgcagtgatggtgccggggatgggctccgatgtaacaaagttttttggaccgcacgagcttgactccatccgcatcaacttcccgacaccgtttcccaagaaacgcctcgcagagtatcgcttgacgattctcgagcgcctcttggattaccgcaaaatcttgaaacccagctgtagcttgattctcaagactgatagccaaccctacttcgacttcacgctgacccagcttaagctcgtgaactaccacctcgattggcagacccgcttcacgcgaggcaagttgcccgacgaaccagtaacggagtacgaggagcggcttgtcgcacagggcgcccatgtcctggggctcaaggcgaccccgcaggatccggctccggagcatccggtccagaccgcagagctttcactctcaaagtatctgcctgagaacttggatgatctcggttacatcccctatgggatggagaacaccgtggtgaacctcaagaactacgaacacaaacatcacgaaaactattttaaacataaccgataggcagcaaaagggcggccccgcagagctgcccttttgccgccactgtgtcacgcaggttctcagatcaacgtacgggtggagttcagcacgcagaggatcatcacgcccacgtcaccgaagaccgcaagccacatcggagcgagtccgaagagggccaagatcaggattgcgatcttgactgcgatcgagaagacaatgttctcatgcgcgatcttggtcgtacggcgggcaatcttaatcgccagtgcgatcttagagggcttgtcgtccataagtactacatctgcggcctcgattgcggcatcagaacccatcgcacccattgcgataccgacatcagcgcgagccagaaccggcgcgtcgttgataccgtcaccgacaaaggcaagcgaggtgtcatctctcttgatatccatgagcctatccatctgatcgaccttgtcagtcgggagcagctcagcgtggtactcgtcgagcccgagtgaggtggcgaccttctcagcaacgtccttacgatcgccagtcagcatcaccgctctgtggacaccctccttcttgaggtcctggatagcctgcctggaatcttcctttatctcgtcagaaatgatgatatggccagcatacttaccgtcgattgcgacgtggatgatcgtgccgacatcccctctgcagacgtgccacttggcgccttctgcctccatcagctcagaattgccaactgccacacgctgtccggatacggtcgcgacgatacctttacccgcgatctcgtgagtatctttaacctcgcagccatcgcccacgcacttgtacgcattgcgcagcgctgccgcgatcggatgtgtggagtactgctcaacgtgtgccgccagatgcaggagcttctttttctgaaggctgctctcagaatgcaccgtattgacgacgaaggtgccacgggtaagggtaccggtcttatcgaagaccacggtgtcagtgttagcgaggaggtccataaagttagaacccttgaccaggatgccgtgcttagaagcaccgccgatgccgccgaagaatgccagcggaacgctcagtaccagcgcgcaggggcagctgacaaccaagaaggtcaatgcacggagcaaccaggtggcgaagttggcggcaaagtcaccgctcacaagcggcccgatgatcgcaaccgcgatagcggcgtagaccacgatcggggtgtagacgcgggcaaagcgggtgataaaatgctcactctttgatttcttgttgcccgcattctgcaccaaatccaagattttggcagccgttgactcgccgaaggccttcgtgaccttcacggtcagaacgccggagacattgacgcaaccagagatgatctggtcccccgcagcgatgtcacgcggagcagactcaccggtgattgcaacagtattcagacttgaattgccagtaagaacgacaccgtccatcggaactttttcacccggtctgattgtgatagtctcgccgacctggactgtattaggatccacaacttcaactttaccgttgcgctgcacattggctgtgtccgggcggatatccatcagttggctgattgatctacgggaattgccttctgcaatagcctcaaagagctcgccgacctggaagaagagcatcacgaagacggcctctgcgtacatcggctcgccgcccgggatgaagccgatcagaagtgagccgatcgtagcgatcgacatcagaaagtcttcatcgaaagggtgcccactaaccaggttcttccccgctgccatcaacacgttccagcctgctacaaggtaggccggcagaaacagcagcaactgaataaacagtttgaaatcagtgaaatgctggatcagcattgctgcaactagaaggattgcggagatgataattctgcgtttgaggactgcaggctccagttcgtcttcgtcctcctcttcctcaaattcatgcgcgtgtatatccgtagcgcaagagcaactgcccgacttcggcgccttcttcggatactgttcggtgcccgtttgcgaagccatagccctccttcttttggatacctctgatgagactttatccccttacctgaatatatgaccatttgctcatatattcatacatgagtatataagaaagttacactcttcgatagtctctgtgggtgaatctccaacagacacccagatgagagtaggaaaagacggttgatgcgaagatggccccgtgaggggcttccgcatcgggcaaggcaggatctgcgtgccgggcgcagcctgccccggcacatgaacaggatgctacgctacgcgctcacactggcgcacaccgcgatcggatacgtacgcatcggcggagatcggaccgtcgtcggggtgcgaccgtggaagcgggacggcctgcgctgtttggcgtgcgggcgcagatacgagtgctgtgacgcctcgccggccccgaggcgatggacatggcgaggccgatgtgcttcctggaatacgccacgaggcgggccatgtgcacggagcacgacgtactcgtcgagccggtcccgtgggccaggcacaggtcccgcttcgctcgtggcttcgagggctgggcggcgtgctgcacggccggcgccgtcgtggggcttacgcgtatggagcagcacaccaccggcgatctccagacacggccgcccgggccccggaagggcgggagacgctacccgggaccagggcgatcaagggcagcagctccgcactcgtcaagagcctcgaggaactcgccagcgtccaacgcgccgagaccgagtcactgaagaaggcggggtcgcggttgtccagggcctgcacgccgtgctcggggcgacggtcgtgtcaagtcggtcagcagcaaaatcaaggtaacggtcaagatgggctgcggcttccgcgatgccggcagcctcgtcgggttgcccatactgagatgctccaattgcaagccgacgctcccagggaggtccggaaagaccggaaagagagaggctgcctagatgaactccttacctacagaagctgacgaaggccctattaaattgtaaatccctccttgcggtctggaggtctaatctgggcagcctattaataagagcaggtctacaatcatgggaattgctcgtctatccacaagaaagcccggatgggcggcaaggttcttgcggatgtggtagtcctggcccccgctatccttctgggccgccaaagactaccacaaagggcaaacacgcgaagcgcaggctcgccgcttcggtcacgccttgggacggccttgcagaaagcgagcttgaaaccagctcaggcgctcgtggatgcgagccatagaagcatgtactcgttcaggcattgccacctcaacggcgatgcgaacggcgcgcctgcctaagatgcaacagcgccgaggtgtccaagcgcggcaaggacgcaaccggcgcccagcgctattttttggctcttcgctacttatggtgggtagcatatctgcatccccttgagggcgtggcctttaaacggtaggattttccccgacaggaggctgcgttctggaggtgcgatatggatgcttaaggcagggatgctagcaaggctcttcgagaggtcgatgggacttaaggacgagtgggaggtcacgggcgtctggtttaaggagcgcgagggagcgcaagacgagctccatgtgagggtggcccacaggaagggccaggcagtggagtgccccgtctgccacaggatgtgcggcacctacgacacgcgcgagaggacctggagacacctcgacatctggcaatacgatacgatcgtgcactgcgcgctgcccagggccgactgccccaaggacggcgtgcatgccacaaggatgccctgaaaggtgcggccgaagacgcacttcacagcgctcttcgaggcgcaggtgatcgtgatggcgctctttggcatgagcgtggaggcgatagcgcatctgatgcacgagacagcccacgcgcatatggaggctgctgggcaaggccgtgaccgaggcgagggatgccgccgactattccggcgtcgtgcgcgtgagcatagacgacaccgccaaaaggcgcaaccaaagctacatcagcatcatggccaacctcgactgtcagcgcaccgtggccgtcacgcagggcagggacaagggcgccttaggcaggctctgagacgagcttaaggagcacgggaggggaccgcacgaaggtcttagaggtcacgcgcgacatggcttaaggcctattcgctcggagtggcggcggagatgccccaggccgcccagattgtggacagcttccatgtggtgcagctcctgatgagggagacagaccctgtgaggtgccaggagaggcgcgagtccgcctcgaagcgccggcagctcgcagggacgaagtacgtatggctcaagaggagggagagcctcactgagccctgtcaatataatggacagagaaatctcagattttttatgcgatctgcatcgcctttggatcgtatgcaaggcctctctcgaggtgctcgaagaactcctgcatcacctctgccggtacgcgatctcctatggacttatgcgggcggaagcggttgtagtacgactcgattaaactcgtgtgccttgtgcttggtcgtggatgcatctaagaggcgcttatggtagtaccactcgttcttgagcgtggcgaagaaggatttggctacagcattgtcgtggcagcttccggttctccccacggagagcctcacgtcgtgtgcggctgagcaggcggcgaactttgagcttatgtactggctgcctgggctgcttagaatatggcccctccggccacgtatccgcgcgaatacgccatcttcagggcaaagacgacaaggcctgccctcatgttgtcctgtatgcttcagcccaccaccatgcgcgtgcacagatcgtgtgcgacggcgagatatataaagcctgccgtggtcctgcgataggttatatcgcccacgagcttggctgtcggaacgggacacgaaaagtcgcgccgggtgaggtcggggcgctcgggggtatcaggtgcgggcagtatcgtcctcttcgatgcattgggacagataccgcagatgcccagcttagccatgcacctgcgcacgcggtagcgggtcgtgcctgcaaattttgcgtaacttcggatctcctgtgagcttggtccataccttgcaggagctaaagcgcctgtcgctttcctcccatatcgcgcagatggcttccttgaggggaccccataggtcctcaccgcctttggccttgagccatctgtagaagtgagccctgctcatctccagtacgcgtgccatcatcgagacgctgtaggttgccctctttgcctgcatgagctaaaacctgtccttagccagaggcttctggcgaagaaggctgcctcttttttaggaacttattttcgctttcgagctcgtgtatacgcctgttcactgcgtcgagctgcttgtgctcgtcgatcctttcctgggtcacccttttggtctttgagtgcttgatgatccagtcgtttaaggtcttgtcgttgatccttaagcttcgcggcgcatcctctgatgctcttcttcgggttggccttacgtgccttcctgtagtagtcgatagcctcaaggcaatacttcttcagtgtagtgtttgggtgtttccggcttcgtgcgggactttgccttctctatctcgcttgcgcttagcgacatctcatctcttcaatctgttgactgtgctgggtgggtatctggacagagcatatctgttgccagtccctgaatcccactgtccaccaaaagattacagctcaggggctcgtggatgatgcactctgccgtggccgagatgaagagcgtggcgaggacgctcaggaaggagtgggaaggtatcctcaactggtggaagaggggctccaccaactcgttcctcgaaggcctcaattccgtcgtccagtccgcccgcagcatcgccaggggcttcaggagcatcgcctacttcagaacgatgatcttcctcaggctaggccgtctggacttcacgacccagaagaagctcgcatgcgctacccaccataagtagcgaagagcctctttttatactctaatgggtatactaattacagcatatcggatggaggcagaatgattggagaagtaatcgtcgagccacatgcactcaaacatgatttgagtgcagaagaaattcggcatgcatgaggtaccccaatcgcctgcaggcagcgaagcgttgagaacgatcctcctatttggatcgcaatcggtgtactaccagacgggcgtatggcagagctagtagcactcgaagacaatcagggacgatggcgcatactccatgcaatggcccctcccaccaagaaattcaggtacgagctcggcatgatgaggagatgagcaacatggcggatttcaaggcagctgacggcacagtggttacagaagatatgattaatggctggtgcgatgccctcgatcacgacgaatggcctgagggatggaagaatcgcagcgatattgtttatgggaaaccaccactgagtgtaggtgggacagctactctctccatcaaggtcccagtagcaatgaagcaaaagatcgctgccgaggctaagcgccatggtacttcgaccagcaattatgtacgtgctttacttgcagaggcattgctcgctgaataaactatttcagttcgcttattgctaagaatactttcacgcgaacaaacaggacgaattttcaaatacctcctcgggcccaacaaccagaggaggctattttgttggatcttcgatagttctgtgggtgaatctccaacaggcacccagatgagagtaggaaaagacggctgatgcggagatggccccgtgaggggccatctccgcatcgggcaaggcaggatctgcgtgccgggtgcagcctgccctagggaggtccggaaagaccggaaagagagaggctgcctaggcgcagtctctattagggcgtccaggatttgggcgcagttcactagtctcaaaatctgaactggaatcagaacttggcttatggattgaatatgccgataaacggtaatctaccgccacaatgagtctgaaaccagggcatatgtccagggggacactcctgtacacacgaccgtatcaatgccctttactgccttcagccctacccataggatacgctatccgtagaagaatgaagtaatatgtacagttgtgcagtgcgagaaagcg

SEQ ID NO: 352 - DNA, 45191 bp, Unknown
  Metagenome-assembled genome
atggagagctccttcgccacgctcttgtatccacgccctttcccgaagagctctgccgccttcttccttgcctcgatgtcgtgcttgaccctcagatcggtatgcatgaatatgcctcccatttcctggacataggaaatgggaggcagttcaaactgatctggaccctgtattccgcacaccgaaaacggaatcgcgagatagttcgattccgctcgacggcgggccatggatagaactggatttcgtatatgatcgatgagaagttcacgaaggaagagcgtatgaggcgcttacacaaagacgagaggtcaggagagatatttgcccgggcggggctccccgcctccctcatcttcgcgggcagtcacttcactcggggcgtatccgaggaacacatggtgccggagggaagaagactacagggcagctgttgggagcccattctgtcatcctctgccacgaaggtcaagagtggcgggatgcccggtaggacaaccctcacgtcctcctgtatcccgccgaaggggcggaaggtggagattgaggaagacctcgagcgtcgtgagcgcaaatagagcagtgggcctgttttttcgttcgagaggagaagccttgactttggagagagatacgagcgttccgctctatatccagatagccgactttctaagggataaaatctccgcgcatgagtgggagccgggtacgaagattcccacagagtacgagctctgcgagatgctcggtgttagcagaggatgcgtaaaacgtgggttgcgcatgctcgtcgacgagggtctgctcgtgcaatatcgcgggagaggaaccttcgtaactgagaagaggataattctccacccaaccgggaacaccctgctctcgtttgcggagtcgcttaggtcccagggaatagacttcaggaccgaagagcttgaatcgggaatggtacctgctgatgagtttctcgcgagggagctttttatagaagaaggagctcctgtcttctttctccgtcgtgtgaggtacgttggtgacgagcccatcatgtatatagagaatcgcgtcagggcagatgaggttcccggaattgagaaggtagatttttcagtagagacactcttccagacaatagagaggcttgctggcaagaaaatcgggttttctaacgccaggtactctgcagagattgcaggagagattagggggagggcgctcggggttagtgctgactccccagttctgcatctcgagcagcacgtcttctactcggacgaccagcctgccgaatggggaaacgtctggctgcaggcttaccgatatgtagttgggacagtgctccctcgtgcataataccactcaccttgaaatcgcaaccgctggtggcaatacccggcgattctaccaagtttttccgacccctaattgacctcctttgtacacgcaaggtggacaacagggtcgatagcacttggaaaaaggattgaagtagaaatctcgaagaacttgttttacaaggtaagcgtgttcttatctgtctcattatgcaatcaacacgcatttgtcaataagaaattatgcgagatttgtatatctccattagtcttgcatagatttgtatacctttgtataaatgttcgcgagtaaggacatgtatttattccatttggagggaaaatgccactcgtgaacatgaaggaactcatgaacatagccaagaaaaatggcttgatgctcccagcctacaactcgaccgatgtccagatgacccttgcaatcatggactcgttccagcgtgcgggtatgccgggtatcatccagatcgctccgacgaatatcaagcttaccggctacgactacattgccgagaccacgaagatggcagcagagcactacgtcacaccattcgtcctacacctcgaccacgggaagacgctcgacgacgtgaggcaagcagtccaggtgggctttacgtcggttatgattgatggggctgcgcttccatttgaagagaatattcgcttctctcgcgaggcggttgactttgcccattgttacgatgtccctgtcgaggctgagctcggtccaatcaagggaaaagaggacgatcacgtcagtgaggccaattgccacaccgatccatcgcaggttgctgaattttgcgagaagacgggctgcgatacgcttgccgtctcgatcggcaacgttcacgggcttgaagaaaagccgaagattgacctgaacattcttgcagaggtctccaaggtggcgcccgttcccttagtgctgcacggagggtcgggaatcccgtttgaaactatccgtgcgatgaggcagtacggaatgatgaagataaacatcgcgagcgatttgaggcaggcgtatatacgcgcggtcgcaaagcgctacgaggcgaaccacaacgaggcaaaccttgcctcggtgctcatggacgcaagacaggctgtctccgacatggcctacaagctgaccatggagattaacaaggactcacttatcgggccgctcgcaaccgagaagggatagagtcggcatcatcggcaaccggacgaatgagaggagaaaaaaacttgaaggtctctattaatgctgaagcggtcaagtgtaacctggacgtttcaacgcaggatgagctcgtgagaagcctctccaactcgcttgttcggacaggttttgtcaaagcagattacccggaccatgtgctctccagggaggagaagtacccgacaggccttccattcgatgggtttgggattgcaatcccgcataccaatcctgagtatgtacataagcccaccattgcggttgccactcttgccaagcccctagtgtttagggtgatgggaagtccgaacgagacagtcgacgtctcgctagtcttcatgcttgcgttggatgatgggcacacacacctcgaattccttcagaaggtaatcaagctcgcccaagagagggagaaggtccagcagcttttctccgcccccaatgacgaggaactatttcatttagttagtgcctatttatccgagggagcgctctagacaataagatgcgaaaagggaaggaactctcaaatgcaacaactaaaagataggagaggaaatgtcgaagaagaagaggattttgttcgtctgtgcaacggggatagcgacgtcaactgtagtcgaggagaaggtctgtaattaccttcggagccaaggaatcgacttcgaagctgatcaacgcaatgtcgggagtgtcccgagcatcgggaacgactttgatcttatcgtcgcgacgacgcagattccttatgaggtcaacgccccggtcattagcgggttgtcgattctgactgggcttggggcggacgagacccttcagaagattaaggacatcctagcgaagtagaggctcttaaccaggctcaaagttagcttaagttcgaaagataggagagaataggcaatggaaggcatttataagggcctgtacgactttgtccaatatttcttgggcctaggcgcaatcgtgatgctgcctatagtaattttcgtcttggcgctgtgcttcagaatcaagcctagcaaggcattcaggtctgcgctgaccgtcggtatcggcttcgtcggcgtgttcaccatttttagcctgatgggggatcaggttgggccagccgcgaaagcaatcgtgaccaggaccggtctcaatttaccagatgtcgacctcggatgggcgccgctctcggcaattacgtggggatcggtaattgccccctttgctatcgtactcacccttatcgtcaaccttgttatgcttgcgttcaaatggacaaagacggtcgatatcgatatctggaactactggcactttgccttcgccggagcacttgtctacatcgcgacagggaatttcttccttggactccttgcaacaggaattgcggcagtagtaatcatcaagattgcggactggtgcgctccgctcacgcagaagtactgtaatcttcctggcatctcgctgccaacactctccagcgcagtattctttcccattggtctgcttggaaactggattcttgacaagattcctggtctgaacaagctgcaggcggatccggtccacatccaaaaacgcttcggtatcttcggtgagcccatgatgattggattcatcctcggtgtcctcctgggccttttagctggctatgactttaagggtattctcaccctcgctatctatcttgctgctgttatgtacatccttcctaggatggtgcgcatcctcatggatggtctcatccccgtctcagatggcgtgaaggactttatggcgaagaggttcccggatcgtaaggacttctacatcggtctcgacatcgccgttgcagtcggtaacccagcgattatcgcaaccggccttctgctcacccctatctcaatcttgctcgcattcattgtccccggtaacgagaccctgcctgtcgccgatctttccaacctcgccgtcttttgctccatgattgtagttgcgtgcaaccagaatatcgttcgtgcggtcatcatctccattccctgcctcatcggcgaccttctcatttgctccgctgcttccccactcatcacccagcttgcgacaacggtcggctatgacatatccgctgccggtgggagcaatatcacggcgttccttgacggcggtaatccgtttcgttacctcatctaccaggtattctctgggaacgttgtagcggtggtcgtcgcggtggtcgttgcagtattggtgttccttacctataagcttacctacaagcagactcatcccgaagccgttgagaactaggctccttttcccaaatggatggcacggggcagcaatgtctcgtgtcatctgtttggctattgtattgcccatcatgatgcaggaggtgacaggaattgtcgtacgcgattggtgtggacgtcggaacaacaaacaccaaggcagtgctctgcgagcttccctcatgtgacccggtctacatcgaaagatttccgagtcccaaaattacggaggggaggaacaccgactacgacactcggaggcttgtcaatggcgtttattcgctcttggaaaaatgtaccaactggcttggcgagaaatcagaggaaatcgagttcgtctcggtagcgagcgttggagagtcgggagtgctggtgtaccccgacgggtcattctcgaaaaggtcgatcttttggtatgacagcagaggggaggagtactcggaagaggcaatccgctccggctactccaatacactctaccgtgtcaccgggattccggtccattcaaactcggcgctattcaaaatcctctggatgcgcgatcatgggttccgtctcgagggtgccaagtggctgaccatggcggacttcgtcgcctggcggctctgcggaaatgcattccaagacaggacctttgcctcaaggacctcagcctatgacatcgtgagtgacaagatgtcggcggagattctcaaccattatggaattcccaagagtctatttgccgagctaattccaagcggggagtcgagggggagtgttactgcagaaacgcgatttctgactgggctcccacgaggctgcatggttcgtgtttcgggtcatgaccatatgtcaggggcaatagcttgtgacctcaaagaggagggagaggccctcaattcgactgggacttcggagggcctgctcatcttagagaaagccccgagactcgatgatgatgccgagaagaggcaaattacaaacggcagatttgtctttcctgatgtgtttaccacctacgtctctgtccccgcagccggattgtctttcgaatggattctgaagacgctcaatatcccacaggaagagttcttcggtgaggggcaagagagactctattccgcgtatttgaggggcgaattcgccacatcgaatctggtctatgtgcctcaccttcgtggtagcggacctccccatagaagcagcgattcaaagggttgcttctatggcatgagcgatacgaccagcagggaagaaatccttttttccacgcatcttggtgtcagcatcgagttcgccagactctgcgattgcatgataaaggacagtggcctcctagatgatatgcttatcaaagtgattggccctgctacgaataaccccctctggatgcagctgaaggcagatgctctggggattaggtttgtcgcatgcgatgtcgccgaggctgtcgcgcggggctcggtgattgtctctgcgcgtagcgctggttaccgagtccatccgcactatcagactaaagagtatttgcccgattcgagtcggcatgggcaccttgtcgattttatgagacgcctctacatccccatttcaaacgcaataggagacgtcgagagccgactggggaagtaaggattgcacggagtagtttagcggtttccctacttaggttgtctcacatggggtggcaaagcctttcttgtctagggaaacgatgattaatgccccataacgtgtcagaggggaccgaccacacgactttttgcggccggtatgcgggaaaggcagggaaggatgcccatccagcacgtgcaggagccgccatcctggcatttgtcctgccccatgcaccgcaagaaggctccaagacagatcaagcgactctgggagccgggaggtacagcctgccggcaaaagatgatgcacatgggtaaggtttgcaagggcgagaaagacttgagtgtgcaggcatcttctctatccttctgtagcgcttccttaaggggtcgaagcgccgcttcacgatgaggaagggtgcttctgcctttgagcgaacggatgccttcctggactcgatacccttctcggatgcgagcgcacaggcaaggccctttatggtcgaaggcttccttaacaacgctttagcgcatagatgagaggtgtgggtctttatgtgtccttaagggcgcttcgctatacctatatagcctaaagtctgcgcagcagaacctatcatcttcccttacgagtacatgtgccacaggatatgtcggatacattctaagcgatcgtctccataccatgcacaaggccacctgcggcatccacgccaatatgcgccttgtatccgatacgccactctttccctttcttggactggtgcgctttaagggtcgcgcgcgtggtcgtggttcttcgttaagctttaaggcccaggtgaaggtcgcatccaccatggagccaccttgcgctgtgatccctgccttttcaagctctaagttcaggcgcaaagcacaagctttgccgaactcctctcgctttaaggctatggcgcatcttcgcgctcgtcgttgcatctggcacctgcgcctgcatgaggtctacgtgcacagaagtgctgccaggagtagcaatccaggatagtatcttcggttctctcgtcttaagagcccaaacatgacctgcagcagatacatccttaagcatcgtctttgcaccgcgcacatgcctgccacgcgcctgagaatggtagctggtatctaccagaacaatccagctatcccacacaacgattacatccatttgctccaggaatgcctcccgtctggtctttctccttagaccttaggatttaaggtcctaaaagctcatctggctgtccatatctgccttttggatatgctggaatgcgtggatgtagctataccatatccagaaagacagataggcatctatgtggatatgggcactgcgtggttcgagacattttgagccgatgtcatacagcgtgtggctccagtgacctcatcgaggcgaattaatcatcgtttccctaggtagatgtactcccaagagtagtcaatcccgtgctcgcgagcgaccgtcttacgaaacatctcctccgcagcttctaggacttccctagggtccaaaaggtccccttgcgcagccatcggcctctctccactctcactcaaccgtcagcattcacagctataaatctcgttcgtatagtacgggcatcttcgcactaactagcatatagacaccccggcaccaaccaccaccaaaggcgcggggtttagtccacaggtacgccatgaatgcccaaccccgaaatgacaaagcttcctgagtagatggactaccgttcgctgatttgtgccagtttgtgacactccagatggattgttacgcgcactttcgcgtgaactgcaagtaaacgagcgtatggaaatgaccatctacctgccgaaatgctagagtctgtaaggttcttcctcgacccggatcaggtaatgtgcagtatcctactttgttccgtagatacggtcccctgcatcgcccagaccaggcaggatataggcgtcgctattgagctcacgatccaaggcgcaggtatagagcctcaccttaggatcatagttgagcaccgcgcggacaccttccggggcggacaccaaggtcagacagcggatatctttgacgttggcctctctcaggaaatggatcgccgcagtgagtgagccaccggtggcgagcatcgggtcgacaacgagacaggtacgcttgtcgatgtcaggtgggaacttgcagtagtactgatgcggctcatgggtcttggggtcacggtacatgccgacgtggccgacacgcgcggatggcaccagcgtcagaacgccgtcgaccatgccgaggccggcacgcaggatcgggatgattgccacctttttgccggcgatacgtttgcaggtggtcttctccaacggggtctcgatctcgacgtcctcaagcgggaagtcgcgcatggcttcgtagccctcgaggacggcgagttcctctacgagctcacgaaattgcttggtgccggtgctcttatcacgcaggatcgagagcttatgctgtaccagcgggtggtcaatgattttgaaacgaggatctgaaatggtctccatgggttctactcctgctccctatcgatcgcttgtaacaccggtaaaattcgggtcgtcctcgcgcatgatctttttgatacggcgctcgtgacgcccgccttcaaaggcggtccccaagaaggtccggacaaaatccatattatcgacgagactcacgaagcgccccgataagcacaggacgttggcattgttgtgctgacgcgccagctttgcgaacatatggctggtcaccgtagcggcacgcacaccggctaccttgtctgccgtgattgccatgcccaaaccggtgccgcagatcaaaacaccgtaatccgcttcctggtttgccactttacgggccacaatgtccgcatagtccggatagtccacccgatcgaaactatctggcccgcagtcttctacttcatagccaagcgactcaatgtagcgcgctaggggctctttgaacccgaacccgccatggtctgaagcaatagcaacacgcatcttctgcgctcctttcggcatgttaacctcttcgctttctctattattacactcagcggcgcttgcacgacatacgtcacacacaattggcgtatggaagcaaccttgagatacacctatatctgccttgctcatactgatgttcattgcgcatcagtccgctctacgggcaccaccgtatcacatcaaggctctatctatctgcgctgtatcgatcgcaccctggcgcaatactttcggtttcgccctggtacaatccacaatcgtggaggcctgggcaagcggtaccacacctgaatcgacgacaatgtcagccttttgcatgactgcaggatcgagcccggcagccgaggtaggcgagggtttgccgtgcagatttgcgctcgtctgcgcaaggggtcctacctctccaaccagcttttgaatgaggcgggagtccggcacgcgtaccgcaactgtctgcgtatcctggcacacatattcgcggggccattccgcagcagctttcaccaccaaggtgagggcaccgggccagaagacttgggccaaggtgtgcgcccatgccggcacttcacggccataggtagcaagatctttttctgagcccaaaaagagcggcagggtctgtgcaagatcccgctccttgatcgcaaagatgcgtcgatgcgcaggattgtccttgctcgcccagcagatcagcccatagaccgaatcggtcggtaccacggccaccccatctgtttcgagtacctgtaccacctgcttgacaatctgacggttaggctgctgctggtcacatgtcaccataacgctcatacctgttccctcttaatcgcatggatgatgcgcgggcggtgggtcagatcttcctgggtcccgatctcatcccagctgccccgctctttcagtaattctgcagcggtatccaaagacccttcaaagagctcaacacagaagagtcccccatctctcaattcctgctctgctaccgggatcaaccgtctgaagacgtccaatccgtccttccctccatccaaggcgagcgacggctcgaacccgatcacttcttcagggagcttcggtaaaagtgcagtcgggatataaggaggatttgagacaaacaccgcgaaggtccccgccaatgcagggtccactccgctcgccaggtctcccggcacgatatcaaccgcctcgtgcagcttcagcgcatcccgattccgctcggcgagattgatcgcctgctcagaaatatcggtcgtcacgacgtgcgtcccgggccgctctgaggcaagcgagagggcaatgcagccggtgccgcagcccacctctaacacgcgtgggccactttcagggatcttatcggtctgaggtagcaccttgatctgctccatctgagcttcaatcgtctcctcgtcgatgccctgatcgcgcgccttctgcttcagctcattgagacgctcgttctccgcttgggcttcatcctccagttgtttgcagacacgctgggctacgtcgtcgtacacccagccctgctcttttgcggtgtcaatccccttgaaggcaacatcgactaagatctcagtctccggacgcgggatcaaaacgcctttctcgcagcgcacaataatgtgcctgaaaggcatctccccggtcacatactggagcggttccccacggccgcgccgcacaaccccattgtgcatgcgtttgagttcctcaggagtcagcagcttatcaaagctcacatagatctcaacgcgggtcagcccggtcgcattgctgatcagccactccgccgaaaggcgggggtgctcatcacctttcttggtgagatatcccgttgtccatttgagcatcttcccaacggtccactctgtttcagccacccggctaccccttttcgttaaaaaggcatccttccaagaaggatgccttgacactcacagcctctgtgtgaggatcagacggcttctgctaacttatctgctctgtcctgtgccgcaagcgcttcgatgatctggcctaattggtctccctcaaggacgccggtatagctcgcattgtagccgatcctgtggtcggttacgcggtcctgcggctggttgtaggtacggaccttctccgcacgcgcaccgtggccgatctgggcgaggcgcgctgcaccctctttggcctgctgttcctcaagtttcttctcgtacaggcgcgctctcaacatctgcatgcagactgcacggttctggatctgcgagcgttggtcctgtgactgcacaaccgtgttcgtcggcaggtgcgtgatacgcacagccgaataggtcgtgttgacgccctggccacccgggccggaagcgcagtaggtatcgatgcgcaggtcctcctccttgatatcgatatcgatctcatcggcttcaggcaacaccgcgacggttgcagttgaagtctgaatacggccttggctctcagttttcggaacgcgctgcacccggtgtacgccgctctcatacttcatgatcgagtacaccttgtcacctgcgaccttgaactcgatggtcttgaagccgccggcttcaccggggcttgaagagagcacctcggtcttccagccacgggactctgcgaagcgcttgtacatctggtagaggtcaccggcgaatattgctgcctcatccccgccgacgccggcacggatctcgacgatcgtattcttctcgtcgttaggatcccccgggatcagcatgcctttaatttcgtcctcgaggccagggagcttctgctcattctcggagatatcctcctgcagcatctccttgtccttggggtcgccggtctctttgagcatctccttcgccgcgttgatatcctcaatcgtctgaaggtactcatgtgccttggtggccagagactgctggtcggaatgctcttttgccaaacgcgcgtattctttcggatttgaaatgacagccggatcgctcagtttttgctcaagctcgctgtaggctgacaccagcttctttaatttatcttgcatcgtcgacatcgtgggctcctcacgtcaccgcctcaaggcggcataattttctatgcatagatatacccttggtgggtgtggtctatcaagcacaaaagtacccctcaggggacgctccccaagaagtacttctgcgaaagcatcgactcagttagctacaagcagaagcctgcgacaacacccatatcctcattggaatctgcaacggagcgtggaccggagtcctgttcaatgatacggaagtgcggcgacactgagggtgatggggtacgggtccaccaggtggaggaagcgctgctgtgggcagccgcgataacattcggaccgttgacggtaccttctgggcttacgctggcaaacatcgcatactgtgtaccctcggaattcaggacccggttgtaaccgctcgtgtttctggactcccagttccagttggtcacgccaaagacttccacataggaggggatccacaggctgtcctgcgtctcggtgacctcctctgagtcgctggtacgtccggcgttgttcgtcatcttattcaccggaacgatcagctgctggaggtcatccgggagctcacccaacacatcgttgttgagccactggcgcatctcagaatcctcccaaccgccttcagaggaacgcgaagagttcatcgcgtgggtgaggttggagtctgaggtgataaacgtgatgcctgccggtgtgccatctgccttcgtatcgtgatagatatcggcgatccgcagggtgacagttgagccatccttcaaggtgatgtctttggtctcgtcggtgagggtgccatctgtatccgccaagttgtattgctcagcgattgccattgccgcatcacgcgacccagactgctccatcgcctgcgcgatacctgcgaggtccgaccaactgtactgcgagaacgaagagacctgttttggaagcaccggttgtgcgctggaactatcaccggtatcagtggtggctttttcactttcctgcgccggctgcgtcgccgtctcagcgctctcgggcgcctgccggacataggcaaacgcgacgactgctatcagcacgcaggcaacaagcagtgccacccacccgggaaccccctgccactcacgcttcttttgaagcttccgctttgtgcgggaacgctgggtatgtgtatcagtgctccgttgcggtttgggctcttccgactgtgccggttgcaccacagcctcttgaggttgaggctcctcaggctgagtgaccatcggccggtccacggactcaggctcctcgacactctcctgaggtgcgggctctttcggctctgtaacgggttcctgaagctgctcttgagggatcagggtggcagttgcatcagcatcgttggtcgcttctgctgcctttgctgcctcgtcctcgttcagcatcgttgtcttgtcggaatctgagagcattttggcagcgtcagtgttgccgattacatgagttgcgtcgtcgctgaagtcagccacggggccggcagcggattcactcggctgtaccggtggctcttccagcggcaccggcagcgtctcaacactgtggtactgcgccccactgcgatagtacttacgcttgcggcggttgaccgtttggtgcatgggcgagcggagcggtgcagagtgcatctcagtctcatccagatcgtttgagtcaatcgggatctgatcgatccggcccttctcagcccgggcgaggtcctcgtcaaatcgctcgtcgtcgtgcatcccctcggtatgcatcatgtgcgtagcgtcggggctgaggtcctgacggttgatccgcgccgtctgctcgacagccggtgcatagttttcctggggagcttcctgctcctcggtaacctcttctttgccgtggatacggatatcgtgcactgtagggccacgctgcacgtgcacgtagggcttggactccttgtgctcacccgcgttcacagcggtatcgtcgagcacggattcctttacgtgtgcggcattcttctcgtcttcagagacgatgtattgcgctgcagcctttctctcgctatctataatcggcgcgtgaaccggcatgacggggctcatcacgctcgtctgcgtctcgtcagagagtgcagatgtctctgtatccgcggtctgttgcgtgcggtttgaggactggacctccggtacccgcatgccgcattgggggcagaacttcatacccagccgaagctcatagccacaattgctgcatttcatgagacacctcttagtttttgtcagtgactatctatgtgatgatacctaaagttggtccacctttactagtaccccgaataaagacaacagatgccacacctacctgatcaccacatacaggtatacgaagcaggccttttaggcacgctgctgtctcatatccagcaatctgctcaggtgtcccctcgggagggcatcataggtgaaacaaagcaatcgatccgatagagctgaaaagagagcccgacgcttgaatcgcatcagactctcatactctcaaactgagattggttgaagtttacttctccttagccggctttgcatcagcctcagcagcaggtgcttcctgtgcggcggttgcctctgcagaagcagcctcagcggccttcttagcctctccagccttagcgtgggcctcggccctcttcgtgtattcagcagcacgctttgccttagcggcagccttagcctcgtgctcagccttcttctgagcagcaagttcagcggccttggcagcctttgcagccttagcctctttggcggccttcagctgttcctgtgcagcaccaccgaacttgtcagagaagcgctgaacacggccgccggtgtcgacgagtttctgctggcccgtatagaatggatggcacttgtcgcacagatcgacgtggatctcgctcttcgtggagcgtgtggtaaaggtgttaccgcaggtgcagtgtacaacacaggtgccatactttgggtgaattccttttttcataatctgactccttatcatggcctggtttccgaacaggcgaggggttgagatgctctcctggagaagagggcgtgcaagtttcatattttacgctatattccccaatctttgcaagaaaatccgttaagcttgatatggggtgcataggtgccttcactctattcatatgcgccacacaggcgttgtaccacctaaccgaaggacagatcgccgatgctcatcgcagtcgatgtgggtaacacgcagaccactctggggctcttcgatgcggaagggacgcagaggaagtgttggcggctcaaaacgagccgtgaggacacctccgatgatattctgatcaagcttcactcactgctgaccaccgccggctacggatctgcccacatcgaccacgccggcgtcgccagcgtggtccctgccctcaatgccgcctggaacaaggctctattcaccatcaccggcaaaaagccgctgacggtttcagcatcgcaggagcactccatccccctcagcatcccctatccccagacgatcggggcagaccgcatctgtaacgctatcgccgcccgcaccacctacggggcgccggtcatcgtcgtggacttcggcactgcaaccaatatcgatgtagtggatcagaaaggagcctttcggggaggcgccatcgcgccgggcctcatgctctcggcaagtgcgctctttcagcgtgccgcgcagctcgcttcaatcccgatcgaagccccaaagcaggcgctcggtgaagacaccaaaggggcgctgcagtccggtctcgttatcggcaccgcctgcatgatagaaggcctggtaagccgcatcaaagacgagctttccatccaggatgcaccggtgatcgcaaccggcggcctctccaccgtcatcagcagagccaccgacctcttcactgaggtcgacccctcgctgacgctgcggggcatctatacgatctggcacgatcaagaggctgtaaacagcgactaatgctgagcccggcgcattgaggcttcctcgtgagagaagctgatctcgctgccgtcgtcggcaaccactgaggctctgccccagacatcgacgcccgcgaagcgtccctgagccttgaggcgaccgttcggatagcggatctccacccgctcccccattgcgtcgagcgcatcaaagtaatcgttcaataccggagcaagcggtccggcaccgccctgtgagaatccctgttcccagccgcgcagtgcggagaggatctcatctctgagcgttgcggcaagttcacggtctgaaaggtcactctgcaccctgcactcttctagtagggcgcaggcgtgcgtaccctcatcgagcgctttaagcggcaaggtcagctgcgcgaccgcaaagatcccgcctttcccataccctgcatgggtctcaaggctcacgagcggtctagtgtcgtgcactaccgcatagggccagccgatgcgcatctcatctgcacagagtctatcgagggcttcacagataccgaggctcaccacgtagggaagaccttcaaggtatcccatcgccacctgagggcgcaggatataggcaacctcaagcgactcgatactatctccctggtcctggacccgtgagaatgcgccgcttccctcgtcggctccctggtaggcacgattctgcagctcagctgtatcgacgccgccggacatctcctgaagatctgccatcgctacctcagatcctcccaacctaagacgccgagctcgcctttcatgcggcccacgcgcttctcaggcgccaccacgtcgacgccgctgtgctttaagaaccgtaccgggtcgtgcatcagatcttccatcggcacgagcacatagtcgcgctcccccaaccctttgagaggtagggtcagctttctaccggcgtgctcttccccctcataccagcacaggtccaaatcgatcgtgcgcggtccaggtttggtcgcgccctctacacgggtgcgaccgagcttggtctcgatatcaagcagcttatcgaccaacacgagtggatgcagctccgtcctgatctctgccacggcatttgccacgggcgttgcgatcccgtaggctggctccgtctcataggctttgctgacattcaccacgcatgtcatcggcaactcgtcgatcatatgggtcgcctttgccatcgtgtccatctcctgctcagcgtcccccacattggagccgagcgagataaaggcctgacgggagtccgggtggcgcaccgcccagaaggtattgatcgcctgggagaccaccgccacattgtggacgcgcagcaagcgtgccccgccttcgattgcggccaggcacaccccgatcgtcgcggcgtcgcgcgctttggcgtccctcacgccgcagaccgcgcccacgaagcgcttgcgcgagggggcacacaggtaggggtagcccatgctcaccatcttgctcgtggcgcgctgaattacgatgtcctcgtcggcgaacttatcgaagccgggacctgggtcgatgcagatgcggtcgtggctgatgcccacccgcatcagcttgcgggcctggtcacccagaaaacccataacctggcgcatgatcggggcctcttcaggcatcgtgaagcggcgcatcgaggggacgcgccgggcgatcggccggttcggccgatcgacatccagctgcacggtctgacgggtcgcatgcgtcccgagccccatcttgttccagtacatcacgatcaggccacagtcggtatctgcgacgacgtcgaccatcgccgggtcagtgaagccggtgacgtcgttgatgatcgaggcgcccgcatccaggaccgccgccgccacgctggcgtgacgggtatccaccgagacgcaggcccctgccgcgaccagtttcttcacgaccggaaggacgcgcctgagctcttctgaaggctccaccgcctcggcgccgggacgggtggactctcccccgacatcgatgaggtcagccccgtcgtcgagcatcttcatgccagcctcaaacgcttcatcgacattcgcgtaggatcccccatcactgaaggaatccggggtaatattgagaatgcccataatacgtgggcgagtcagagaaatctcgtgtcctgcacacgtccatgtggcatagtcttctctgagcatcaaatcctcctgaacataaaaaaacaaagcgttgagcactttgattgtaatggttgtatacacaactgcccattacagaaactttcagaaatcaaacgttttggcgatatcgcaggcgcagaccagatccgctgagcgatcctgtggggtcgcctgcaaattgcagatcaccagctcgtcaccgttgaagtagttggctagactggccgccggatacaccacgagcgaagtgccgccgatgatcagcatgtcgcaggccgcgatctctttaacagccccgaggaggttctcctccttcaggttctccccatagaggaccacatccggtttcacgacgccaccgcacttcgggcattttggtacgccctcggttgaaaggatccactcctcagagtagaccgccccacacgtctggcagatattgcggtgcgtggagccgtgtaactcgatcacgtgcttggagcctgccgcctggtgcaacccgtcgatgttttgggtgatcacgcaggagattttcccctgctgctccagctgcgcaagctttctgtggcactggttgggtttggcacccgggacgcacatcacgtggcggtagaaatcaaagaactcttcgcggtggtccatataaaattcgtgtgagagcatctcttcaggcggatacttgtagccgcgctggttatatagaccattgggactgcgaaaatcaggaataccactggccgtggagacaccggcgccgccaaagaagacgacatcgtgcgctttatcgatgagccctttcagcgtttgcgctgctttgcctggatcgcttatatagtcacccatggttttccctccccttttcctttacagttgataatgctcctctagcttataccaagctgcgctgagtacctcttttggttgttctgaaaggtatgagacaaatgataccaaccgaaacccatctcgcccatgttcccgatacagccctgctctttgaaggcggcggctaccgagcgagctatactgcgggatttgcaagcgttctgttagagcacaaggttcagttcgacgtggtgtgcggcgtgagtgccggggcctcccatacggtcgactacgtctcacgcgacctcaagcgcatccatgattcgtttatcacactctccgaccgcaagccacagtcaggcggcatccgttctttcctccatggcaacggctacttcaatgcggactacgactatatgggctgcatcgaggataactacatgccctttgactggaaagcctactgcgaaaacccggcgaacgtcgcaatcgaaagcttcgaggcggataccggcaagtccgcggtgtggaccaagaaggatatgccgacattgcggtcgatgatggagcacgtacgggcaagctcgaccttgccgggtatgatgaatccgatcaagatcaacggccacacgatgttcgacggtgggatcggtgccggagctggcctgccgctgcagatggtcagggacaccggcgtaaagcgggtctttgttctggcgacccgtccctttggctaccgcaagaagccggtcagccgtgccttaaagcgcctctacgccagagtctcacgggacttcgagccactctatcaggcactggtcacccgcaacgagcgctacaacgcctcacttgaccgactgagagagctcgtcgagcagggcatcgcctacgtggtctacccggatgagatgcccgtgaagaacacgacgaacaaccgccaaaagctcgaggattcctacatcaagggctacacacagggcctcaacgactggcccacgtggcaaaaatggctgtttgaggcgtaggggaccacacatatatacacgttacctgatcgaggggaaccatatggatagtgaaccgtcggtgaaaaaatgtatctcctggaacgtcaatggcctgcgtgccgtcctcaagaagagtccgaacttcatggagatcttcagtgacttcgatgcggatatctttgcaatccaggagacgaagtgccaggaggggcaggtcgacctcaaactacccggctacacccaaacctggagctatgcggcacgcaagggctactccggcaccgcagtcttctccgaagaagagccgctgcaggtgatccgtgagatcggctcccctgtcgccgaggacgagggcagggtctgcgcactcgagttttcaacttattggtttgtcgacgtgtatacgcccaactccaagcagggcttgaccagactcgatgagcggatggtctgggacaagtgctaccgtgagttcctgtccaagctggcgaaggataagccggtcgtcacctgtggagacttcaatgtcgcccacgaggagatcgacctgaagaacccaggcaccaaccacgaaaacgccggcttctccgaccaggagcgcgccgatttcaccgaccttctgaacgcgggattccacgacaccttccgtgaggcccatcccacactcgagggagcctacagctggtggagctaccggatgcgtgcacgccagaagggtatcggctggagaatcgactacttcctggtctctgacaatgcagctaaggcagtgtgcaacaccgcgatccacgacgagatcttcggcagcgatcactgcccgatcgagctggatatcgccttataaggtaatatccgccacgtgagcttcccgcaacgtatccaaaaaagccttcgctgaacgggttgcaatcagctcctcggggaagtggatctgctcaagcatccgctttgttctgtcaagctgaccgatctcacaggagatatgagcatcgctgttgaccgcgatcttaacactgagctctgcacaacgctcggcaatttttgtgcaccgctggatccgcttctctgaggcgtggtcaaaggagtgctcgttgatctcgatcatcttacctagatcctttgcggcggtaagcactgcgtcaagatcaaacgggacccctgcccgtcccggatggccgataattgcgaccttcggatcctgcagggcgtggatgtacatatccgtggtctggactaggcttgcgccgcgggcaaagtcagcattgtggacgcttgcgaccacgtagtcgagcccgcggaagatcctatccttcagggtcgtcggcttccgctttgacccattgatccctttggtgatcggcacttcccaaccgaagagatgcccgtccagatccacaatgtcggcctcgcaggctctgagcaggattacgttgtactgcgtccatacccggggccaggcgtccagattgataaagtactggtagttcttgaatgtcacctcattgaacaacatcgcagagaagtggtccgccgagcctaaaagctcaagtcccgcttcatgcgccgctgcgacattctcctggatcgtcgagtaggcatggcgggaaaagagtgtatgggtatgcgtgtcacatgcaagttccatggaatcaaccaccctaactgccaggcatcagcagtgtctccgcgcttgatccgtaggaggcactgttcaaaatctattgcttcgtatcgttttcgctgtcgcgtgcagccttcagctgtttctcgaggagcttggcctttgcatccgctacggcagccttcgcctccgcggcttcaagtttggcctccgccgccttcaccgcaagctcatcgggactgagctttgagtagtccggatgctctgcagctctctgtttctgcggggtacccctgagtacagcgcgggggctgggggcttcgcccttcgcccaactcgtgacggcggtcacaacccgctcggcgttttgctcctgcagttttgaaaggtacacgctgcaggcggccccgttgtgctttggatccaccttcggatccttggacatgcacacagttttcgttctcaggacgccgcttcgctccactccgaacatgcaggtgtcacagctgcgttgatgcttgttcgccatatcagtactgctcggcgagcttttcccacgccggcatagagttcccgatggtctcatagttgacgcagtaaccgacacggacccagcccttgcagccgaaggagtcagacggcaccgggagcagctcaaactgctttgctttctcaaagaaggcgttcgcatcaggctccagtgacttcacccacagatagaaggcaccctgcggctcgatgaaggagtagccgagcttacttaagccctcagtcaaggctttgcgattctttgcatacgcctcaacgtttgacggcacatcgcagcagtctgcaatgacacgctggaacagcgccggtgcacagacaaagccgagggagcggccggcacctgccacagcggggatcagcttatcgtgaaacgggttggtgtccggaaccagcacccagccgatacgctcgcccggaagcgagaggctctttgagtagctgtaggtcaccatcgtgttcggatagatgctcgggacccaaggcaccttggcgccgtagacgatttcacggtacggctcgtcggtcacaaggcagatattgtggtcagcattggtcaaaacctctgccagatccttgaggttctgctcagagtagacagagccgaccgggttgttcgggctgttgattacgacggccttggtcttcggggtgatcgcgttctcgaccgcctccacatcgatctggaaagtcttctgatccgccagtacctcgacgcaatgggcgccagcagcctcgataaagaccttgtactccgggaagtatggggcgataacgatcacctcatcgccggggttgcacagcgtgtggaaggagatagtgagggctgctgcagcgccgcaggtgatgtagaggtcattagctgagtagttggtaccgtagcgcctgttgaggctctttgccagggtgtcgcggacaaccggaaggcctgcggcaggggtatacccgtggagctgtaccgccgggagcgtcagcgccttctcaatcgagagacgtacctcttcaggagccggtaccgaggggttgccgagtgagaaatcaaagaccttgtctgcaccgatttcggctttgcgtgccgcgccgtaggccgcaatctcacggatggtcgattttgaagcgccataggcgtagctttgttcattgatgtccatattcgattccttctttagcgactggaaaacccattggtttctatcgtatatagggcaagggcagctcgcaactgagcactattatcgaacgttaatacaacctttgcaaaaggcacctcccacagtctgtgaaaggcgccttgaggctcatgcgttgatgcgatgctgctactcgcccccagccgagtcaggctcagcggccgtatcttcaccctgattgttctcaagctccggcttggcttccttgggatgagattcaaggtatgcatcccacttgttatccaggagggcttccagcgcgtccccggacacggtctcacgctcaagcagcacgttcttcatcagatcgagctggtccttacgcctggagagcaccttgcgggcacgcttgtgcgcttcacacatgatgcgttcgacctcgtcgtcgatgcgcttggcggtctgcgcggagtagtcctggtgatccgcatagtcacggcccaggaaaacctggtgctgcgcttcgccgaagacctgtgctccaagctcggtgctcataccgtagcgggtgaccatctgccgcgcgagctttgtcgcgcgctccagatcgtttgaggcaccggtcgtgatgtcgctgcagcagagctcctcggcggtacggcctcccaagagcaccgcaatctggtcaagcatgctgttcttggactccaggtagtggtcctcggtaggcagctgcatcgtatagccgagcgcctggccgcggctcacgattgagatcttgtggaccggatcggagcgctcaagcacatgccccacgagcgcgtggccgctctcgtggtaggcgatggtcgtgcgctcctgttccgtcatgaccctcgtcttgcgctcaggacccgcgatcgtgcgctccatcgcctcttcgatctcgccttcaccgatcgcagccttatggcgacgagcagccaaaagcgccgcttcattcatcaggttcgcgaggtccgcaccggtaaagcccggggtcatctttgctaggctcgcaaagatgaccgtcttgtcgagcggcttgccctgcgcgtggaccttgagaatcttctcacggcccctcacatcggggcgctcgacggtaacttggcggtcaaaacggcccggacgcagcagcgccggatccagaatgtccggacggttggtcgccgcgatcaggataaccgcttcgttctcttcaaagccgtccatctcaacgaggagctggttcaacgtctgctcgcgctcgtcatgtccgccgccgaggcctgcgccacgctggcggcccactgcatcgatctcgtcgataaagatgatagagggagcggcttccttggcctgtttgaagagatcgcgcacacggctcgcgccgacaccgacgaacatctccacaaagtcagagccggagatcgagaagaaggggacaccagcctcgccggctacagcctttgccagcagggtcttgcctgttcccggagggccgacgagcaggacgccgcgtgggatgcgcgcgcccatcttgtggtagcggtccggatcccgcagaaagtcacggatctccgtgagctcctcgaccgcttcgtcgatgcctgccacatccttaaaggtcacattcgggcgctgcgcttcggtcatcttcgcctctgtgtggctgaaggacatcgcctggttgttctgcccttggatctggttgataaagtagaccatcacgccgatgatcaacagcgtcgggatcaggttgaagagggcagataccagcatatcgttggaatcggtattcacattgaactggatatccttgtgcgtctgcatcaggttgtcgaggttgtcagtccccacgtaggtggacttgtactgctcaagcttgctctgatccccgacatcgtcggtggactcccagtagtcgccggtcagctccccggatgcggtcgaataggtggcagagctgacgcggtcttcctctaccgcgctcagaaactcactggtggtgatgctcttcgcatggtgccctgaaaaggcacctgaagcactgaggacaatcacgacaataagggcaatgaagatagttgcagagataaccgtggccctccgcgaggcaggatcatggggtgaccgatgcggtccctgcgtaccgctcggtctgttcttatgtttcactcaataactcctctgggacgctccggggcgtcagatatctgtcactcgtgcgctatcaactataaacctccggctttaaaacgcctaggtacccctaggtacagaagacgtatcagcacttaatccttctgcgagctataaacctccggcttcaagacgcctaggtacagaaggttacgatatttttctgcataatcgagtccatagcccacgataaaggcattcggcacggtgatccccaggtaatccggcttgatcgcagccttcttgttcgggatgtccttgactgcgaagacgcagatgcggatcgatttggggttgcgggctttcaggagattgtagagataggagagggtgaggccggaatcgaggatgtcctcggtgatgatcacgtcgcgaccttcgattttagtcgagaggtctttggtgatacgcacgacgccggagctttgggactcagagccatagctagagacagccataaagtccacctcgcaggggactttgatcgcgcggatcaggtccgcagtgaagataaacgcccccctcaggatacagacgatcaggggatttttgcccgcatagtctttggtgatctgatcgccgagcttcgtcactatctcgtgaatctgatcttcagtcaagagtactttctcgacatccggatgtatggtttccattggctgctaactcctatctgtgccgtgagccaacctacgtgtgcgtcctagagaatatggagctctaagagcacttttgtcgcatgcgtacagcggtagcgctcatccgcgcgcaaccctcctacccagatgataggacctgtgggagaaagatgcacgattgggagacgattacgctgagcagtcggaatcttagcatcacagagcaggtcagagagcttctttaagcgtccctgcatgcctagcgggcagacgacctctcccgcctgtgggggctcgacccaaagctcggcaccggcaccggcaaccccacaggtctccgcatcgagcaggaccgaggatccggcccactcgtggccgtgcgctttggccagcgcgatcggatcggacccctgcggcactgggctgagcctggcagtcagcgtcttacccctgcccagatcgagggaacccggaactggcagccagccactcaaacctttctcctgtgcccttttcgtcatgataaacaacaggccgtattcgactttaacgtcgatgctcaaagggatcgtctgcgagccctttctgcgggcgatgagctccaaggttctctccacgtggcgcgcctcaaggcgggcttccggtgctacatgcaagaaggcgatccggatcacgcggcgtgcgattgcgacatcggtggcttcgagacggtctgcatcgagggtgaccattccatccgcttcccggcgcaccaggtcgcaataggtccggttagcgaccatggtgaggaaactgtcctcgtcggacaaaatgtcgcaggtcgaagagaggttactcacgacgcggggattgcgctccttgatgcggggcatgagttcatggcgtacaaaggccctcagatagtgcgtgtcattgttggtctcgtcctcccgccagacaatcccgcgcatccgcaggaagtcacagaggctttcgtgggttctgtccagaagcggccgcacgatccggttacgcacccgtgggaccgaggctagacccgccgggccgctacctttgatcgcgttcataaagaaggtctctgcccgatcgtcggcggtatgcgcggtcacgatgcgggcggttgaacggggtaccccgaactcagcgcacagctgattggcaagctcgtttgcataggcatagcgcagccgacggccagcgctctcgatgttcttgtcctcctgggcggcctcagccttaacatctacgcgacgcaccgtgcaggggatgccgcagcgttttgcgagtccccggacgaactcctcatcctccagtgcgtcaatgccgcgcagttcatggttcacatgcaggacgtggagccgctcccgtgcgatacgggcggtccctgccccgtcattgatatccagctttgaggttgctgcgagcaccatgagcgccgtggagtccgccccgcctgaaaccatcaggacaaccggcgccctgcgctgcgcctccgtaaggtcatttggcacaccggctgtaaatcgcttgcctacgctcgccattccattcctcacttacgtatctgtatataatctgtatcatctatatattgtgtacgctaaagttagtaacacacaacaattctaaaacgtatctgagagatctggtaatgcattgactccgttaatacacctttttgtcttcgcgagcggctccaaagggaactccgcgctggtacagggtcccgaaggctccgttttagtcgacgacggtatctccttcaaagcactgaaacagcgggcccacgaggtgcaagccccgctctctgatttgaaagcggtactgatcacccacgagcacaccgaccacaccaaaggcctcagggttctgtcacaccattttccaggccccttctatgcgacgaagcggacctcacgcgcaagcgaagtcctctcggagttgccaatccagatcctgaataaccgcgagggacttgatctctgtgggatgcatgtccagtgcttcccgatctcgcacgatgtggtggatcctatcggcttccgcttcgaggtcagagacggtgcggatactgtcgaggatgccttgggttggtgcagcgataccggctacctcaccccaccggctgagcaggcgctttcaggctgccgcatcttatgccttgaatccaaccacgacaaggggatgctcacccacggcccctaccccgcgatcctcaagaagcggatcggcggcaactatggacacctctccaatgaccaggccgccgacgccctggtcaacctcgtcagcgatgacacgcgctacgtggtcgccctgcacttatctgaggagaataaccagccaagcctgtgtgtcaaaaccttagcgaacgccgtcgacgctgagccggttgattccaccttcactgaggcgaaaaccggcaagctcacgatcgagccggcagctcagcaccgcgcgatcaaagtttggtgataaaatcccaaacgtagaaaagcgtgtggataaagatgagtctgccagttgcggaaatgtgcgtcagccataaaaatggcgaagcaccctcgcagctttgggctacctctttgcgtcctgacagacacagaacagcgacacaaacctattcaggcaagactggaagctggacttctttgtgtctgggaacctgaataggtagagcagcacagcttgttcacaagccccatggccttgtgcaggtatgtcaggtcagcgatgtctgccctataggcctcgtcagtgcattcggttgccttcacgagtgagagatgagacctatccccatggtgtgcataactattgagccttctgctctatacgaaagcagtgtgttttcgattcgcttggaagagggctttccatgccctaagatcacgccgacgctcttgagtgcgtcgatgcctgccacagtgcagatcttgttcttggagggcccactcttctgcacgatgtcggagtcggtgaggtagggcttgtctgtccagatgtggccacacaacacgagccggttctagtagccatcggcggtggcaaagacgctgtggcaccacacgaaggcactcgtgtgggtgaggtcacacatctcaaagatgaggtcgaaggatgtggtgtagcacatacaggtgatggggcacttccagctcaaaagttccttctcagcatatttcagcactaagagctaggctgtgtacctttgatgccccggtggtgtctgcttgtctttccagctttcggcaaacctgcaaatgtggcaaacaggatggaaccatcacagctcggtcgcctctttgagcgtttctgcgcctatctgtcttgcgacatctgcgttctacaaccgcagcgccgaaggacgacactgtgtccttgtaggggtttgatagcaaccatggtggattttctatccacgcaggtggccatccgctcagaaatgtcgccaaacatagggccagatagccacttgagcaaatctatacttggcaacgccaatggtagcaccacagggttacaggtgagagatcctatccacacgcttccctactctcggataaaatcatgaccacctgcgtagcgagtagtttgctctaagggtatagccctataaatgccggtcaggaactcaagtccccggccttcgcttcgtttaggccgcatggccgcttgactcgtggccagcccgtcaaaacgggcatgtgccggcctacttcctgccgaacgggccctcgtactccttgacgctcagcttgtcggggggcgatgtcggcggcttcctgctctcttatgtactgtacttcgcgatcgtggcctcgttcagcccgacggtcgagacacagtagccctctgcccagaacttcctgtttccgaacttgtacttgaggcttgcatgcttgtcgaacataagcagcgagcttttgctcttcggatgccccacaaagctcgagacgctgatcttgggtgggatgctcaccagcatgtgcacgtggtcgggtatcaggtgcccctctattatctcctccgccttctactggtagaggttcctgaagatctggtccttgcggtattggttgtagatggcctttcttctatactttggacaaaacacgatgtggtacctgcacacccatttcgtatgcaccaggctgttggccttctgtgccagggtgttctcctatttccttcatgtcccagcacactgccaggttttctattgccctctatccacccgatacacccttggagtatcaatgctccacaatgcttccttactataggaactctgcatatcaggcaagctgacctcttcttgtgggcgcttggaggaatcagccctgtttcatgcatagagtgtccgccttcggcaacaagtccctcagaaaagatgggaggtatcatgggtagcaggaagcgctccgcacgtgcaaaggagagggaaaaatttctttcaagccttggcagcatggacgatgtctttaccaaagaagaggcacaccagcgcaaagcgggagacgagaaggaagaagcacgcctcatgaaggcctgcctctcgaagcagcgctatgccacccgtcaagaagcggaagagattgctgcactctgtgcacaacatggaacgtatggcctcgaagtctaccgctgtccatactgcaagggatggcatttgacatcacatccctggaaggacaaaggacagcgctagcgcgtctggacacattgccatgctttactgcccattcggcagacaaaggcagcacgaagtgatagcaagaaggctacctttgttttacatacctacggtttttcccgccgctttctgcaaagatgtctccatctgatactatctgggcaatatgccgacgtgccgttttctcagagacagatgccgcagctgcaacgatagaagtcgttacatagccataggcatcaagcaacagggtaatgacctcatcgtgagatctccccttctcctcatgaggctcaggcagatagacgtgcgcccggaaaatgtcatcctcagtcaaaacgggagctttgccggaatagacgagcgaatatttaagagtcatctgcacaatgtgtgaaccgatatgtgagtgctaggctctccccggcagcggcatctgaagccccgagcatatgagcatcaccatcgcgaagaggttgtcgaggctgcgaaagctataggccatcctcacggtcagcttgatcttgttgttgatggcctccacgcgtgcgttggacaggccgctctccaaggtggcgacgatggtatccagatgcctcctgattttcctttagggaaacgatgattaattcggctcgatgagatcgctggagctgcacgctgtatgccgccagcttaaaatgtctcgaaccacgcagtgcccatacccacataaatgcctatctgcctgcggatatgttataattacagcaacgtattccagcatatccaaaaggcagatatggatagcctgatgagcttttaggaccttaaatcctaaggtctaaggagaaagaccaggcgagaggcattcctggagcggatggatgcgatcgttgtgtgggatagctggattgcactggtagataccagctaccactgacaggctcttgtcaggcatgtgcgcgctgcagagacgatactttaagatgtagcctgctttaggtaatgtttgctctcttaagacgagggaacttaaagatgctatcctggattgtcgctcctggcagcgcttctgtgcacgtagacctcatgcaggcgcaggtaccagatgcaacgacacttgcgaagatgcgccatagccttaaagcgagagagactcggcaaggcttgtgctttgcgcctggacttagaacttgaaaaggcagggatcacggcgcggggtggctccgtggtgaatgtgaccttcacctgggccctaaagcttaacgaagaacaaggaccatgcgcgcgacccttaaagtgcaccagtccaagaaagggggagcctggcgtatctgatacaaggcgcatatcggcgtggatgccgcaggtggccttgtgcatggtgtggagacgatcgcctagaatgtatccgacatatcctgtggcacatgcactcgtaagggaagatgacaggttctgctatgcagactttaggctatataggtatagcgaagcgcccttaaggacgcataaagacccacacctctcatctatgcgctaaaacgttgcaaggaagccttcgaccataaagggtcttaactgtgcactcttgtccgaaaaaggtatcgagtccaggaaggcatgcgttcgctcaaaggtagagcatcccttccttatcgtggcgcgccgcttctgccccttaaggaagcgctactaggggatagagaagacctcctgtatgctcgagtctttctcgcccttgcaaaccttacccatgtgcatcttttgccggcaggctgcttaacccggctcccagagtcgctcgatccgtcttggagccttattgcggtgcatgcggcaggacagatgtaaggatagcggctcctgtacatgctggatgagcatccttccctgcctttcctgcataccggcctagaaaagtcgtgtggtcggtcccctctgacacgttatggggcattaatcatcgtttccctagagacgggagcaggccgtgagcaatccaaaatgcccctcgtgcaaagccaagatgaagaagaacaaggcgacgaaggcgggcacacagagatggtgctgcgccagctgcggtgcctcgttcgtgcgcaggcacgataaggccgcaaagcagctcgcggccttcttgaggtggctgctctcaaaggacgcgatagcggatctgaagaccagcagatcgacgttttggcacaagacagtgtgggcctggaggatatggccgatagcgcctggcagcggcgagattcacgatgtcgtgttcctggacggcatatggcttcgcaggaaggacatcgtgctggtcgccgtagcgggcggccatatcgtcggctggcacctggcgcaaagcgagtgcgggtccgcctgggcggcgctgatgctgcacatccccgctcccaggatggcgatctgcggcatctcgccgctcttcgcggcggtaagggaggtgtggcccggcacgaacgtgcagcgatgcaccttccatgtggccaaccaggtcagaccctgaagcccaagctcgaggcaagggtcgagcccctggtcatcgccaacagtctcaaggacgtcggcttcgccacggcgtggctcttggagtacagcgcatggtgcactaaatgggcgacgtttctgaaggagttcactgtcaaggacgacaggagagtctacacccacgagcgcctgcgcaaggcgaggaagatcctgaacaagctcgtcaaggacgggacgctgttcacgttcgtcgagatgcagcaggaatacggcggcgagtggccttcgaccaacaacgcggtcgagagcgtgaacaccaggctccaagacgtgctcaggcaccaccgcgggctttttgctcctgcaccgcgtcaaggcgatcttttggtggtgctacatgcacacggaaagcccactgccgccggcagatatcatccgcgtcatgccggccaacgacgaggtcgacggcctgttcgcgacagtatcatcggacaagaaacacgacgacagcgcgcccgaagaatacggcacagggatagtctggagcgagttccacatgcccacgaattacaggcggtgaataatcaatccggacacactttttgaaacataacccgacgatctcggtaccgtgagcgcagaccgctagaacatgtacaacctgctctactttgcggcaaagagcctcgacagctacggcgcctcgaccgtctgcccacactggcgtatccgcaccggcatcgagcagggcgatacctcgctcacgaccgaactcgatctcgcgctcgtgctcgaggagaatccggatgcccaggatgtggatttcgcgacggtctggggagaaggccacactactgcagagcgcactggctctgcggccacgaacgtcatctcctgagtcaagtcctgctgcggagctgcgcaataaccttggttgaggttgatggggaaacaaggttatcggataatcttgtttacaaagctcttataaacaaggttattatactaaccttgtttttggaaggttcgagtccaaggttattgcaagcggcccgaactgctcaggttctttgttgacataccgtgaggagccggcatgggatactatgagacgcgattctggttaagcgacacgtggggcgccaacaggcgcgagcgccagtcgggagcctatcatccttttgttcccgacaaggtcagtgaaaccgatcatctactgacgcccgaagcatcagaagccgccgcccaagctcaggcagatatacagaggctcgatctcacgacgcctcacttggcaaataccgagccaatagctcggctcattctccgggccgaagctgtagcgtcctcgaaaatcgaaggtctccaaataagtgcaggaaagctgctcgaatatgaagcattggacgagctcggtgtatcgcaccgtatagacagcactgaggcggcagtcctcggcaatatctcatccatggaggagagcatcgatacgctctccgtgaagccctctttcgatataggcgacatctgttccatcaacaaaaaactgctggagcataccgatctcgcagattacggaggggtaatacgcacacagcagaattggattggcggcaacaacgtcaatccaatcggtgcaccctatgtccctccacgcccggaactggtgccggattacatcgaggatctcgctgaattcatttcgactgcgcagatgcccggtatcgcccttgccgcaattgcgcatgcacaacttgaaaccatccaccccttcgctgatggtaacgggagaacagggcgtacgctcgttcaagtaattctgcgcagatccggccttgctcagaatgtcgttccacccatctctctgattcttgcaaccgacaaagcacgctatatagataatcttgcagcataccgatgggatgagaacgccgaagaaccacgcacaaggatattgtgcgaaagcgattggatcgagtattttgcacgttcctgcagccttgcatgcaagcgtgcacatgatttcaacgacacgcttgaatcaatactcttaggctggcgagaaagagtgcatccccgagcaaactcagcagcagatctgcttcttcccaagctcataggaaatcccgtcatcagcatcacttctgccgcaaggctgtgcggcagaagcactgaagcagcaaggaatgcaatagccacactcagcgaggcaggaatcctgtaccagaattcaaagaatcgcaagaacagccttttcgtcgcacgagaaatcgtcgatgcattcaccggttatgaaagaaggcttgcatcgccagctggtgatacagctgttgctctgccgtcccgtccgactccgcagcgtccacgtcattgatctaacgaagtgcctcatctgcagcatatcgctcagatgaggcactgagcagtcagctattcctgtgccagcacctccgagattgcagaggagattgcatgggcgtcatcgctatcccggagcagcttgcggaaggctggatccatcagaaggacagcggtcttcgagagcaggcggatatgctcttccctgtctgcttccggcaggaagggggcaaccgcgatatcgaccggcttctcatcgaacgaaggccaagggacggcggtcttgttcttccataccatggcagaaggcctctagatcgtctttgcctttgcatggggcacggcaaagccttcgatgagaccggtcgtaccgagctcttcccttacaaggaaggcctgatatgcttcctcgtcatccttaacgatgcccagggcctcggcctatgcacagagcatacggagcagctcatggcggctttccgcttccctgccgagcaatatctgatcgtcggatacgaagtccatgggctccccttctcgcagcttctactcatcttcctgacaagcatacggcagatggatgcccatctgcccagaaactgtactagggaaacgatgattaatgccggttcagtcctaattcctgtgggcagccccatcacgacacagctccggaaggctccgagtagcgcctgctcacatcgaagatcttgaggaagaagtactcgtcgtccggatatccgtagcctgccctcctgagcgtcttgatcatctggttggtgccttccaccctgcctgaggtgatccggtgcctggcgtgcgccacgatgccgtccatgtgcgactcgacgagcctggcgaaccctggcgaagtgcctgtctccggtgccgcggcagacctccactatctgctccatcgcatcgcgcatgcgcttctgctgtctgtagccgtaggcccggcagagcatctcacccgcgatgtcgcaggcagccagcagctcgttttgggctatgaggtccttgtacctctggcggctgccgcccttctgggtggcctcctgctttccgaagagggcgcttccccttaagacaaccttgccagcacgtgcatcctggtccttcctcttcctggtgtccgcacaggacatgaggatgtatgtggaatgcttgagggcacgcgccgcatcggcatcgccttcgtccttaagccttgcctgcttatccttcctgaccttacagatgaccttctcgttgaagttcttcacgaggtggaagcagtcgtagacgacatccaggcgcgggtgcctcttaaggaatgcccgctcgaagtcggcgttcatgtcgcaggcgatggcctccaccttcgacatccattcctctccgacgaagtcgcacaagtcgtatacgacttgcttcttcttggagtgtgcaagccacagcacatgccccatcttaaggtctgagctgtaatcttttggtggacagtgggattcagggactggcaacagatatgctctgtccagatacccacctaccaacaccagcagattgaagagatgagatgtcggtgagcgcaagcgagatagagaaggcaaagtcccgcacgaagccggaaacacccaaacactacactgaagaagtattgccttaaggctgtcgactactacaggaaggcacgtaaggccaacccgaagaagagcatcagaggatgcgccgcaaagcttaaggatcaacgacaagaccttaaacgactggatcatcaagcactcaaagaccaaaagggtgacccaggaaaggaccgacgagcacaagcagctcgacgcagtgaacaggcgcatacacgagctcgaaagcgagaataagttcctaaaaagtggcagccttcttcgccggaagcctctgttgaaggacaggttttagctcatgctggagaagagggcaacctacagcgtctcgatgatggagcgcgtactggaggtgagcagggctcacttctacagatggctcaaggccaaaggcggtgaggacctatggggtcccctcaaggaagccatctgctagatatgggaggaaagcgacaggcgctttagctcctgctaggtctgatccaagctcacaggagatccgcggtacgcaaaatttacaggcacgactcgctaccgcgtgcgaaggtgcatggctgaactgggataggcggcatctgatccaatgcctccaagaagacgacggtgcccgcacctgatacccccgagcgccccgccctcacccggcgcgacttttcgtgtcccatcccgacagccaagctcgtgggcgatacaacctatcgcaggaccacggcaggctttatatatctcgccgtcgtagacgatctgtgcacacacatggtggtgggctgaagcatacaggacaacatgagggcaggccttgtcgtctttgccctgaagatggcatattcgcgcggatacgtggccggaggggccatattctaagcagcccaggcagccagtacataagctcaaagctggccgcctgctcagccgtacccgacgtgaggctctccgtggggagaaccggaagctgccacgacaatgcgctcgccgaatcgtttttcgccacgctcaagaacgaatggtactaccataagcgcctcttcgacgcattcacgaccaagcacaaggcacacgagtttaatcgagtcatactacaaccgcttccgcccgcataagtccataggagatcgcgtgcccgcagaggtgatgcaggagttcttcgagcgcctcgagagaggccttgcgtacgatccaaaggcgatgcagaccgcataaaaatctgagattcctctgtccattatattgacaggggtcagttcctctggcttgtgtacaggcaggtgtcgccttggcggtctacaatgtcgtcgcccctaccgcgccgcttctggcttacgaagagcgcaacaaattcaaactcttctaccttgatgcaggaatgcttgctgcagcattgccgaagaacagctatcagggcctgcttgatgggaaagcaaccgtcaacatgggcgctgtctatgaaacattcgcggcacaggagcttgcggcgcatggattctcgctgcgctatttcacatccaagaaagttggaagactcgactttctggcagagcaccaggacggcacaatcgatgcgcttgagataaagcctcagcggatcgtacatgactttcattcggcgcttgaccaggcactcgaagtgcctgagtattccgatcgacacgcctacgtctttttgcgaatcgaatatcttcgagaaagataagcgtggctctatgtaccctatattcgcttctcggtgcgcttcaagtacgaatcctaaacggtatgacatctattccctcttttaacttacgcaaatgcttcaaatccaactccgttcggaaaactttcaacagaccattgggagtcaagaattcttcatcgaccctcatcagcggcgccggcaagatagatccgcccaggtcctcccctgcaccttgaaatggggatcgcgcacgccctttagtcatcttcttcgcttattctcttcaacttcgtccttcagtctctttccttcaatcttttcctttctctttcccacccatagctgcgccccatcctattcggcttctgcgacagacgaagtttctgaattactggtcgaatcagccctctgaatatcttgaaaagtgttcagtttccttggcatttgaaatctcgaatctgtccagcgcatcgtcagaaacgtgccagcctatcctgtcattctctccgccatggcccctagccttcgcactcgcccctttctgaccagcgcatgctgctatgaaggtttaccgacaccctcattccaccgttttccggatcaaccgtcgcctccctccccctccttccattcttcttcattgcatgcaaaccatcgtcacggcacattctccggccagccacacaacctgaatacctgacgccggaatgactgactcgggatggctgattttcgtgtttgccgcctctgcatggatctgtgcgctctccccctctccctccccccccccccctcacttcatttcctctcctatggcattgcctatttccttattctactctcgtactttcccttctcctttcgcttgcttacctcctgacttcttcactcctgcaattcctcttgtcctatcttcgtttttcgtctttcctatagggcccgcacattagttcgtacgcagtctgtgcaagtaagcacgcattcttcttcggcacgaacgatgtgcaggcttccccagaaggatcaggaccgcatctgcaggcaggatcccatatacagccctgtcccctccccatcgtatcatgatgtacacattacgcgtatagcatcattccttttcttcccctcggcagccccggcaaaaaaacagaagaaactgtggggggggctagaactattttagagtgctcttgtaccttaacttcactctgtgaagcagggccatcgagtggccatgggttggctccgtcctgaaggagtccttctatacgcaccatattgcacagtatgtccctacgcatgttttactctaccagcatcgttccttgacgtgctgcccgttcctcgcgcgggccgcggcgtttcgtctttcgagacggcgaggtcgtgcagcgacattcggctacgacccgacgccggtcgccgcctgggcgtgggtccagtcttttcctcatcccttcttgccttcactctagagacggcccacgggcttcgaacctgcagaggaggctcgtcgctcctcgggctgccctgccacgtggggcgccttcctctaagatggtgcggccctggggctgcaagctggagaagtcgccgatctcgaacggcgatcccgaagggcgggtgacgggtcgagacgcgccgcgcagggcgcggagcctggaggtgacggccggcgatgtgtcggcgccgccggactcattctgtcgatgggcctgatctattcttttctcggcgctccctcgcactcccttacctcgtcgtccttactccctctctcccatatcctctctcacttgttctcctctctctgatttctctgcctcccctctctcttttctcctttttccactcttcccttccttccttcttccccctttgcgcttgaggccttcttccttccctttctccccgcgtcgtatatttggttctaatgagacgtggctttaagggccgtacgtcgactcggtccatgtctactattctgtgaccagtccgttgtctctttttcccgtttgatatcgtacatcgagacggctctgctgtcctgtcccgtgttccttttcttttttcttattgattctcgctctcgctcacttgctgcccacggccagcagcctcgagaaaatgggcgtccctctgtcgtcttgacgcgggtcgcccgagccgcaccatcttcgagacggcgcccacgtggcagggcagcccgagagacggacctcctctgcagtcgaagccctggtggccgtctctcgtagacagcccctcctccggctctcgccaagcgcccccggcgtcgggtcgtagccgaatgtgcgctgcacgacctcgcccgtctcgaagacgaacgccgcggcgctgatggaacgggcatgcacgtcaaggccgatgcttggtaaggtacaacattcaccgcctattaaggccagctccttccagcccggcgcctcctgctccactctccctcttcacagagttccctccctctcctcatgcttctagccaccccagttcttctgtttttctgccgggcctgccgctgtggcagccccggcatgctttctatacggtcatgtgtccatcctgatcgatggggagggctgtatctggatcctgcctgcagatgcggtcctgcatccttctgggaagccttgcacatcgttcgtgcgaagaatgcgtgctacttcacagaatgcgtacgaacaatgtgcggcatgacgcgaaaccgaatgaacgatgcatattctcttccgatgctgctcaggcaaggagcttgcaggaggatatcgacacgcctccaggtctccgccattgaagtgcgggggagcggaccatgatccatgcagaggcaaacacgaacatcagccatcccgagtcagtcatctccggcggtcaggtatcaggttgtggctggcgagaatgtgctcgtgacgctggtttgcatgccatgcagcagaatgtaaggcgtggaggcgactgttgagtccggaaacgtgtggaatgagggtgtcggctaaaccttcatagcatgcaatgcgctggtcagaagggcgagtggcgaaggctggggccatgcgagaatgacaggataggctggcacgttcttctgaacgatgcgctggacagattcgagatttcaatgccaagaactgacacttttccaagatattcagaggctgatttcgacagtaatcagaaacttcgtctgtcgcagcatccttctgcatttggcgctgtggcatgagaatgccccgcttgccagagaagcgaagcggagcatttgcagatgctcagcgagactatgactacaggtgctctgtccccatttcacggtgcaaacctggtgcggatctatcttgccggcgcccgctgatgaggtcgatgagaatctttgctgcctcaatgtgtctgttgaaagttttccgccggaggtttgctttgcagctttgcgtcagttaaaagatgcgaatagatttcatcccgtttaggattcgtactgaagcgcaccgagaaggaatatggtacatagacacgctatctttctcgaagatattcgttctgcaaagacgtaggcgttgtcgatcgaatactcaggcacttcgagtgcatggtcaagcgccgaatgagtcatgtacgatccgcctgactttatttcaagcgcatcgattgcgccatcctggtgctctgccaggaagtcgagctctccaattttcttggatgtgaaatagcgtagcgagaatccatgcgctgccagctccttgtgccgcgaatgcttcataggcagccccatgttgacagttgccttcccatcaagcaggccctgatactctctcttcggcaatctcgcagccattccggccatcaaggtgaagagcttgaattgttgcgctcttcgtaagccaaaagcggtgcggatggagcgacgacattgtagactgccaaggcgacgcccgcctgtacaagccagagaaactgattttcgacctgcgtgaatcgtttgatgccttgtatggagccgaaattgaaacggcgcgtcttggagaggcctggcttggaacaggtcataaatttccgaatggtcaacgcagctcgggtggtgcatacttcgtgatatcgagacggtagaggccatgcagtcctgctgtacagtcctgaccgagtcaatatgttgttagcaaggaaaacttcacggcatcagcattccgccgaccataattagcggtggaagagatcgagcagcttgtgtagaggaattcaggcagagcacgtctttcctcgaagcattgaacggcctgctgatgataccgcttcatggccattggcccagcagaattcttcgaaatccgaggatacatctgcaccttcgtgacatagccgacgggcagggaatcgatcgatcgaggcgcacgccgaggagggaaccggtgagtacgaaccgataggtgcctcttctgaccagatattgatataggtgacgatattgggcttcctgcacctcgtcgattgatgacaacggtcttgttcggcacgaggtgagatgcgctcaccggacatgcgcagctcgagatcgtctgcctcttggctgcgagaaagaggtccgtatgtcagcatctcgatcaggtcgaatttcacgacattctcgaaatggtcgctgcgaaggcatcaccaatagctcttgccgaccctggcgtgcacccatgacaagagcgctttcatggaagtgagcttcgagccagctttcaagagtcctatggcttcctgcttgacatcctgcttcccctctctgacacaaatgcgaaagttaacgagtatagacaataaatcctaaatatatgccgatagatttgcaaaaatccaagatttaaatatgcatgccagcagcatctcttcttccaagtgcttgcgacagatgcagatgcatattgcctcgctgcctggtctcagaagccttgagaaaatgaagcagcctcctttcctgagggagaggaggctgttgcatggagttggcaattggactacaaagtgctctgcccccactgcacggtgcagggaggatctggtgggatctacttgccggccgctgatgagaggtcgagaggactttgccgcctcgacctcttcgaaggcaggctgggccaatgaaggaacccggactggaggcgacttgcctcagtcgtgttgtcgaagccaagaaggaccgtctctttcggcatcgcgggtcgaagtcgctcatgcgacatagatgtcggaaggggccagcagttcggagcaaagcccagggttcggaaacgcgcattcgtcgagatgctgtcagcaagacaattgcgtgagctactctaacccccccccacccacccaccccccccccccccccccccaccccccccccccccccaacccccccccccccccccgcacgccttgtcgggaatcacgaaatgctaggcggggaaggcccagagcttacgatgtatcggtcgtcctggagggagttcggtcctcgagccagaagctgcggctatgtcccgccacgacgagcaacgccccagccatgccattggcaagggaccctgagagggccgcttcgtggcttcgttaatctgtccgtctctcccaccagcttgtccgtggtagtcattcagtacttgtcgcagtcgaagaagacgaggcttcttgccggagcttccgaatcgcctctgccaccttcgcggaagcgtgcggtcg

SEQ ID NO: 353 - DNA, 10920 bp, Unknown
  Metagenome-assembled genome
acttgtaggattgtaactaggtggttctctattcagttactaactgttggacagtgtcagatatgtggatttgggtcttatacttcttaaggtcatgattgttagtcgctgtatttcccttatgatttaacaaagcatctagcgctgctaggttgctaacataagtctgattaatgtaggtgcgaggaacgatacgcgcaactttaacataactgcccttatgataagccatcacataaggatctttgaccccaggattaagccccgttgttaaggttagtttggtccattcattccccatcgtattatcagtgaaccaagcggtccagtaaccattggttgccttattgttaggcgaaatttccttttcactaggtaatttagtgtacccgactttataggataaaaacggatcaaatcgatcaatcgtcccaatacctttataatatcccaaacataaaataccaatactaaccagtgctagtacgatcaagccacctaaaccaaaagtccaacgacgataacgacttttaagcttaacatcatgatctatctgggtagccaaagagggttctttatcttttttcattgcaatctcctcgttaaatagaagtttttcgagtgagatgttaaacaattgactcaaagcatgcagggtctctaaacttggcatattcttgccagtttcccaagttgagaccgtttgacgggtcacatgtagtttttgagctaacgcttcttgggttaaattagattgcctgcgcaaggtcttgatatcgtctttaaagctcaaatctcactcctcctaaatcataatcaaggatctaagacaatcctagcaagaattactagcattagtcacgcaaatgttacttgcacaagccaataaagccattcctcagatcgtaataacgttctgaagaatggctttagaaatgatcaaaggcctatttgtaagttataccccctgatgcataggaaaatatcattggtgttttgttttggtagattgcaagagtacaaaaggttggtagcaattaaaaaatgttcgataaataaggcggagtagcccgttaaggactactttttttggctataataatcatatactgcaaacaggaggtggcttgtattgactaaaagggagttatcagtcccagaaatcacgacagaactaggggctcactgacaacgtgtgtatcgctcgataaaaggttgaggaatgtcaattactacggcgagcctactatcaagctggatagagagcattttattgtggtaggcatgtcgcggagatacaggtgccaaaaacgcgagtgagatagaaaaaaggtgtaaatgcttgatataaagccaaagcaagtcgatacaaagaagcgcatgtcagtacaaatgatacaggagaaaactgacaaagccttacggataaagagtttaagcaaggtagtgttgcagtacaaaaagtactggcggccaagggtcaacaaataaactagcacaacggggacttgaattttaattttttagggatacaataaaattatattgataagaggtgaatttaagcggatgaaaccccttttttataaaaaaccatcgttttatgtgtttattttattttcactgttcttaggtatttcattggtatatcggagagattggtggattacaatccctcttgtactagtagttttaatacaaggatatagaacaattagataatcataaatataagttgctcttggtttcataggaatcccaaaagtatagtaaaaatggtacggtccgttactgaaattagtgattgtaatatttttaccatgctttttatatttggtagattgtaaaattaatccgaacgctgttcggattaattttacaatctaccaaatcactttgttttccaaaaacgccaccaacttttaggtatgattctttctttattatcagtttcacccaccctacattttgtttgttggtcgtttgcttgttgctttttagttgaattaggagattcaaccaaataactcaattttcgcacgtgttcttttaattgtcggttttctgttacagttgataactgtaatttttgttgctgatctatcaactttgttaaactgtctatttggcggtctttggtagcaagctgtttgtctcgttgagactttaggtcctctacttcttttatcagagttgcaaccagctcattattgtctttgttagtctttgtagtttctttgctatctatttgttggttgtttgctaacaaaggctttgctactttgtctctgataatcctttcagctttagggctaatcatgtttgtaccctgactatctttttgccgattctttgctggtagtctttggtaatgatattgaatagtctgtttggagacattcaattgatcagcaagttctctaattgttttaggcattatttccaaacccctttcggagttcagcaagcatttcttgtcttgtctgatctcttcttgttttatcatgctcaatctgtcgttcggctaaaatctgtttttcagttgagcctagtggtaggcctttaactttatcggtagcacgccatttttcttgttctgttaattcaccattattctggatattaaaaagtttttgacgctcatcttggaacttaccttgagaaaagtcgtttgcgtcttttctttcaggcttccaagtaaaagtataaccaatcactggtttcccgcgacctttaccatatttttttcgtatagttagacctctaaacaaaggggttagttcttctttaattgggcgaataaccctagattcaacgttcgcaggcttactccaatagctttgtggaatatctagtagttcaaagaaatcatttttagaaaaataagcataaccagtggttcggaattgtttaagaatacgaaaagttgtttttgcgtaactactctttaaatctcggaactctgtcaaagcataacgaacccaactttcgagattatttagaagtttcaacgctttgggataaatttgaatatcaacataaggaacgtctgcagatcccttaatttcaaatcgagtgaacatgacaaacatctctctatcaagaccatctttacttcgagagccaaatctaagacctagtattttttgatatgtactttgtatatcatcaataaaccgattatttgcggttggcttataggcacttaactcttttaactgatcaaaggtaaatctaacagtatcatcacctttatcacgcattctagaaactacagaaaagaacaagttcatttctacaggagtaaaccttcgcaaggggattgtatttaattcagggtcatatttgactaattcattgctcataaaataacctccttgaataatactaccttatttgaatacaggagtaaataaatgtagtcgataaacagacaaaatgtagtcgataaacagacaaaatgtagtcgataaacagacaaaatgtagttgataaacagacaaaatgtagttgataaacttctataagccttgggagagtaagcctcaagaggggtctaaaagaggtttaaaagaggtttataaaagaggtataaaagaggcagcactgtacgaggtcaaaacctagcaacaaaaaacacaaaggagtgagcccaaaaccggctcacattaaatttcagtcgctacgctccttgcgcctcactccgttcgttgcctaaaaggtgtggcaagccacattaattcgggcgctgacgccccgaaccccgtccaagctgagccagcttgaccgctttttcactcgccgttaggcaagaaagcaaagttttatagaaactttggctttcgccatttcagtgttaagactggtttagagctgtcaattccttatgctcccacgctacgctcgtccgctaccattgacagcaaacagttagtttttctgaatcttaacaagaatttagcggctatgttcgtttttaagggccttatttttcgtttttagcggttttgagaccgtttatatatatttataccaaagcaaaaacaaaaagccctcaacaggctcttagagggctaaataacgaagccaggacgattaataatatcttcttgtcttttttgcaaaatataagtgtataaggctttcagtttaaattcacagatcttacagcaccgttattcaaaatttgttaccaagcttataaagattatctgcacaaagcaattaaaaaattttggcttaaaacagcgtaatctgcaacactttttaaatatttaaaacataacaatcctagttaggtgcaaacataaattgaattaaaaatacagtcaattcaacaacggcaaaaactgatttcatggttatcagcagaccgagtaaaacgaggtcaatgcgcacttacacatagaatttattctatgttgtgctagacccattaaaaacctgtatcagaagtcgccgttggcgacaacaaaatcaaactaatttacccaaaatcaatttgatctaacatactttcggtactggcttgatctaagcctaaataagctaaagtcatcgcctcactggaatgatttagcaaattcatgactaagccaatattgtaatttgattgcgtgtagacccgataagccccggttttgcgcatcgtatgggtccctagataattaattcctaacagatcgccaaccttgctcatgattttgtagaactgtttttccgtgatatggcgttctgggtgttgaattgaaggaaagagccattcagaatccagctgatgaccaagcagccattgacggtacaataaaagctctgtttgaactggtttaaggtacaaggtattcggtttacccgtttttcggtcgtgaatgaatgcattttgtttaatagaaccgtccggattaaaaatatcggcctgttttaagcgcatgacatcactgactcgcagcagtgtcgctttgccaacttgaaaaactgtatagttacgccggccagctttaaagttgttgagtaaggtatcttgcacctctttgagaacgtttgaatctttgatgggtaagacaacttgttgcataagctgttagttcctttactttaaaattaatttagttgcagaaaacctaaaaatcgaatattataacgtagtacgatggtaaacttaaaggaggcggattagaatgagtaatactattattaaaaacaagacaatttcaactcgtgtaacacctgacattagtgaacgggctaaagctaatctagcaaaacaagggctaaccgtttctgagtatatacgcttatcgttagttaaagcggccaataatgaagttcgattagtcagctttttagattctccggaagccttagccgctaaaaaagaagcagaaacagggcaggtcaaaaacattggttcattgactgactttgaagattggatcgataagttagatgcaaattaaacagaccaaatcttttgaacgtgaattaaaaaaactagtcaaaaaacatttcccaataactgtcttgaagccttgtttagaagcaattgttgaacaagatgtacttgttttgaaacagattaaagatcatgcattaaaaggaaattggcgtggctatcgtgaatttcaccctgccagatatggaaactatggtaaaaattatgacaactggattgttatttatcagctagatcatgatgaattgattttgttattggttgcaactggctcccatgaaatcttgaatcaatagctatagtttaggggcacttataaaaaaataaattaaaatagcccccaatatctacattatagatattgggggctattctttcaatgtttttgaggggttatttgtaagttatagaccctgatttgtgatttgctttagtacggcaaaaatcaacaaggcagcagagaatcccaagactattaatctcaaataccacgataatcgataatatagactattctggcgtacttgagacaatcctctcctcatccaaaggaatgtaactaccataactacaatggtattaaaaacttgttgtggaaaagaccatccggtaaatatcaccaaaaggccaatggctgcaaaacaccagatatcataataaagcactaacgaacgagaatctttcaattctaattatcccctttcaactaacgaagtatatttctactctttattccttaggaaggaacgaaatatttacgttaatgatacactggtatgagacaagggcggcaacaacatattataaaaccggtgaataatccgctcatagagaaacaagtagtttgctagaattacaaaggatttttaatattttgtcaaagactctcataaacttggtttcacatcgatttagtcgatatttcatttataatgaaatataaaaaaggtatttaaaagtggtgtgctatgacgaaaacagtaaaagagttagctgatgaattgaatgttagtcgacagtatgttcagaaagtgatatctaaacttcctgcaacaaagaaacctaaaaaagtgcaacatagctaccagatagacaaccgggtagaggcctatataagggactttatggggataagtgacaacatagaagcaactggtgacaaccaaaattgtacctctgacagtaactcggattcaaataaatatgagaatgctctgttgtcacagattgataacctgaagcttcaagttaagcaaaaggattttcaattagaaaatatgcaaaagctgctagatcaatctcaacaattacagtttatggccgagaataagatcaaacagttagagaataagtcggatgatattcaaaaacaaaatggtgagccagagggtactggacagcctagtagtaacgataacgtagatgaatcaacggataagactgaacgtggcttctggtcacgtctatttaagcagtaaggagtttaatgatgaaacaaaagctagtttttggtattcaatttgtcattaacttgtggtttatgttgaatgtgattggttacttcttgaatttgtcgtggacagacgagccttggcatattttgctggatatatttggcatcttgatagccattgtcatggcttatatgattacggttagatttgaaaattgatggattttacgttgtattgtgctttcgaatacgctatcatgaaaccaagttgaatatgagcgcaaaaaaaataaagccttcgggattggcgtcccaaggcttagatgacttagtagctacagactactaaggttttctgataggactgaagaaccagtccctatctcaataacgtattttatcatgaactctggttaaataaaaccatttgataagaacacgttagttaaccttagcaggttggctaacgtgttctttttttgtggacgtggaatgactggaaacgactcccagttaaaagacgcgtgggtaatcccctgatgttggtcactcaaatcattcgttagcgtggttcgttaccccgtttgtagttaaagccaggggtatgctaaacccagtcgagatcaacgcgactaaagacgtggtaggaaacatagaaaatggaaacgaccgccctatggtcaaagtgagttgaaacacgctctcaggttaaataaaagcgcgactggcaacgaccaggctaaaagacggtagattataggggcaagggctatgtgcgcttaaacggttgttaaacggctaaattgagccacggagtaaatccggggttgaacttagttgtttagggctccaaagaagccgtttttcccattttcggggaaagactcatgagagagccagtctggctcaacctttggttgggtttaagtatctttgtgcttagttttagtacgtatataaggctgtctagaaatactagcttgttttttaataagaactattcatagttgattttgggaggcaatatgaaatttcaagagaaaattaaaactttgagattgcagggaaaaatgactcaggaggctatggccaaatctttattagtttcgcgtaaaacggtttccagttgggaaaatggacgaaactatccagatattaagacattggttaaaattagtgatgttttttcaatatctttagatactttgctgagggaggaccaagtaatgacagatagattgagtgaacttgaaaaattgagtaagaaaaatcttaggatatttaaggttagttatggttttatgatggtgcttactgttttgtcctatatatcgagtatgacacgtttttacccacgtaatgggtggttagtcatattttatgtgattagtgtagctatctgtctaacacattttcctttaactgaccatcagttaagggaatggtttgtctcgtttgatcatttattattgtttgtgattattttaattggtactggttatttggcattacaggcttcttttatggcgaccggtgagtctgcttattatctgactggtaccatcgtgggagcgatttttggcggtttaatgcggattgtatcagttatggctattgttgtattcagtcctgatagagtgctaaaaatgacagctaccagtcttgattgagtcgttttatatttttatgttggtttaggatatggaggaaggaatatgagccttaataagccttttgagaagttggtgttttctcgagtattttagccgtgttggtactttggaatctggttaatttgtttagaactggtcattagagcataggtagtgttaaaaattagatggtctaggaagaattgacgtaaatttcactaacttttcgagggcctaaatgttgatttaacggcaggcgcatttttcgaaagttaacttcacaagcccaaaaaataagaagcctgctaactcaacggttagcgggcttcttgtcataatcgggattatgttaagtagaaattggtctagctagttgatgaggtgatcatacgattaattgggttaatattgcagttttaattccattcttaattttaattggggttatttgtctaattgtgggattctggcatgattttaaagacttaaccgttattcaaaagaccggtattatcttgtgtgtcattggctacgtcgttccggttgtgttaagtcaggtaatgagaatttttcacttggagtaagaggtaggtaattagttattggtatacgcattatattaagtagaaattggtatagttgacacaactaaacagacacgccagaggcaccccgttcgattaggggcggccctttttgtttggcatggtaacggcatggctagaattgcacaggcagcacgtgatcagggtatttttgccgttatgaccatgaacacacggcaactattcttataaagattctctgcacaaagcaattaaaaaattttggcttaaaacatcgtaatatgtaatagtttttaagtatttaaagcatagcaaatttagttgatttggacgcatatattgaattaaaaatgtatttaattcaataacggaaaacctgatttcatagctataagaagaccgagtaaaacaaggtcaatgcgcacttacacatagaatttattctatgttgtgctagacccattaaaaacctgtatcagaagtcgccgttggcgacaactaaaaatccaaataaaactaaccaaaatcaatttgatctaacatactttcggtacttgcttggtctaagcctaaataagctagagtcatggcttcacttgaatgatttaataagtgcatgactaagccaatattgtaattggattgcgtataaacgcgataagccccagttttgcgcatagtgtgggtaccaaggtaattaattcctaatagatcgccaaccttactcataattttgtagaactgtttttcagtaatatggcgttctgggcgttgaattgacggaaagagccattcagaatccagcttatgatcaagcagccattgacggtacaataagagatctgtttgaacaggcttaaggtacaaggtattaggtttaccagtttttcggtcatgaataaacgcattttgtttaatagaaccgtccggattaaaaatatcggcctgttttaagcccataacatcactcactcgcagtagcgtcgctttaccaacttgaaaaatcgtatagttacgtcggccagctataaagttattgagtaacgtatcttgaatctctttaagaacgtttgaatctttgatgggtaagacaacttgttgcataagctgttagttcctttactttaaaattaatttagttgcagaaaacctaaaaatcgaatattataatgtagtacgatggtaaacttaaaggaggcggattagaatgagtaatactattattaaaaacaagacaatttcaactcgtgtaacacctgacattagtgaacgggctaaagctaatctagcaaaacaagggctaaccgtttctgagtatatacgcttatcgttagttaaagcggccaataatgaagttcgattagtcagctttttagattctccggaagccttagccgctaaaaaagaagcagaaacagggcaggtcaaaaacattggttcattgactgactttgaagattggatcgataagttagatgcaaattaaacagaccaaatcttttgaacgtgaattaaaaaaactagtcaaaaaacatttcccaataactgtcttgaagccttgtttagaagcaattgttgaacaagatgtacttgttttgaaacagattaaagatcatgcattaaaaggaaattggcgtggctatcgtgaatttcaccctgccagatatggaaactatggtaaaaattatgacaactggattgttatttatcagctagatcatgatgaattgattttgttattggttgcaactggctcccatgaaatcttgaatcaatagctatagtttaggggcactt

SEQ ID NO: 354 - DNA, 41748 bp, Unknown
  Metagenome-assembled genome
ttggtggcgtcccgacagcttcttctgatagacgggagacgcggactctgctaacagactcccgccgagtgattggctcaagggtaacgaagcacttccttcaccgtgaaagggccgctgatcgaatccagcattgcccaccaggaaatattgagggcgtcggctcagccgtcgccttttttctctatgtaaggactcatgcgccacggttagcgcaggggctcatatccctggtgcaggtttcgagcctgctgggcccactagacgacctcgaggccggccggcacgcgctgctgatctcttttcgttaggaagggaacagtggggcccatgttcgtttcttcacgaagggctcgaagggacttatagatggagccgaagagtcaaagatccgtagtcccctcgaggggcaacctcgatcttcaatctccgcgagtttcttgctgtatatccgggctaggcatggccccaccgcttcctgcaccggtgttctcccgcttccggtgcccgtgacgctgcgacagaggccgattgcgctttcccaaaggactacgcgcgtgtgccgtgtccagtggaaccttcgagcacggccgagccttgcacacggcgacgttcttctcgcacaggacccaatctccccgcctggataaaacgtgccgctctcgactacaacatgagcgaacccttacctcatgcctcgcacggacgacagatacctgccgagatctactgcacgatacttgcgaacaagcctgccataaggatattttttcgcagttcttctcctacgctgaaagcggaggactgcatccgcttccaagcgcagcctgctggacaggaccggcgtgacgttcgatgctcctgctcggactctggctgcggcgtcgacctcggcggcacatcatccttcgactattctaattccttcgcgacgtacggcgaggtcgacaaggcctgtcatgtccgggaagcgcccgaagaaaggcatgtgcgttcgcggagccaagagccgtatcaggccataatcggaagactgggactcctgatatcattctattgctcgtccgatacctatctcgactcctgcggcatcatgcccgcgacgagcgagccgtaagggagcatcctcgaagagctgacgccggtgcggcaaaagccctcattctcgatgctcttcccttacttcgcgtggcgttttcgcagatggggctttgcgtccccggagttgccgataaaaaatccgtacatctgactcgaagaattggagtatcagatgtatcagatctaacaatcaagtaaataaggggccgccagacctctttcggctgcggagcttgcatcggacaatcatcatatgggcggaccacccttgcagtctcgggccacctgtccttggccggttgacacaaaccgaacagttagacgtaccagttgagtaagcttttgcatgttggacatgggccatgcccgtgaagcgccagaggtttcgcttgagccaggagcagaggttgtagcagcttcatgctctcaaggtaccggtcgcgcacgtactcgggccttgtatgattcaagatggctccgacatcgcgtatgacccccgctgtgggcaacgcttctcggtcggcacgacgatcgcggcctttggctatgtgccgccgaaggcgtccccctgatccttttcgtgacggctgccgtgccggcaaccacggcgtatgggttcttgaagtatatctatccctcagctatacagagctgctggaggagaggcacgcttccttgcctggtcccgttatccgtgcgtgaggtccgtatccactatgtggtctcgtcgatccatatgcgcttcttaaggacgtcctgtccttgataggccatcccacgtggtaaacacccggcgcctccattcccagcgctctggttgagatatctgcatgggatttagcgatgcttccagggggcacgtttgtagcgcatgagctttaatggcgacccagccccgccacccgtagcggccatgctcgatacggtccattaagcggctgtatctgctccacatgcgggtcactcccaagctctgtgtgccactcggcgcgaggccgtcgcgctttgtgcgcgcggacctacattacgggccagcagggatgcggcctcgggcgaaggtggcgaagcccgtctgcttacggcagcggcgaccggccttgtggcctcctcccagctggcggatcttctgctcttcggcctctgctatgctggttacaggaggtattctcccatccgtataatcctgacgattccacttcgccctggaggccacccggcaaaaccgtcgccaaaccagagctggggtgggctccagtgcacattctccatttggcatgtgaattgtatccaccttggggctgtcaggacagccttggaccgcccccatttacttactgtcagatatcaagaagattagaaaagtgtctcattgaagcatatcgatgcaacagtcacttccttggcaaagtcaatgcaaacgctcatggaaagcgatgattaataccccataacgtgttagaggggaaccgccacaatgacttttctaggccgggtatgcgaaaggcagggaaggatgctcatccagcacgggaaaggagcccgcatcctggcccatacacgcaagaaggctccaagactgatcaagcgacgctggagcggggaggtactcctttttggccgtatacacattgataaggtttgcaagggcgagaaagactcgatgtggcagaatgtcttcctatcccctaggacgcttccttaagggggcagaagcgacgtttcccgagaaggaagggatgcttttctcctttgagcgtacggatgccttcctggaactcgatgcccttctcggacaagagcgcacaggccaatgcctttatggtcgaaggctttccttgcaacgctttagcgcatagatcgaggtgtgggtccttatgcgtccttcatggcgcttcgctagtccctatatgcctcagtcggcataagcgaacctgtcaatcttccttacgagtgtgtgacacaggatatgtcggatacattctaagcggtcgtctccacaccatgccaagtcccaccttgctgcaatccacgccgatatgccgccttgtatcatatacgccactccttccctttctttggactggtgcgcttaaggtcgcgcatggcccttgttcgtcgttactttagggccggtggaaggcactcaacaaatggagccgccccccgcgcctgatccctgccctttttcgttcaattcaggcgtaaagcacatccgctttgggcgaactcactcctctctcggcttaaggctatgggcgcatctttcgcaagtgtcgttccgccctcttgtaaacccctgcgcttgcatgatgtctacgtgcacagaagcgctgccaggagcgcaatccaggatagcatccttagggttccccctcgtcttaagagagcaaacattactgcatcagatacattcctaaagcatcctcctttgcaccgcccatgcctgacaagagcctggtcagtggtagtggtatctaccagaacaatccagctatctcacacaacgattgtatccctccgctccagattctctcgtctgtcctttttcctagaccttaggatttaaggtcttaaagctcatctctgtccatatctgcctttttggatatgctgaatgtgtgatgtactataccagtcccgaaacagatggcatcgtgtgggttgggcctgtgtggttcgagaacagtttgagcgatttccatacagcgttgcgcttccactgggcctccatcggccgaatttaatcatcgtttcctagcgacgaagaagactcttctcagagtcttcttccttgtaagatctgattgtgccagcagccaattcacataggtgggtccctgaaagtgagctcctcgtgcatgcccataacgccgaggcggatgatggattcgtcttaatgggaaggtagagcacaatgccatcgatcttgccatcctaccagcatggaagtcaatgtggccgttggtaccttacccgcccggttatcttaagacatgtgggccggtactctgcaggcacctggccggtctggcatgagctcttccaccggcttcggccaaagtctgcctgatctgtggatggaccccttcctaaccctctggtagccagcttgaacctatgttcaacccctgatttcgaacatggctacttttctgtgcaggtaggccatgaaggcttgcctagcagagaaggccggcgaatcatcagggatgattcccagttttccttgtgcctcggcttccaccaagcccgcctcgtgccgcgttaggtgtcgctgagatgggctcagtcgaagggaacccgccgctggtttgatgactgtttcacagccagttgaggtaactttttaaaaagctagaccgatggactcggaatagaggttgcctcgtccttgtcacgccggtcaagcgtcccgttgtcgtctgagtgacgtggccataaagaacacctccactgattgctgtgaattctagtgacattatattgcatcatagcatttatcatccccacaagaaacgaggacaagatggcatccttgtccaccgatcgtcgctgagtcactcgagacacaccttagcctgcaagcgcctccaggactttgtccaccgcagtttcgctgaccctcccgaacgattcctcgtgctgccacctatgtgaaagagtgccgatgaagttgtcaatgtggagcagggtccatacttgagggaatcttctcttcgaagacatcgtagcacccctgccacaattccgttcctcaagaggctccaggcgttaacccctcgtccccacgatgccaccagtaccatgttgatggtcataaggcccagacttggcaagggccttgtgtcctaccatgccctcctcgtccctcgtcgaccagcgtccgtggagcctcacgaaatcgcaggcgccaacggctcgcaagcgtgtccatcttctttgactgcgcactacatactcgctggattgttatagcggctgcacctcattcggacaggtcaagccctccactcatctcagcgatccgctgcgcggatgtgcgcctgtgtcaatatttcggacggcagattgtcaagctgagtgcaacatcgccctaaagacctcgttggcttcccctgtacgttcattacttcctcgctctgtcaccgatcagctctaaccgcatgctggacctcctcgtttgtgacctttcttaagttgctgcccttaggggaagaatcacacaggagcccgttggtttcttaactgtgagcttctgccatagatggtgggggtccgcgcagaagtagaactgcaacgccttcaaagggcatctgttgagccctgtaatgcctgcgaactccttgccccctatccgaagtggagcgtctcgagggacgtcccctgcagcagcccgacctctgccttgagacgctcccgctgacggtggtggcaaacaaaaaatctctttgcagcagcgcctcactgccctgtcggcagcacgagcaggcacagccacacgggtcctactccgctcaggcatgttcgtttcctcccctccctccgtcgccgaaaacgagacccgctcatcggcctgcttgggccttcctccacggtgttaatatctcgctcttgcccctcgtcgcgggccctcttgcgggcggattttgctttcccttcctgcgcagtggtgccagcagcattgcctcggggccgcttccggcagctcgcgcttggctgctacggacctacctgcagagtagtcggcaggactcaacggtgcgctgacaccacaccctcgagcctgagatatagtctatcttctccgggaccagtgtctgtccatgatgagcaagcgcaccttctgtgcaaggcaggggctgaagccgccttttcgcctgcatctcctgtggactcagccgccctccctttgtgggcgcacatgccctaagcgcccgtgccggcccgttcttcttgagcttgtggcagacgcctggagcgtcccttgcgatctctgccgcgatataggcaattgaaccttccctctgcatgcatcggtggctatgcagtctttcttcctgtaggcttgaagatgcttggtagtggcacattctttagctttcgacggttgatgtgggacaaccacatcttatccttccggagtgtgccagcttgcatgcgcgggctatcctgttgcactcagactgctcatctgccggtcttaaaagctcatcaggctctccatatctttccttttggataggctggaatggtgtggattgtaagctataaccaatccaaaagaccagattaggcaatctatgtggtatgggcactgtgtggttgagacgttttttgagccggcggacctacagcgtacagccccagtgacctcatctaggcgattaaatcaatcgtttccctatcgcccagatcttgtctcggagccactcgctgccgtcgttcacacgacctgcccagtagttaggggtcgccaaacaatggccgccgcccggaaatcacattgagccacattgtgggaagagcgacttagggctcgtctgtgagtacgaagcggcacgcacctgatctgcgtccccatggaagatgatcacaattacatcctgcggacaggccgggatatgctcaaagaagtcgtatcccatcggcgcggcaggaaaatctccttacccatcccatgctcataacgtggcaatcgctcatgcagatcctccctctccgtgcacaggcactgtgaccgcatcgtacatgtttgaaggcagtagattcagctggcaggacaatatgtccgctcttcaggagcgcatgatcctcgaggacggttgcctgggagcttctcgcggtgattcctatgtgacgagcacaacctctttcctcggtgtctcctccttgttgtgccacgatccgctcatggcaagcgagggctaacgtacagctcgtgaatggctgccttctgctctatcctgcgcttcaacgctgtcgatgcggtgcacagtgcctgtgcacgagggaggatctgcctgagcttcccaagttagtgagtaaaagcatggatgtgtcagaatttcctgcgctcctgctgggactacgactttctctttgagcatatcacggcctttcccgcaggatgttatcatttccccagggggcgcgggtccctccggatcaggtcgtgccgctcttctgtactccagtcgctccgtcgctcttcccagaaacactgtgagctccatgtgattccggttgtcggcggccatggtttcgtcgacccctactacggtcaggtcgtgatcacgatgcagcggagtggcctccgcgcccgatctggcctaggaaccgatgttaattcgcctcgtgatgatgcctggggctgacgctgtatgccgccggctcaaaaacgtctcgaaccacacagttggcccatacccacatgagccttctgtctttcagggggctggtatgtacgctactcccacacatttcccgcatatccaaaaggaatgatatttatagccctgatagcttttaagaccggcatattgattcttagtgcacaggatagccctctgatgcagcttggcaccctccgaatgctacgattttggttgtccacatcaacgtcgaaagctataagtgaatgtgccacacaagcatctcaagcctacaggagaagacttcctatccacgctgatgcagagttaaggtcaattgcctatatcgcggcagagatcggcagggaacagctccagcgtcttccacaagctcaggaagaccggccggcacgggcgcctttagggctgtgctgcccaaaagtatgtcttatattaaccacatggattcagggcgacaagggcggcctttcagaccctgcgcttgcacaaaggttcgcttgcttcatcattgacagacaactttttccctttatcaatataactatatatcaggctcgagggggtgtccatctgcccgttgagcctgccgaatactctggcgtagggcccgtagcccgccacgtcgtctgctgccggaagccggcccgaaggcaatacacctgcggcaccacctgcgcagaaggcgaaagcaaaatccccagcaagaggcccgagacgaggtgcaatatcgagatcttaccacatccgtggaggataggccccaagcagccgatgagaggttctccgtttcggagacggggaaaccacatgcttatcggagtaggacccgttgtggcctgctcgtgcttgccgacaggcaagtgaggggctgcttggcggcaagagatgccaccacttcagcgggagcgtctcttaatgccgaggtcgtgtctgctgcgggacgtccccctcagacgctcacgtcggatatgggcaaggatttcgcagggcatacagggctcacagatgcgcctttgaggcgtgtcagttctacttcttcgacccccaccatctatggcgaagctaacattaagaaccaacggggctcctgtgtgagggttcttcccctaagggcacacttcagaaactcatcaaccaaacgaggaggtcccgcattcggtagagcgtgacgtgaccagagcgaggaagggtcctgaaatacagacagccacgaggtcctttcgtcgagttttgcactgtcgctgttgacaaaatctgccctgtccgcaatattgaccagggcgcaacatagcgcagcaggctgctgaagaatcgtggaggctggccgttccccgcatggattgtgcgccctacaatccaaagaggatggtagctgctcccttcatagaagatggacacttcttgagtcgctctttggcgcccgcgatttcgtgagtcttccacgtgccgctggtcgacgagactagaaggcatagtaggacccaggtcccttgccagtctgtgccttatatcatctaaccgggtacgtggtggcatcgtggcaaaaataacaattgacgtttcggggcctggatcctcttattacttataattgtggcaggggctggctcgatgtcttcgcagagagattcctcagtatggatcctgctcgcacctgacaacaccctgtcaaaaaaagcgtccctcttcacaaggttggcagcacagaggaagttcggcgggtcacgaaaccaaaaaaaaataatggagtggaccacgtcctgggagcgcttgcaggctaagtcgtgtctcgagtgtgactcatcgctatctggtggcaagatgccatcttgtctcgttccttgtggtaatgatacctgcctatgatgcaaataaaaaaaaaaaataatgtcactatgattccacagcaatcagctggaggtgttcgttttatggcaacagtcactcagacgacaacggtacgcttttgccgcgtgccacggaagaggcaaaccctctattctcgagtccatcgttgctcatctttaacgttacctcaaccctggtgtgaaacagctcacaccacgcggcggttcccttcgaaaccccctggagccatccccgcgacactacgagggacgagcggtctctggtgggaagccgaggccagggaacttgggaatcatcctgtgattcgtccgccttctctgatagtgcaaagcctcatggcctacctaacagaaagtagccatgttcgaatcagggttgaacataggttcaagctggactactcagagttatacgggtccatccacagctcaggcagactttgccgaagcctgtttgaatagctcatgcagaccggcagggtgccctagagtaccggccacatgtcttagatatccgggcggtaattacaccgccacatgacttccatctgtcgatgagcaagatcgattgtcattgggtgctctaaccttcccatagacaaccatcatccgcctcgtgcgtatggcatgcccgaggagctctttcagggacccaactatgaatttttgctgctggcacaatcaatcgtcaagagaagaattctgaagagtctttctttcgtcgctaggaacgctgaattaattcggctcgattaggcccttttagccgccgcttaatgacatcggctgcaaatgtctcgaacccacagtgcccatacccacatagatgcctatctgtctctggttatggtatactacaccacacattccagcctctccaaagcagcttatggagaaaaaaaaccagatagatgagcttttagacttaaatcctaaggtctaggaaaaaacagacgagaggtcattcctggagcggaatggatacaatcgttgtgtgagatagctggattgtctgtagaaccagctaccactgacgggctcttgtcaagcatgttgcgcgtgcaagacgatcttaggatgtatcggctgcagtcatgtttgctctcttaagacgagggacctaaggagctatcctggattgtccgctcctggcagcgcctctgtgcactagacctcacttcagcgcaggtaccagatgcacgacacttgcgagatgctccatagccttaagcgagagattcgggcaatctctgtgcgttacgcctgacttagaacttaaaaggcagggatcacggcgcggggcggctccattgtggatgtgaccttcacctgtgccctaaagcttaacgagaacaagggccatcgcgacccttaaggcgcaccagtccaagaagggaaaggagtggcgtatctgaaacaaggcgcataatcggcgtggatgccgcggtggccttggtggcatgtgtggagacgacgcttagaatttctccgaacatatcctgtgtcacacttactcggagggagatgacaggttctgctatgcagattaggctatataggtatagcgaagcgccttaaggacgcaaataaagacccacacctctcatcatcgctaaagcgttcaagaaaccttcgacccataaagggtcattgtcctgtgcgctctgtgtccgagaagtgcatcgagtccaggaattcatccgtccgctcaaggtctgaagccatcccttccttatcgtgaagcgtccttctgccccttaaggaagcgctactagtgggatagagaagaccttctgcacactcgagtcttctccccttgcaaaccttatccatgtttatatctccactagtctgtacctcccgctccagctcgcttgatccgtcttggaggccttcttgcgtgtatgggccaggatggctgctcctgtaacgtgcctggatgagctccttccctcctttcccgcataccggcctagaaagtcatgtggccggtcccctctaaccgttaggggtttaatcatcgtttccctagcggttgcattgctttgccatgaagtgactgttgcaaatcgatagtcttcaatgagacaacttcttctaatcttcttgattctgacgtccagtaaatgtggtgccggtcccacggctgcctgacagcccaggggatacaattccaacatgccaaatggataatgtgccctggagcccacccagctctgtgtttggcgacggttttccgggtggcctccagggcgaagtggaatcgtcaggatttatggtatgagggagaatcccctcctgttacccgccatcgcagagggccgaatagcataagatccgccagctttaggatgcccagccggtcccgctgccgtaagcgacgtgctttcgccaccttcgccgagggccgcatcctgctgcccgtcatgtagttccgcgccgcaccaatcgcgactgcccctcgccgagtgtcacacagagattgggagtgccccgcatgtgggagcagctacatctcgcttcctgaccgtcttcgagcatgcccgctacgggtctgcggctgggtgtcgcccaagctcatgcgctacaactgtcccctggactgctcgctaaatccctgcagatatctcaccagagcgccggggaatggaggcccggtgtttttaccaccgtgttgatggctacaggattatcgtccttaagaggcgcactggatcgacgagactacatgtggatacgatccttccgccacggatacggccaggcaaggaagcgtgggaactctcctcccagcagctctgatagcggcttgataattcttcaagaacccctacgccgtggtctgcctggcaagccgtcccgaacaaggatcaggggacgccttccggcgccacatagccaaaaggccgctcgtcggttcgtacgcgagagcggcccaccagctttgtctacgcgatgcggagccatcttgaatcatacaaggccgacgtgcgcgatccaaacagagcattaagctcgctaaccacctctgactcctggctcaagataatacctctggtcttcacgtccattctccattccaacactgcaaaagctacctcaaactggtcgtctatcctgttggtgtcaaccaggcaggacagtggcccgagactgcaagggtggtccgccatatgtcatgatgtcgatgcaagtccgcagctcgactataggtctggggccttaattttacttgattgttagatcttgatacatctgatactccaatcttcgagtcagatgtacgattttttatcggcacctccggggacgcaagccccatctgcaaaacgccacgcgaagtactgaagcgcctcgagctgaggcttttgcgcacagggctcagcctctcgagatgctcccttacgcgtcgcctcgtccgggcatgatgccgcaggagtcgagataggtatcgccgaccatagcctgctatcaggagatcccaggtctccgatatgccttgatacggctcttttgagctccgaacgcacatgcaatcttctcgggcggcttcccgacatgacggccttgtcgacctcgcgtacgtcgccgaagaagaggaatagtcgcagatgatgtggcgcccggtcgacgccgcagagtccgagcaggagcatcgacgttcacgcggttcctgtcctgccggctgcgcagttgaagaggatgcagtcatcccgcttcatcttcgcgaagaactcgaaaatcatccttcatggcaggcttgttcgcaagtatcgtgcattagctctcgcaaggtatctgtcgtcccgtgcgaggcatgaggtagggtcgctcatggttgtagtcgaagagcggcacgtttaccaggcgatattggggtcctgtgcgagccccgtctccgtgtgcaagctcggcgctgcctcaaggtccacgacacggcaacccgccgtagtccttgaggaaagcgcaatcgcctctgtcgcacgtcaagggcaccggagcgcaggaaccggtgcggaagcgtggggccagcctctcccggatatccacaagctcgcggagattgaagacgaggttgcgccctcgagccatacgatctttgctcttcggcctcatctctaagtccttccgcagcttcttgaagaaaccgaaaatggcctcatgttccttcctacgaaaagagatcagcagcgcgtgctcgccggcctcgatcgtctagtgggcccagcaggactcgaacctcaccagggattatgaagccccctgcgctaaccgtgcgccatgagccttacatagagaaaaaggcgacggcctgagccgccgccctcatatttcctggtggggcaatgctggttcgaatcagcggcctcgtccgttgaaggaagtgctctacccttgagccaatcactcggtgcgggagtatgttagcagattccgcttctcccgtctatcagagaacctgtctgcgcccccaaagcaagcaggccacctagtggcctgcggagtaatcatagtggagaataggggattcgaactcctaccacatgactaccagtcatggtggtctcccaactgagctaattccccatgtgtgcgggaattactataacgaagcaagatttcggtcacgtatgaatttggcaagttccggccttccgctagttaagtcaaatctgtgtgtaaattagccataagcaaccgtctacctgaaccatcacgaatcaagcctcatctgttcgctgcgtgcgggctatctttgcgagcgctctccttcttcctctcatagctcctcgaccgccgacaggcaagtactgcttgctctttgccgccctctgtcgttctcctcgataaggtaggcccccacgagcttgatgagtaagtcctcgctcgggaatatagcgatgagcttctgggagcgcttcacctcagcgttacctctccaggcagttttagtgtcattggtgcactcactgcgggggggccatgggacttccaattgcgtccttaaacctgcgcaccagacactccggccttgggacaccccctcagtgagcttgcagcacgggaggcgcgcagccgctttaagagacagcggcagagacgtttgtgcgagaagtgcgcctgaaaggctgccaggcccgcttagggcagacctgctgcacagcgcgcctgcgagccccccgtgggcatctaaggcaaaacatctcatgcccgactgcctacaggcgcgcaggaggaagaactcttccaggtctcgtgtgacgctcacttcttgagcctaacctatgagctccttcatcgcgccctgctaagtcccatcgggtagatcctgtagttgaccctgacttcaggtaggtcgttcccaccatgaaaaccaggtagtcgtcctcaatgcggtacgtacgaatctcctctacgcagcgtcgtactgtgcgagtgcctcgaacactaccgacttcgacaaccctctgttacagatcgtccccatgagcgtgctcatcttcgccactcgatgtaccggcgacgaccatctcggccataatggccacaccggcaggctcgcttgcgcttgtaggtctagaagggcacattgcttgccttaggacaaaagagctatcgtggtgaagcgcagcgtgaggacgccctcctctatcgctgcggctgtcgctgcgctcgcaagtccccgcaccagctgaccctccactttgcgagcagattgggcattgagcgacttttagagcatgagcttgagtgctcctttgctgggccttcgagcagatgcattatctcgtcctggttagagtaagtttgatctgaagccatttaaccttcaagtctctttgacttttggcaattgcaaaatgatccttgaagctcaacctctggtttgttttctctgtatataccactttgcggagtgaccaccgcgcagcatactccaagaggtcactatgctaggtgctgctggccccttgagattgttgtagcaatagaatgtagttatcaactcttgctatgacccatctgtagtgaggctcgatgtctggcccatctgttctttatgcgtccccagaagctctcgatgcaggcgttgtccacaccgtgcccttcttgacatggatcagttgatcttaatttccttgagtttgtccgataggccgtgctgtggaggggtgcctaatctgagcagacccatatgtcatccgcagtgcgatgtctagagatttcgtaaatgcaccggctctcaggatgctcatctttctggagcactctcatgcatcaggagctcctgtcctatctctttcagcccctgggcatcgatgtcgcttgagaagtgggatatccgtgagggggccaatccatggcacccccttaccggaaagctcagaatttggtcttgcaacatacagtagcagggagagaccacacatgagagaaatgatggcagatagggacctattcggtggatggagagcctaaggccccgctgctgcaggaccagaaaggaccatagcatggatcgccgatgttcctgcttccagtgcggaagactgccggttgcaagggttactacgcctttccagcgtctgttgggaagacccccgatgtggcagcaactgcagtacctgcctcatctacgtgacgtaagggcatcacaggggcatcggcattcgtgccaaggcaataagatcacgaatgccacgaccacctcgtgacgacgaatctctccgaacgatcactaaacgcgaactgtcacacaggaagcctctcaagcgtatcgaggatcacgtcgctgccagacacttttcgctagagttttttcccaccgacggactgctctgagatcagccgctctggaggttccgcagcgtacagcttcgaggagaaggtacgcaggcagcgctttccacgagaactggacacagtctcttcgcgagcttatgcctactggtttcaaggcctcgctgtctactcgagcacgaacgtgctatgcacgatcagacgagattgatgcctcatccagcaggctctggcccaaggtcccgaacgacccaatcttacagtcgacgacctccgtgctgctgacgctcgaggccggcccctttccggacgtcaattggcacggcaatgcccgatgtcgcctaacaccggagacgttattcggcacctggagagaccagaaggtcgagatcggcgtccgcaacgaatcccccatcttatctccgtccacgatgctagaatcctcgagatttggctcgacagaccggcttgcaacggcgtgtgacgtttacacgccctccgagatgctccctgtgtcacaattcatcctcttcaacgggtactcgcacttcaccggcaactacggcatgcctggtggcagaagactggagttcgagaagtttaaacggcccctatccttatgaacgacgaactgccatctgttcgcctgaaggaccacgttataagggccacattgacgacagctgcaacggcttccggctgcaggtcacatcgaggcatacgagatgcggctacgaagacttatcccacgatacatcgagcagcgcaaaacgctgcttccgtccgaccgagatcgaacagttagttgttcggcggctttgcatgagcaggtcttcgcgcttgcttacaatttcgtttgcctgccttcaatcccgcgccatccggatttcttcgttatgcagtgctcgatggccgccagaagatgacgatgacctactacacgggttcgccgagagcctgccgaaggacgatcgtgatcctcactgctgctgcgcgaagtaaccctacaacaagctcaactcggcgacatcgatggcattccccgatgcgtgctcgacctgtccatggtgcaacgatcctactcgctttcggatccactgtaagtctcaaggagatcttcggcctcgagtatcgacgggcctgccgcgtgcttttacacagcctggtatgagcatgaaggccgtcatcgtcctgcttgcctgttattcctctcgcgcacagaatctccacctcggtcctacgcttcggcattcctctcgtcgaacgtccgaaggtctcgtggacaactcggtatcgcgcggcatcacgcttcgtcgagagtccttagctcctcattgggctagtgaagaagcaacagctttgcaatggagcttccgtgcatctgtccggagctccctttttcgggagggtaacgcatattgagttcgcagtatcttcgaagccatcagcaggatgacaaatgcgtccttacgagcgcggtattgacccgctctacacggcccttcccacgctccccatcgtaatcatcgacaggcccggacgcattgcagaggcgacgcatattccctggaacgacaggagcggagagcgcctgagaagctggctctggatggcggcagagaccttctacgatcctgcgaaggtcgtcaatccttcctatggacttctatttccccccggcaagggaaagtcaggcgacctccgccgaggccccgtcctttgccgagaagtgcatcccacttcctgcctctcccagatgccgcagttctgctccttcgttcttgtcgggacctacgcccgtgcaccactatctggttccggcaaaaggtgaagctcacgatatcgtacgtgctatgagggatacctgcccaagagctcccgctctgtcatccctctcccaaaacagatctggatgaataagaaccctggttcgagacagatgtcgtgcctgcgcttcagagcgagtggcgcgtgcgctctcctgacatagcaaacgctcattgcagagacctgcacaaataggcatttcacatcatgatccttccctgaacccttgtatcagcagaaggaatgggctcttcatggaagcgtacacgtcgaatcaggctcgaggatgcagggctgatgcctctggggcagcgccttcgcaatgctcgatagcatggcggcacgcatctctttttctgagccgatgccggaagagcgctctgcgctcttcacgcgagggcaggaaaggctcgaacatctgtttatcgatcttcatgctccagaaatcagggatataagagttgcaaggcttctctggatatccaggaaggcgagaggggaaagggattgcgatgaagcatacacaggacgcgaccatccccccggaaaagctcggactttcgctccgggttcgccccatctgacgacgatatcctcttggggatgtgtgggatcaaaaggcgctgtccacgaagacgaagtgtagctcacggtcacgaccctcatggcacagggcgtcacgggccctcgcttgctctaccatctccataatggcaaagaagcactcttgacccgcggcgagatcgctgccctcatcacccacgtcacgatgtctgccggatggccgaagggctggggctttgttcaaccttgccaagcatgtctggaccgaggtacgatgaaggcgcctgtgacctctcctgagttcctctccgagattttcccgtgggaattccgagcacgcctatcgaagtgactcatcggcaacagctagcttggcgcctctcggagatgctcagctcggtgctgcaacgtgacgtctatccaggctgccgccaacttcacgtgcaccgacaagggcggccaggtcctcatctgcacgcaggcgagggctggtaccagagtgggcaatcctccccaaagctcgtcccggcgatgtcgtgagcatcgagcctgagaggtcaagccccatggggggggggggagggggggggggggggggggggggggggggggggggggggggggggggggggggggggggggtttttggggggggggggggggggggggggggaggggtggggggggggggggggggggtggggggggggggggggggggggggggggggggggggggggggggggggtttatgggggggggtgttgtgtggagggggggaagtggtttatttgtgggggtggggggaaggtggggggggggggggggtgaagggagggggggggtggtgggggtggggtggtatttggtggttcgtgtgggtgaggggtttttttggggggtttgggggggggctgtggttggaaagggggcatactttttgggggtttccctttttcccataaggactacctggttcagcataagtgtccttccgtggccggcagagggcgctacgaacgagtgctcgagcctgtctataacaattactatctgtcacttgcttatcttcatcatgacggagacctggaagcattgcagcttcaggctccttgccttctggagaatttcttcgccgagaatttgttgcgcaacttattaatcttcgagtggtctattcttttcaggggcggacagaggagggcttccggtttcagcctgcaaaagttcgggaaatcgattatccgccatgaacgataacggtaatagagcgcagaagctcttccccgttctccccaaagcaagcaggccacctagtggcctgcggagtaatcatagtggagaataggggattcgaactcctgaccacatgactaccagtcatgtggtctcccaactgagctaattccccatgcggtgcaggaattactataacagaagcaagatttcggtcacgtatgaatttggcaagttccggccttcacgctagttaagtccaaatctgtgtgtaaattagctcataagcaaccgctacctgcaagccatcacgaattaagcctcatctgtcgctgcgtgcgggctatctttgcgagcacctccttcttcctctcatagctcctcgaccgccggcaggcaagtactgcttgctctttgccgcccatctgtcgttctcctcgataaggtaggtccccacgagcttgatgagtaagtcctcgctcgggaatatagcgatgagcttctgggagcgcttcacctcagcgttgagcctctccaggcagtttgaggtcctggtgcacttgcacctgcgggagggccatgacttccaattgcgtccttaaacccggcgtccaggcacgccagcgccttgggacaccccctcagtgagcttgcagcacagggaggcgcgcagccgctttaagacagcggcagagacgttgtgcgagaagtgcgcctgaaagcgctgccaggccacgttagggcagacctgctgcagcgcgcctgcgagccccctcgtgggcatctaaggcaaacatgctcatgcccgactgcctacaggcgcgcagtgaggagaggaatctcttccaggtctcgtgtgacgctcacttcttgagcctaaaccctatgagctccttcatcgcgtccctgctaagtcccatcgggtagatcctgtagttgaccctgaccttcaggtaggtcgttcccaccatgaaaaccaggtagtcgtcctcaatgcggtacgtacgaagctcctctacggcagcgtcgtactgtgcgagtgcctcgaacactaccgacttcgacaactcctctgttacagatcgtctccatgagcgtgctcatcttcgccctcgatgtaccggcgacgaccatctcggccataatggccacaccggcaggctcgcttgcgcttgtaggtctagaagggcacattgctatgccttaggacaaagagatctatcgtggtgaagcgcagcgtgaggaagcgcctcctctatcgctgcggctgtcgctgcgctcgcaagtaccccgcacccagctgaccctccgactttgcgtacagttgggcgttgagcgacctttagagcatgagcttgagtgcctctttgctggagtcttcgagcagatgcattatctcgtcctggttaagagtaagtttgatctgagccatggttgaaccttcaagtctctttgacttttggcaattgcaaatgatacttgaagctcgaacctctggtttgtttctctgtatataccactttgcggaggtgaccacgcggcagcatactccaaagaggtcaactatgctaggtgctgctggccccttgagattgttgtagcagtagatgtagtcatcaactcttgctatgagcccatctgtagtgaggctcgatgtcgggcccagctgttctttatgcgtccccagaagctctcgatgcaggtgttgtcccaacactgtgcccttcttgacatggatcagttgatcttaagtttccttgaggttgtcccgataggcgcgtgctgtgtagggggtgccttaatctgagcagactcatatgtcatccggcaagtgcgatgtctagagatttcgtaaatgcaccggctctcaggatgagctcatctttctggaagcactcctcatgcatcaggagctcctgtactatctctttcagcccctgggcatcgatgtccttgaagagtgggatatccgtgagggcggccagatccattgcacccccttaccggaaaagctcagaatgtggtcttggcaacatacagtagcaggggagagaccaacaatgaagaggaaatgatgtcagataggaaacctattcggtggatggagaggcctataggccccgatgtctgcaggaacagaaaggaccaatagcatggatacgccgatgttctgcttccagtgccaggagactgccggttgcaagggttacacgccttccagcgtctgtggcaagacccccgatgtggcagcaatgcaggacctgctcatctacgtgacgaagggcatctcacaggtgacatcggcattccgtgccaagggcaagaagatcacgaaggacacgaaccacctcgtgacgacgaatctcttcgcaacgatcacgaacgcgaacttcgacaaggaagccatcatcaagcgtatcgaggacacgctcgctgccaagaagcagcttttcgcagagttttttcccaccgacggactgtctgagacagcgctctgggagggtccgcacgacagcttcgaggagaaggcacgcatggtcagcgtctttgccacggagaacgaggacatcaggtctcttcgcgagcttatcacctacggtttcaagggcctcgctgcctactcgaagcacgcgaacgtgcttagtcacgatgcagacgagattgatgtcctcatccagcaggcgctggccaaggtcacgaacgacagtcttacagttgacggcctcgtgctgctgacgcttgagaccggccccttcgacgtcaagggcacggcaatgctcgatgtcgctaacaccgagacgtatggcaacccggaggtgaccgaggtcgagatcggcgtccgcaagaatcccaccatcctgatctccggccacgatctcaagatcctcgagatgttgctcgaacagacggctggcatcggcgtggacgtttacacgcactccgagatgctccctgtccactattatcctgccttcaaggggtactcgcacttcaccggcaactacggcaatgcctggtggcagcagaagaccgagttcgagaagtttaacggccctatccttatgacgacgaactgcattgtgccgctgaaggacagttataagggccgcatgtggacgacggctgcagcaggctatcctggctgcggtcacatcgaggcagacgagagcggctacaaggacttcgcaccgatcatcgagcaggcaaagacgctgccttctccgaccgagatcgagacaggtaagattgtcggcggctttgtgcatgagcaggtcttcgcgcttgctgacaaggtcgttgccgccgtcaagtccggtgccatccgcaagttcgtcgttatggcaggctgcgatggccgccagaagatgagagactactacacggagttcgccgagaagctgccgaaggacgtcatgatcctcactgctggctgcgcgaagtaccgctacaacaagctcaacctcggcgacatcgatggcattccctgcgtgcttgacgctggccagtgcaacgactcctactcgcttgctctgatcacacttaagctcaaggagatcttcggcctcgacgatatcgacggcctgccgcttgcttttaacatcgcctggtatgagcagaaggccgtcatcgtcctgcttgcctgttttccctcagcgtcaagaatatccacctcggtcctacgcttccggcattcctctcgtcgaacgtcacgaaggtcctcgtggacaacttcggtatcgccggcatcacgacggtcgatgagggccttaagctcctcattggctaggatctagaaagcagacagcttgcaagggagcttccggcatctgtcgggagctcccttttcaggagggtacgatatggatttcgcagatatcttcgaagccatcaggcaggatgagcagaatgcgtcctatacggagcgcggtattgacccgctctacacggcctctgccacctcccgcatcgtaatcatcggacaggcgcccggacgcattgcagaggcgacgcatattccctggaacgacaggagcggagagcgcctgagaagctggctcgggatggcggcagagaccttctacgatcctgcgaaggtcgcaatccttcctatggacttctatttccccggcaagggaaagtcaggcgacctgccgccgaggcccggctttgccgagaagtggcatccactcctgctctcccagatgccgcaggtcaggctcctcgtgcttgtcgggacctacgccgtgcaccactatctggaacttccggcaaaggtgaagctcaccgatatcgtacgtgactatgagggatacctgcccaagagcttcccgctcgtccatccctctcccagaaaccagatctggatgaagaagaacccctggttcgagacagatgtcgtgcctgcgcttcagagcgaagtggcgcgtgcgctctcctgacatagcaaacgctcattgcagagactgcacaataggcatttcacatcatgatccttccgccgtacccttgtatcagcaagaaggaaggggagcggcaatggaagcgtacacgtcgatcaggctcgaggatgcagggctcgatgcctctggggcagcagccttcgcagagcttgatagcatggtggcacgcatcgcttttctgagccgctgccggaaagagcggctctgcgcgcttcacgcggagcaggaaaggctcaaacatctggattatctgatcttcatgctcagaaagcaggggatagaagaggtgcaaggcttcctggatatctagggaaacgatgattaatgcctatgctggccgcgaaaggccacgtggctagtcctttctggcacatcattgggaattaatcatcgtttccctaggaaggcgagaggggaaagggattgcgatgaagcagacagcaggacgcgaccagctcgggaacttcgctccggagttcgcccatctgaatgacgatatcctcttcggggaggtgtgggatcaaaaggcgctgtccacgaagacgaagtgcatgctcacggtcacgaccctcatggcacagggcgtcacgggctcctcgctgctctaccatctccagaatgcaaagaagcacggcgtgacccgcgccgagatcgctgccctcatcacccacgtcacgatgtatgccggctggccgaagggctgggctgtgttcaaccttgccaagcaggtctggaccgaggacgaggaaggcgctgtgacctctcctgagggcctctccgaggatttcccgatgggagatccgagcacggcctatgcgaagtacttcatcggcaacagctatcttgcgcctctcggagatgctcagctcggtgcctgcaacgtgacgttcgagccaggctgccgcagcaactggcacgtgcaccacaagggcggccaggtcctcatctgcatcgcaggcgagggctggtaccaggagtggggcaagcctgcccagaagctcgtgcccggcgatgtcgtgagcatcgagcctgaggtcaagcactggcatggggcccagaaggactcctggttccagcatattgtccttgccgtgccggcagagggcgctacgaacgagtggctcgagccggtcgaggacaaggactatctggcacttgcctgagctgcagcatgacggagacctggaagcagtgcagcttccaggccccttgccttctgggagaatttctcgccgagaatttgttgcgcaacttattaatcttcgagtggtctatgctttcaagggcggacagaggaagggctgtccgttcagccggcagaagtcgggaatcgatatccgccaggagacgagaacggggagagagcgcagaagctctttccccgttctttgtatctccgtttctgcagcactcagatgcagaagccgggcagcatgcatgaagtgtactcgtcgcctgtcgccaccgtcgcgaagtcgaaggcatcgccgttcgggccgatgcggttgaaccagatctcgccgccgtcttccgagcagtcggggctcggcgagcgtgtccaccagtagcagtccttgccctgccacttccgctgtgtcgcttcgttcaggtgtgccgtgatgctcacgccctggtccttctagcacccatactgcgtgtctttggcattcacgatgtcggcaagatagccataaccggatgcgaacgtctcggccgtgcgcgtgccgccaagctctgccatcgagaagagccagattgcgtcggtcgtggatgtgatagagctggcagtgcgagtggatctggcattgttcgtgagcttcacggcggggacgatgatgccggatagctcgtccggaaggctgtccatgaagtcctctgcgagccagctcctcatgttgcactgctcccagccgccttcgggcatggacgcatctgccattgcgcgggctgcaatcgggttcgtgaaggcaaatgtgaggcctgcctttccgccatcctccgtatcgtcgtgccagtagccgacgacctgggctgcggtggtcgtgccatctgcgagtgcgatgctcttcgtgaggccgtctgtgacagagccatcctcgtcggcgattcccctgtcatgcgcaatcgaggcggcttcgtccaggcttccggcagaggcaatggtggaagcgatgtctgagatctcgctccagctcttcggacgcagcgccacataggcaccgaatccggctacagcagcagcggcgacgacaccggcactgatcaaaaggcttcttcttgtaatgacaggatgccttgtggaagcctgcgaggccacagcagagcttcctgccatttctgtctggatcttctggaagcgcttctgagtctcctgatgctctgaggtccagaggcgcgtgccgctcctgcgcgatggaatctcctcatggtgaagagtcgaggctctgtcggtcgtctccttctgccagacagcaatctcgcggaagaggatgcgggcattcggacgctctgcctgggataccttgatgcaggacatgatggcatccgtgaggccacgatcttccggcccacgcggcttcaggggaatgggctctgactgtgtctttatgaggcaggcatcctcgccgggatggccggcaaggcggaacggcgtcgtccctgcgtacagctcatagagcacgcttgcaagggcgtagatgtcgatcgagggagagcgccttgcaaggatctggctcctgtcgttcagggccagtatctcgggtggcacgtattccggcgtcgcggcacgccagacatccatcgtcgtcgtgaagctcgcgtcgtccctgcgcatgaagatggagctgccgaggtcgatgaggcagcactcgggctcctttccatctttgaacggcactccatcgtctatctggatcatgatgtttttcggagagatgtcgcggtgcacgaacgtgccctcgagatattcggtcgagatgagcgtctggaggacggaaagtgcgatggcggcaacggccgtgcctggcgcgtcgccacccttccctcggggggtgaggtcgcttgcggctgcgtccctgagcgtctggcccgcgatccattccatcaggatgccggggtcgccggcatgcgtcacgccgtaaccgaagacatcgggaaatcccttgagctgcgagacagcgagctggtttcggtattcttcgaagagcgcagcctcgcggtcgcgccgtgcgaacggatctgcatcctgcggcacggggtagaggcgcttcagcacaaacgatgcgccctccgtgttctgcacatggagcgcctgcgcgtcgctcaggcacgttttctggctgcgctctccttctgactctgcgaggagcgtcatatagcggcgccttgtcttcccctcatcggtggggctcacggcaaacgaggtatcgaactgctcgaactcgattatctcgagcccgtccgtgccgggcttatcgctcgtttcctgcatcgtgcaccttccgcgtatccctgtccgatcctgcaaggtccatcaccaagaaccgtgtcgtcgtgccaagacagagcgtgtcgctcatggagatctcgacagggccatagtccttgcccggctctcgctgtgcgcggggaggctcgatcgtatagatcttcctgctgtcgcccgagatgagggtcgtgccattcgtggagctgagccccttcacccaccaggtcccgttctcgcgccagatgcgcaggtagtttcgagatacgtcgaagcccacgttcgttattgcatgcgggccggtggcaagagcgccgatgaccgtgccggcaggatcgcatgtgagctcctcgattgggggctgtgccttgccattgacgatgcgcatgaggccaagctgtgcatcgctttcctggtcgctttctgccttcgggaaggctggaccgaaattggtctcggtcgtattgatcgtgagctcgaggacattcgatgcatagtcctgcacgaacgatatcgatggcggcatcaggcttgccgaggcagccgcagacgatgaagagcatgaagcagagctgggctttcgcgttgtcggaaagctggcctacgaaggcaatcttctggagcgcattccatagaggttgctgtcctcgccggcagcattgagcgactggcacatcgcatcggcagcagggccggcgtagtgctcatggagctgctgataggagctgtcttctccgccgagatgcgacaggatgacagcctcgagctcctgtgtcgcatgggcgaaatcggcaaaatcgtctgtctggtatctgcctggcatcgcatgcacgatatctctcgagagaaaggtcctgccgttcatggcacgggaacgaaggggaaaccccttcgtgcgcgagttcggactcagaagcacgagtgccgcatcgcggttcgatatgcggccgaatgccttgagatctgcatagagtgtgtagctgagcaggtccatcgcaggcatcagtctttcatccggaattgcagagcagcttcagaggtgaagcaaagcctagggaaacgataattaattcgcctcgatgaggtagctggggccacacgctgtatgccaccggcttaaaatgtctcgaaccacgcagtgcccatacccacatagatgcctatctgtcttctggatatggtatagctacatccacgcattccagcatatccaaaaggaagatatggacagccagatgagcttttaagaccttacatcctaaggtctaaggagaaaagacccggcgagaggcacacctggagcggatggatacaatcgttgtgtgggatagctggattgcactggtagataccagctaccacggacaggctcttgtcaggcatgtgcgcactgcaaagacgaagcataaggatgtatctgctttaggttatgtttgggctcttaagacgagtaaacctaaagatgctatcctggattgccactcctggcagcgcttctgtgcacgtagacctcatgtctgagcaggtgccagatgcaacgacacttgcgaagatgtgccatagccttaaagcgagaggagttcggcaaagcttgtgctttgcacctggactcagaagcttgaaaaggcagggatcacggggtgggatggctccatggtggatgcgaccttcacctgggctcttaagctccacgaagaacaaggaccatgcgcgcgacccttaaagcgcatcagtccaagaaaggggagcctggcgtatcggatacaaggcgcatatcggcgtggataccgcaggcggccttgtgcatggtgtagagatgaccgcctagaatgtatccgacatatcctgtggcacatgcactcgtaagggaagatgacaggttctgctatgcagactttaggctatataggtatagcgaagcgcccttaaggacgcataaagacccacacctctcatctatgcgctaaagtgttgcaaggaagccttcgaccatagaaggtcttgcctgtgcgctttcagccgaaaaaagcatcgagtccaggaaggcctccggccgctcaaaggtagagcatcccttccttatcgtgaagcggcgcttcgaccccttaaggaagcgctacaggaggatagagaagatgcctgcacactcgagtctttctcgcccttgcaaaccttacccatgtgcatcttttgccggcaggctgcacctcccggctcctagagtcgcttgatccgtcttggagccttattgcggtgcatgggacaggacggtggctcctgcacgtgctggatgagcaaccttttctgcctttcccgcataccggcctagaaaggccgtgtggtcggtcccctctgtgacacgttatggggcattaatcatcgtttccctaggatagcgcatgccatgagcttcgctgttgtggcaactgaacggcaacgactccttcagacaactttgcagaactcttcaggtacagctgcggcgcggagcgcatcaggccccgtctgcgacatggcgaagctcgtcgaggaatgcctctcctggcttcgaaagcaggcggaacttcttccagatcaggtaagcacctgccgtgagcgcagactccaggggcacaaaggctagatcggcgtggcagacgctttcgatcgagagggccaaggcaaggtcttcgcgcacaagcagcagggcattgccgatcatatcgtggcgtccgacgatataatagcttccctcctggagcatgccctgggaccaggtaccgaggttgaacgacttatgcgtcgtgcgggacgagaccatgaggtcgaggccctcgaaatcttcggaacggacgcatgccttctgggtaagcggatggtcagtcgggacgataaggccgacacgctcttcttacggcagcttcagatggtcgtacttctctaccttgaacggctcgagcacgacggcgaaatccacgacgccacgctcgaggcgctcctcgattgcatcggcattgccggtcgagagctctatctggacctttggatggagtgcatggaccctgcggaatgcctcgacggccgatttcatggcgcgggtctcggcggcgccgatgcggaccgtgccctggagctcggctcccggccctacttcggactcggtctgctcgaccagtgccaggatctcctctgtgcgctggcggagcctcatgccatcctcggtgagcgtcgtcgcgcggttcgttcgcacgaagagcgtgcagccaagctcattctcgagctcggcaatctggcgcgagagtgtcggctgcgtcacatgcaggacgttggctgcctctgtcatgttctcttcgcgagcgaccgccaagaagtatctgagggtccttatctccatatcgcaccccgctctttagctatggatggcagattctgcaggaagcatgctgctattggttcaggagtctggatagcttcatgatgacacaagctggtttgcggaagccccttggactttgcctgaattggcagcgcgtgttgcggggagatcaagtgcttaaaatgcaccatcattcttgtgctgtctccttttttgcaaagcagaggacatccaggagcgacgtgagatcttgttcagaactcaagctcttagctgcaatgcccaatgtctcgagcgcttcgcctgatatagagtctgatcggcggccgagatggggattgccctcagcgaaaaagctcatcatgtgtgccagtgcgctccataagggctatttcctcatccgaagtccagataagtagccagtctccggcgttcgctacatggcattctctgcttcctgcccagttgccggcgagtgcgtgcatacggtgatgcctgcgcagctcttccagagcctctggggtattttctgcaatgagattgatgacttcggaaaggggagcatcatcgaaatgcttcttgtccaggcgcttgatatcctttctgaaggatggcaagtactcgatccgaaggtgtcccatcagcgtttcgctcgtatcgctgcaagcatgtcttcggctgtctcgtatgatttgccggtcccgcctctggacatgatctcagcgccttcacggagagcggcgctggtctcatcattcggaatctcattgcccagattgagcgggatggtgtgggtgcgtgccatctgcttccagaacgcccgggttaccgaggaaaggtcgaacccgtagtactctgctacctcctgagctgcttttttgtcgttttcatcgcagcggatggtcattgttgtcattttaacctcctaatatacatcttatgtatgtacattgtactatacccaattcatgggcgtagaccacatggtgacggaagatttaagaacccttgtactaagagcgcttgcatgaactgtctctgttgctgaggggaaccggagaagctgcacctcaatgtcagagaaagctttgagggggggggaagatcgagaatgcttcagattgggctttttccaatcagcatcttcatcttgcaatggaagagtctcgtgctgtctgcatggctggcagatactccgtgagccgaggagggttgatgcgcgccgtagccaagaaatgtagctgcggtgcagaagcaagcggcaccaatagatgagagctttccgaacacgaaagatgcgttgtctttgatatgttcctccatggagagcgaatggcagagattcattgcagaaggacgtcgagggtttcgagggcatctgtatccttctttcctgctatgcccgcacgtatggcaagcttcctcactaggcgggctggctgacggacctacgcttgatgcgggaatcaggagagaaaggacttctcatggcaaaggcattggttgcatatttcagcgcttcaggcacaacgaagcgcgtggcaaagcgtctggccaaggcggcaggagctgacctcttcagaatcgagcctgaagtgccctacacgtcggcagatctcaactggcgagaccgccagtcacgtacgacgaaggagaagaacgaccacagcatccgtctggccttgaagggtgcggtgctcgatgtgtccggctacgacgttgtctatgtaggctttcccatctggtggtacacatcgccgaacatcgtgaacacgttcctcgagtctgccgatttctcgggtaagacaatcgtgccgttcgcgacttcgggtggaaacaatgctgcagcctcctcgtgcgatctgactccctctgcgccaggcgcccagggagagcccggcgtgttcttgaacggtgccacggacgcccgtctggtgaagcttgtacagcaatatgcctaatcggacgaatggacgtgcagctctccctatgatgggggcaatggattccggagaaagaggtgcttcatggaagagaagccaagaccaggcacaggcggagatatctacgttccctatgaggagcgccagggcaacgagtcgatcgtctacttcacgcgagacttctctgcacaagggcttgcccgtgtctacgagcaggtaaacggcaatatacatgggaaggtcggcctcaagcttcatacgggcgagcagcacggccccaacatccttccgagggactgggtcaagtctcttcgagataaggagtctgagctcagggactccaacatcgtcgagacgaacacgtactacgagggcgaccgctacacgacagagctgtaccggaagacgctcgaggtcaatggctggacgttctgccctgtcgacattatggacgaggatggcatcgcagacctgcccgttgcgggcggcaaatggttcgacacgatcggtgtcggcgaccatatgctgggctacgactcgctcgtcgtgctcaccacttcaagggccatatgatggacggtttcggcggctcgaacaagaacatcggcatcggatgcgctgacggccgccgcggcaaggcacagatccacacgacgcccggttcctccaacatgtgggatatcgccgaagaggagctcatggagcgtatcagcgagtccgcgaaggcgaccgtgggcttcttctcctccgatggacgcgcgatcacgttcgtgaacgtgctccgcaacatgtcggtctcctgcgactgccaaggcatccatgcagcgtcggccgtgccgccgaatgtcggcatcctcgcctcgaccgacatgcttgcagcagaccaggcttcggtcgatatggtcttcgctatgaagccggaggagaaccacgaacctgacagagcgcatgttaacacggcatggcatgaggcagctttcatacatgaaggagctcggcgtcggcaacaactgctatgtgctgatcgacctcgatcacgatggcaggcgcatgagcgtcgaggaggcagtcgcgaatcttatgccgtttgaaggctagcggcacagctcatagagaagaggagcggaaggagcgccgagatgggctccttccgctctctgtgtcttcaggccttgtatctctcagcagaatctgccttgcttccttgtggcaaggaaggcatcgaggtctttctccgtctggtcggcataggtatgggcgaacgtgcaggatgcctcatccatagcattgtcgtctccgagataggaggcaatcgcgaagcggttaccggtccgtgcatgcgcacgggcaagcgtccagctgcagagggcagccagatgtgtgaggcggtgggcatcgatcttcgtgaggtcgggtgcacccttgccgtcccagagctggcgcacgtagtagtcatgcagacgcccatcttcgccaggaagccttgtccagccgagcagcaggtctgaggagacctggatggcacgctggccttcggtcaagtccgaattcgtgtgtaaaatcgctgccgcattccctgccttacgccttcgccatgtccttctggttgcacgctatctttgcgagctcgtcctccacctgcaggagctgcacgtaagtcctatccgtagtagctcttcctctgcatcgagctgcgagctgcactcgttctcctcggtaaggaccgacccgatcagcttgatcgccgccgccttactcgggaagaccccgacaaagcaggcgcgcctctctatctccctgttcagcctctccaggtagttggacaccctcatgtacaggcgcatcgcggcgatcagcaccctcgccgcccttaaggcgacgccgcacaagtgcgccagtatctcgtcgcacctgtgcctctcctccggtgcgcttggcagttgagcctctcgaccagctccccccttaaggccggcgcacacgcccttgggggtggccttacacacgttgcacgagaagtgggcctggcagcgctgccaggcggcgccgggcagcacctcccttacggccgccacgagccctgacccccgtcaatataatggacagaggaatctcagattttttatgcggtctgcatcacctttggatcgtatgcaaggcctctctcgaagcgctcgaagaactcctgcatcacctctgccggcacgcgatctcctatggacttatgcgggcggaagcggttgtagtatgactcgattaaactcgtgtgccttgtgcttggtcgtggatgcgtctaagaggcgcttatggtagtaccactcgttcttgagcgtggtgaaaagcgattcggcgagcgcgttgtcgtggcagcttccggttctccccacggagagcctcacgtcgtgtgcggctgagcaggcggccagctctgagcttatgtactgactgcctgggctgcttagaatatggcccctccagccacgtatccgcgcgaatatgccatcttcagggcaaagacgacaaggcctgccctcatgttgtcctgtatgcttcagcccaccaccatgtgtgtgcacagatcgtgtgcgacggcgagatatatgaaacctgccgtggtcctgcgataggttgtatcgcccacgagcttggctgtcggaatgggacacgaaaagccgcaccgggtgagggcgctcgggggtatcaggtgcgggcagcgtcgttctcttcgatgcattggatcagatgccgcagatgcccaagcttagccatgcacctccgcacgcgatagcgggtcgtgcctgtaaattttgcgtaacttcggatctcctgtgagcttggatcagaccttgcgaaagctaaagcgcctgtcgctttcctcccatattgcgcagatggcttccttgataggaccccataggtcctcgccacctttggccttgagccatctgtagaagtgagccctgctcacctccagtacgcgctccatcatcgagacgctgtaggttgccctcttctccagcatgagctaaaacctgtccttcaacagaggcttccggcgaagaaggctgcctcttttttaggaacttattttcgctttcaagctcgtgcatgcgcctgttcactgcgtcgagctgcttgtgctcgtctatcctttcctgggtcacccttttggtctttgagtgcttgatgatccagtcgtttaaggtcttgtcgttgattccaagctctgcggcgcactccctgatactcttcttcgggttggccttacgtgccttcctgtagtagtcgatggcctcaaggcaatacttcttcagtgtagtgtttgggtgtttccggcttcgtgcgggactttgccttctctatctcgcttgcgctcaccgacatctcatctcttcaatctgttgactgtgctgggtgggtatctggacagagcatatctgttgccagtccctgaatcccactgtccaccaaaagattacagctcactcttccaccggcgacacgcagctgcaccaggacgtcgaactgccttgagaggctcaacgcagaggggatgcgctgggcgaaggcttcggcgtgttcttgagtaagggctcgctaataaggctcgtcgggacctacctcatcgagggaaacgacaggtgggccgccaagagcaagcagtactggctgccggcggtagaggagctatgagaggagaaagggggatctcgaggagatagcccgcacgcagcagcggatgaggctcgcttcgtggcggctcgcaggggcgtttgcttatgaggcaatttacacacgaattcggacttgacctgggtgtgagcgtcctgcagacaagcctgcaggacacgcctgccgaggaggtcttcgcgctctacaagaagcgctgggcgattaagacctacttcgactacttcaagaacggctaagacgcgcatgccctgtgccagcaggactaccacaggatgcaggggctggcgttcatcctgcttgtgagcgccctcgtccaccaggaggtctcggaggcgctcgaggccctgaaggtcaaggctgccaagcggcatggtgtctggatggcctgcaactgcaagaagaggcgtgtcgagctcttcgagaagctcaacacgccattggaggtactccccaaatgctgactgtctacctagaaatcctagttgttgtggctagatgatcggcgaaatgaagatatgccagccaaatctcccaaacagagggactgtctctattccttgaggtggtcatagagcccatcctcctcgtcgttcatgtcggcgggtaggatggtagctccgtatcttgggtcggcacgcatgactctagttgcatcatagcgtggggactcgtttggtcgcatatcaaatggcagtccgcccacgtcaattgacttgattaaaaaagtgttcactgcgtccgaaaggctcattccccagtgagagtaaatctctgtggctttggccttcacgtcgggagacacgtacgatttgatttcggcagttctggatgccatgatgaacctccttaatctataccttatctagacacagtattcccctatttgtcccgtcatatcgaaggataatggtgcttcttcgtcagaggcacattaatgtagtttggcaaagacggatgagtaacatgcaggggggctttaatcatggccgagctgggcgacttgaagcttaacgaccgtccctttgccctgtaagcagttgtggacggcgtaacgctgcggtttggtcgggccgtgcacggtgctggcggggtgaaggacgtcgttctgtgcactgcggaggatggtagggagtttgcagtcctggcaagtgagtggccaagtcagttggaccagattgctacgcgaaagagctcggcagcgcagaagattaccctcttcaggtcgctttttgtggaaggccggatgcatttgctactggctatctgcgcagagatgggcgcatggaatatagtcccgcgtgctcgaatttgtggaagcccggtctatgcgattgccgccatgtgaagtgcagcgaatgtccgaatcgcaacttgcatgcaattggcgaccgtactctgattaggcatttcgtgggctcggactttcggcggaaggatgtgctgggtctgtatcccatgaccaaggactctacatgctggctgctggtgacggactttgatgacgatgggtggcagaaggctgctggtgcgtatcgtgatgcatgtcggtgtcgcggtcttttctgtgcggtcgagaggtcgtggtctgactgtggtgcgcatgtttggttgttctttcaggcagaagttcctgcggcgaaggcgcatacgttgggcacgctcctgttggacgatgcgcggcgaaactactccaggataggactcgattcgtatgaccgacttttcccaactcaagacactataacgtcggatggcctgggcaacctcatagctctatccctgcggggtgtcgctgttcggggagggcaacagcgtatttgtggatgatgcgtttgagccatatgacaatcagggggtgtttctctcaactgtcaaaaaggtgccagctgtagtggtgcatgggctggcggatggctatgttgtccctggaatgggaggaggcaaatctcgctggagtagcgagaaaaatgaggtaatccagaatgacttggccacccagaatggcgcgactgttgccgatagcgcggcgcccgaaatcgctgcagcccagtgcctcacgtcgttacaagttgatgtcacgttggatggtatggttcagctgagaaagtaccagctgccgcaatccttgctggcagacttgtcgtagatggcggctatggcgaactctgagttcttcttaaaacagcgtatacatcagaggatttacgcaaagactacccctcgcttcttgtggtttggcgaggagaatgacgatgcgttgtgcctgcctcgcggatgccagggtgcggctgtgccctacttgtgcgaatgtgactgcgaggtcgatttgcacgacgagtggacttttgggcacatgattcattccagctttgtcgggaccctgcgtgaggggtaggacgatgcgatcaattcgcttgtgcagcacgacgatggcatgctggtggctcctaccggattcggaaagaccgtggttgctgcaaatcttatagccagtaaaggtgtcaccatactggtgctgatacctagggaaacgatgattaattcgcctcgatgaggtcactggagccacacgctgtatgacatcggctcaaaatgtctcaaaccgcgcagctcccatgccaacatagatgcctatctgtcttctggatatggtatagctacatccacacattccagcggcagattgtcaagctgagtgcaacatctccctaaagacctcgttggctgtcctatatttcaggaccttccttggcctgtcacagatcagctccactacatgctgcacctcctcgtttgtgaccttgctgaagtctgtgcccttaagggaagaacttgcgcaggagcccgttggtgttcttaactgttagcttttgccatagatggtgggggtcgcagaagtaaaactgcacgcctcaaggggcatctgtgagctctgtatgctctgcgaactgcttgccccacttaggagtgagcgtctcgagcgggcgtccctgcagcagcccgacctcggccttagagacactcccgctgtcgtgctggctctcttcgcggcaagcagcctcactgccctgtcggcaagcacaagcaggcacacgggttccgctgccacgagtgtgtcgtctaccaagtcgccttcgggcttcgaggacgagacggtcgctgtgataaaggagttctgctccggctgggccgacgtaaagatgaactcattgatggatgctctgatctatccgaaagatttcagcggcatgaagccggcgcttatgctcgatgcccatggagacgaggtcggcagcatggtccgctcgatccactcgaacgggaccatgggcttcgtcgagttcggacgcttttctccccatgtgcttgcagggcaggatgtctatgtgcgcacgacagaaggacaatgggcccttgccgtcatcggcgtgaagctgccacacttcatgagcgaagcagagagggcttccggcacagaggagctcatcctcgacttgcggtgccacctcgaaggaagaggctgtcgagtgcttccatatgggcatgggcgagccgttcgtgccagcgacgcagtctgtctatgatgcggagtacggcatcgccttcggcaaagccttcgaccgcaaggcaggtgtcacggtgctgctcctggcgttgagagagctttcaaagaaggacctgcctttcgatgtaatggcctcgatcgtgtcgatggaggaggtaggggagcgcggcgttgcagttgctgtcaggaccttccaaccgaagcttaccttcatgttcgaagggtgtccggcagatgacgtattccttccgtccgacgatatccaggcggcgctctacaaaggcccgatatttcgctacttcgactgctgtatgataacgaacccgagatatcagcgctatgtgcttgccacagcgagagagcatagcctcagggtgcagacaagcgtgtgtgaaggcggcagcgctgacggagaatctgcgcacatgctcgatgtgccgagcgtcgtggtaggagtcccgtgccgctacgtctatgcagggtgtgcgatctgcgctctcgatgatatcgaggaagtagcaaaggtctgtgtggccgtggccgagtcgctcacgctggaagaggcagagtgcttctgacaagaagaaggaggcagagcctgagccctgtctccttcagagttctttactattcgttgagatctatgctgtctgagccaatgcctctttgaccatgacagcgactacaacacggcagcgtccgtagcgggtgtctgctccggttgcgcactcgacgtcctcgacgctttgtgctcctgccgccactgtctatagtctccgcgatgattcttcatcgcatcatactcggcaagcgcagccttgttttcgcattgggcagacacgcttccttcgaacggtatgccattcgtgacggacggccgcttttcagaaacatggtatgccaactgtcactgttcaatccccaaatcgtttaaacaaatcctcggcagcaggaccgttcacatcggcatctacacaattccgtttagtatttgctgtcggacattgaccccctcttccccactattgtctgatatgttgtatactccttcgcaaatgtattgtaatccacaagcaaaacatattttactatcgcatacctacaaagttagaattcccattcaaggaaggaatctaccttatggttacgaaaagacgaacgtgaaaagatcgagacacctcgctgcaggcgatgtcatccacgaagagcaccccgccgaagcgtgccgagagtggcataagcttcccgccacaaacatgctgtctggagagcctgccatcctccggacaccatcacggtgaatgggactcgagaagccggcatcattgccaccacccatcaccacgtaatggagaaggaagtacgctgggcacacgaggcggcggctacagcaccgatgaggaaggggctcgtcttgcccctgccatgggaacgacgagggaagagtattccgaccagc

SEQ ID NO: 355 - DNA, 13319 bp, Unknown
  Metagenome-assembled genome
tcttctttcgccatcgatccctgctgaaagcggtttacaacccgaaggccttcattcccgcacgcggcctcgtcgtctgcatcaggctttcgcccattgtgcaagattccccatactgcgcccccgtaggagtctgggccgtgtctcagtcccaatctggccgggcgggtcgtctcaacccggctaccatcattgccttggtaggcttttttttaccccaccaacaaagtaacagggcgcgggcccatcctgtgccgctaaacacttcccactctttttcatgtgagaaaagatggaggtatccggtataaccacggtttcccgaggctgtcccgatgcaaagggaaggtgcccatcgtgttactcagccgttcgccactctatacacacccgaaggtgcttaaccgttttcgatctgcatgtgttaggcgcgccgccaggtcatgcctgagccaggatcgaactctccgttcaaaccatttgcatcaagcaaattgcaagtcaagcaaatagaagatgaaatgaacaggtgtgttcctgtatcgaatgatccgctcgccaaataaaaaccggattcatcatgtagttctcttttttaaagaaagaagaaagaattgacggaaggacatggtgtttaataccaaatacaaaccgttagtacatcaaatcagtgttcttttagtgtttgtcacaacacagtatccggttttcaaggttcagcgcactttgaagaccagtgccccgaagcgcgagcattaaccctacacgcccaccgaccccgaacatgtgggatttgtcatgttcacagaatggacacaacataggacgtttgggaaataccaaatattttaggaaatgacctatagagagctggatctgactagctgaatcgcggctttcatcagcttcatgcgctcaacactattcgaggcttccgcatagattctcaccatcggctcagtctccgaagcgcggatcattgtccaggatccatcggaaaacgtcagtttcagtccatcgccgtgcgagacgctcttcggtttcttccctgcaaggctggagggattgagtcctggcagcatcagacggaacgaatcgatcgatccgtaatccatacggatatcgcgtcttccatagtcgtagtggccgatcgcacgctccaactcctcttcaagctgggagatcggttcgtcacgcatggcacgatattccaccattaagagtgctgccaaaagcccatcgcgctctgggaaatgcgaggggatacatacacccccatattcctcagtcgcgagcatcacttgggcatcccacatctccgcatagagccggttaaagccgacgagcgtctcggttagtggaatccccaaccgttttgcctgagtcttgatcgcagaggagcaggaaatggtcgccaagacctttccgttgcgcttccgatcagttaccagatggtccatcaacagcgggatcatagttttcggcgtgagcaggttgcccttctcatcgaccactgagagccgatcggcgtctccgtcaagcaccaatcccatatccgcttttgaggacacagtcccagcttcgcaatcatcgacccacggctccatcgggtcaggatggatgccggcaaaatcatcgtgcaggcctccgtggatctccgtcacgtcgcacccgatatcgcgcaatattcgggcgagataaccctcgcctgctccgtacatcggatcgaccatcaccttcagatgggcattgcagatgagatctttatcgacataggaaaggatgtggcacaggtaatcatccatcaaattgattgtttcataggatccacggccttcgggggcggagggcggcatcgtcgcttccagctcatccttgaagatccgcgtcgcagggctgccgtcccgcatcaacagcaggaccccaccataatctgcgggcgcttcgctcgctgtaatcattaaaccgccgactgcatcaggatctttggagatgctccatcccagcgccggcgtcgggcagatacggtccgacaggtacacccgtaagcccttagcggccataacctcagctgcgagcatagccatctcacgcgaagcaaagcgcgtatcgtctccgactaaaacccgcgaatggggctttgcctcttgccatattgtggcaacaccatcggctatgcgtgcaactgattcttcattaaatccgtcatcataccgtgcacgccaaccgcgagtgccaaatcggatgatgctcatggaggctcctataattgtgtagtacccagggcttctttgaaagcttcggcatattcaggatcgctcagcgccatcctggcattcgtcgcagcccaagcggctggggttccggtatcgcaaccctcattcgggtcgactacaagcgcgtagatatcttcctctgaaagtagtttgactaaagagtcggtcagctggatctctccgccagcgcccggctcctgggtagccaaaagctccatcaagcgcggcgtcagaaggtagcggccgacgataaagagatgcgagggggcatctttcggctccggcttctcgaccatgccggagagtttccacacggcgccttcctgctccgggtcgctgagcttgcacccatcataggacccgatacaggtaccaccgacgattccgtagcgggaaacctgatcctctggcaccggggcgaccgcgatcactgaacatccgccgtgcgcctttgagacgtccgccatgcgcacgcacatctgacggtccggcacaaagtaatccccgagcagaacaaagaacggatccccatccatcttatctgcagcgcagtggatcgcatgacccaagcccagcggctgctcctggtagacgaaggagacgggcagactgcctgcctgctttacgagatccgcaaaggtatccttgccacgcttgcgcagcagactctcaagctctaggtcttcagagaaatagtgctcgatttgaggcttctcatgggagttcacgagcacaacctcgtcgacccccgctggctccagcgcttcctcgaccacatattgaatcactggtttgttgagcacaggtagaagctctttgggcgtgcatttcgttgctggcaaaaatcgcgtccctaaaccagctgctggaataatggccttcatagaagcaatcctccttatatcggatggacaggtaaaacccttttctggaaccaattgtcgtaggataccccagccgctctacgcactgccttcctatatgcctaaggcttcagataatccgtggacggcatccgcatgagattttccacaccactccttcatacctttttgatacgaactctatgactcaatctcttaaagctgatcgaaggtgtccgccatcacgccggccatctcaggcccagcgccgaagccgggaccgacgaacctgatccctgactgggccagatctctcgtcgcgatctggacggcttgcatatcgtccatctgcgcctgctcagtgcgctcctctgccttcgtgtcagccttaatcctgaccaagatgctgattcccgcgtttgaggcagcatccgcaagcctactggagcgcgcttcagctcccacacagtcgagcccttcgatgctcacgcaatccaggtgcagatcatgcgcctgctcgatcacctcgtagggcgtcgtgccgtcagccagatttccatccgggcccagcacgactgagccaatcatgggccgataagctcccagctcgcgtgcgtgcgcgccatagtaagcaccgcgcgccgcaaccgtgaggtggtacatatcgggcattccatcgaggaataccccgtgggcatgcttggaaacgagcgtccgggcttgcttttcgtaagcctcttccgcttcctcatcgcttgaggagtcgttcagacagctcggccccagcgtccccaccacaaagggtgaggcgctcttaaaggccaggcgtaccgcatgtgagttggcatcctccatacggatcccacactgctgttttgcgagtgttggggcagaacagttctgtgtataggtcagcgcgacatccgcgccgatatcgtgatagatacgggaaacgtgtgcaaccgtctctccttcgaacatcacccattcagcatcgcggatcgtgtctgccaaaggatatttcttcagcatatccgcaaccgatccggcaaaaaccagatgctccgtgctcgtgggttgtaagacctcagtcaagctgagtgcgactttatcatccgcgtctaattctggcacaagctgcccctttttatttttcgaacgtaacgccctgttttttcatgtactcaatccagcggcgctgtgtgtccatcgaaagcgcatgctccatcaagcaggcctcggtatcggcggtctcaggatcgactcctaagtcatccgcgaggaacgcgcgcagcacccggtggcacatccacacatgttgagcgtactctttccccttgggcgtaagtgtcacttttccgtaacgcgtctgatcaaccatgccgctttctttgagtgttgagagggccttgttgaccgaggccttcgaaacattgagtttctccgctacctcgacactgcggataccctccccggcatccgcgtcaccgttctccttcgcgatcctatagatcgcttcaaggtaatcttcatttgccatggtaaggctgtgctgaggtccaacatctgagcgagccatacttttgctcctataatcgatcgctttttcggttagttttcaccatcctcataccccagatacgtatggtgcaaccaaccatcactacatccacccatccggacggggtgaacggcgcacaaaaatgcagtagccattcctcctgctactgcatcgatcaaactttttactgctgaggcggactctacgaagcgagctcctcctcagtgtcctcgatattcgtgcgcacgatgtgggcacccagggactgtagcttctcgacaaagtgctcgtagccacggtcgatgtggtggatcgcggagaccgttgtgaggccctctgcgaccagaccggccataacgagagcggcaccgccgcgcagatctggggacttcacctgagcccctgagagcttcttcacaccgtgcacgatcgcatggtggccttcgatcttgatgtcggagcccatgcggttgagttcgcttgcgaacatgaagcggttctcaaagatattttcggtgataatgcaggttccgtctgacatcgagagcaagcacatcgtctgtgcctgcatatcagtcgggaatcccggatacggtagcgtctggatatcgatcggatggattggacccttgcggtagatcgtgcagcagcggttaccgcgctcgacggtgagccccatctcttcgtacttacgcaggactaatcctaagtgctgcggctcaaagcccttcacggtgatcggacggtccataaggcctccgattgccaggaaggtccccgcctcgatgcggtcccccacgacccggtgggtaaccgggtgaagcttcttcacgccgcggacctcgatgatcggggagccagcgcctttgatatcggcacccatctcgcagagcatgttcgctagatcgacgatctccggctcacgcgccgcgttgtcgatggtcgtgacgcccttcgcgaacaccgacgccatcatcagattctcggtcgcaccgacggaagcaaagtccagcgtgacgacccggccggtgatcccgttcggagccgatgcgtggatgttcccgtggtcgatcttgaacttcacccctagggcctcaaggcccaggatgtgcatatcgatcttgcgagcgccgatcttgcagccgcccggcattgcgacaaccgccttcccgaaccgggacaggagcggccccaacacggcggttgaagcgcgcatctgcgcgacgagctcgtagggcgtctcccacctgtccaccccggaggtatcgatgcacagggtgtgctgatcgcagacatcgatggtggcgcctaacttcttgagtaccttccccatcacgtggacgtccgcgatattcgggacgttggtgagtgtggtgacgccgggcgccatgatggtcgctgccatcagtttcaacgccgagttcttagcgccttcaacagtgacctccccctctatcgggtggccaccctcaacttcaatgacttccatactgcaccttgtctagttacgcttttgagcagttgaggtggttttgacctgcttcagcaacagatcgcaccacttgatcttgttttggtagtacgcgcggcggtggtcgtcctcaggcagcgcattgcgggcatcgatcgccttctgctttgtctcgttgaccacttccggctcgatatcgtcgatatcacgcgcatggtcggcaagcacgatcaccgtatcgtttgagatctcggcgtagccgccggagataacgatacggcggagatcgccgccgtcctgctttctgcgcgtgattctcatcacgccgtcaccgagcgccaggatctcggccgcatggccgggccagacgcccacttctccggtgtaggaaacgaggactacgtggccgataggcccctcatacagaagcctatccggacgtacaatttgacagttcagttgtgcctctgccatagctatctttcctattcagcagtctcggccgcttgcgtttcagcctgcatcttcgcggcacgctggcgcacgtcgtcgatcgtgcttgcgttgcggaacgcctgctcagggatatcatcgcacttgccgtcgatgatctctgcgaaggagcggaccgtatcctcgacgtggacatagacgccgggctggccggtgaacttctctgctacgtggaaggcctgggacaggaactgctggaccttgcgggcacgagagacggtcttgcgctgctcttcggagagctcgtccatacccagaatagagatgatgtcctgaaggtccgagtactcctgcaggatctcctgcacgccggtggcaacacggtagtgctcttcaccgacaatggaggggtcaagcgcggagctggaggaagccagcgggtcgacagccgggtaaatacccagctcggtgatcttacgggagaggaccgtcgttgcatccaggtgcgtaaaggtcgtggccggtgccgggtcggtcaggtcgtctgccgggacgtagactgcctgcacggaggtgatggatccctcacgggtggaggtaattctctcctgtagatcgcccatctcggttgccagcgtcggctggtagccgacggcggacggagttctgccgagcagtgcggagacctcagagcctgcctgtgagaagcggaagatgttgtcgataaagagcagcacgtcctggccttggtcgcggaagtactctgcctcggtcaaccccgccaaaccgacgcgcagacgggctccgggcggctcgttcatctgcccgtagaccaagcaggtcttgttgataacgccggactcggtcatctcgaggtacaggtcggtgccctcacgggtacgctcgccgacaccggtgaagacggaggtaccgttgtgctcctgcgccagattgttgatcagctcctgaataaggacggtcttaccgacacctgcgccgcccagaaggccggtcttgccgccacggacgtagggctcaagcaggtcaatagccttgatgcccgtctcgtagatctccgtggtcgtggtcagatcgtcaaattcaggggcgggacggtggatcgggtagtatgagacgccctgcggcatcggcttgtcgtcgactggctggcccataacgttccagacacggccgagggttgcctcgccgactggcatcatcataggacggccggtatcgtgggcctccatgccgcgctgcattccgttggttgacgccatagcgacacagcggacgataccgtggggaagctgagactcaacctccaggaccacgtggaccttgcccaccggcgtggtgccgtcgacgatcagcgcgttgtagatgtccggcacctggttatcgaattcaacgtcgacaattgcaccgacgatacgatcaacagtaccgaccccggcgctgtgctcttttaagttgcattgcagcgcctcaaagtcaacactgttctttttcttctctgccatcagttgttgtcctccaatgcggacgcaccgccgacaatatcgttcagctcggtcgtaattgagctctgacgaacacggttatacatacggctcaacgacgttaccatatcgttcgcgttatccgtcgcggactgcatagcacggcggcgtgcgccgtgctcagccgctgcggagtcaagcaaggcatggaagatgaccgtcctgatgtaggcgggcatcagatagccaagcacgcgcgtagcggatggatcgaaggtgaactcggtatacatggtctgcccgaccttgctgactgcctcgcgggaacgcggcgggttcgggatcgccagatcctccgccccgaccgggagcagctgctcccgaacctcatcctgctgcattcggttgcgggcgtgcatgtagtagatcatgatgcggtcgatagaccctgaggtatagccgtccatcgcataggatgcgatatggtctgcctcatcgtccgtcggctcactggagatgcccgtgaaggacatgaccggcttcacaccacggtagttgaagtaatcagtcggcttacggccacaggtaatcagcaaggtctgcttgccttcgcgctgcagcttctgcatcgcacgcatgacctcacgctcgaggttgatgttgaacccaccggcgaggccacgatcggaagcgatcagtataaacagaacggtcttctctttttcatgctcctgaagcaggggttgattgacatcgatccctgcattcgccacattggcaagcatgtttttgatagcgtccttgtacggagccgcctcctgcgcacgctcaagggctttgcggatcttcgcggtggaaatcatctccatcgtgcgggtgatctgcatcgtcgacttgatcgaagcgatacgtctgcttatttccttaaggttcggcatgtgccgtgcctcacgctttctcgttctcgtccgcagagtctgtggcgccagcatcctgctttacgtgatgcttctccagaaagctctgcttaaagtgatcaagatgtgtcttgatacggtcccccattgcgtcagagatgcggttctttctgatctcctgacggataccgtcgtggcgctccttcatgtaccggaccatttcgtctctgaatgggatgacaagatccatatcgaggtcgtcgacatacccctctttgcctgcgaatagggtcagaacctggtctgcgacatcgagtgcataataccggccttgcttcaagagctccatcatacgggcgccgtggttgagctgatactgcgtcgtcgcatccaggtcgcttccgaactgggagaacgcctgcttgtcgcggtagtacgccaagtcggagcgcagggtaccggcaacctgcttcatagatttcagctgtgcggagccgccgacacgggacacggagataccgacatcgactgccggacgctgcccctggaagaacaggttggtctgcagatagatctggccgtcggtgatggagatcacattggtcggaatataggctgacacgtcgccgtcctgcgtctcaatgatcggcagtgccgtcatcgaacccgcgccgttctcatcggagagcttgcatgcgcgctccaacaggcgggaatgcaggtagaagatgtcgcccgggtaagcctcacgtccaggcggtctgtgcagcgtcagggacatctgacggtacgccactgcctgtttggagaggtcgtcatagacaaccagaacatggccgccggggtgctttgcatctgcagggtgtccgttcttatcgttgtacatgaaatactcgccgattgcggcacccgccatcggcgcgatgtactgcataggggccgataccgccgccgttgcggagacgatgatcgtcttgtccaggacgccgtgagtgcgcagtgcttcacggatcgttgcgaccgttgaagccttctgaccgattgcgacatagatacagatgatgtccgtatctttctggttgacaatcgtgtcgattgcgatggaggtctttccagtcttacggtcgccgatgatcagctcacgctgaccgcggccaatcggcaccattgcgtcgattgccagaaggccagtctgtaccggctcgttgaccggctggcgctccatgatgcccggagccttgaactcgatcgggcggcggtgcgtcgtatggatcgggcctaagccgtcgatcggctggcccagcgggttgacggtgcggccgagcatctcatggccaaccgggatattcataacacggccggtcgtgcggcactcgtcaccttccttgatcgcgtcagcgtcgccgaacagcaccgctccgacactgcgctcatccaggttctgcgccaggccatacacggtattgcctgtctcagagctggtaaattggagcagctcaccctccatagcgcttcttagacccgcaatacgggcaataccgtcacccacctgggtcactacagaagattcctgtgtgtcaaccgttgtcgtcacatcattcaactgtttctcaagcttcgatatgatggcattcgggttgatggattcactcatttactcatcacttccgatgaaggttgaggaaagtttcttcctgatgttggcaagctgtgcctttaccgatgcatcgtagcggtgaccattcacagagacaatgatgccaccgatgatggaagagtcgacacgtgaaacaagatagactggagacttcagttgtttctcaaacttcttgatgatcttgtctctcatctcatcatccagtggaatggcggtcgtaaccgtcacggtgacggtcttatcgtcgttttccatcatggtttgatactggtcagccaccttacgaaccaggtcctggtcattgtctgaccgcatcgcggtcagggtctccaagacctcgggggtgaacttcacagcgtgttgccactgtaccaagtccgcattggctctgccctcagagcgagcggcattcagcagagcgcgggtatacgcctctaccttttcctcatcatctctatttggcatcgtcgtttcctatttcctcaagatacttctcagcgagatcacgctgctgttgctcgctcaggccgtctccgataatcttgccggcgatctggacagacagatcgacgacggagtttgaaagatcgaccatcgctttgtgacgctcagattccacaacatcgtgagccttggcgatcgtagccgcagcatccttctgcgctttggccaggacctgagaacgctcagcctcagcctgctttttcgcctcagcaacgatctcatcggccttgtggtttgcctcatcgatggctcgcttcgcttccttcgcgctcttcgctgcatcggccttcgattttgccgcgtcatccagatcggatttgatcttattctcacgggcatccattgcctttaccacggaaggccacgcgaacttagcgaggacgatccagataatgacaaaggcaatgcaagccgggatgaactctgccggtctcgggatcagcagcgccattccaccaccacctgaagagccatcgtcagccagcgctagtgtcgggagcgcaaaggcgacgaagcccactacactcgccgcggtattgcggaagaagctcgttttgttcaatttcataatgctccctcttccagcccgtcgacacacctacataatggctacaacaaagccgatcaggcacaaagcctcaataaatgctgctgcaagaatgaagaccgtaaacagacgaccctgaacctcaggctgacgagccatgctagttgcaacgttggcagccgagaagctgatgccgaatgcagcaccaatcacgcagagtgcgtagccaataacgttcacaattcctcctttgtcactcgccagtccctttggccggcgactttagacacaactatatactgcaggcaaaacctgcgagtaaccttaatcagaatccgcttctgcaccgttgatatagaccgcagagagcagggtgaagatgtaggcctggatgaaggcgatcatgagttcaacgccgtagatcatcaaaagcaggagcatccacaggatggacatcgcaccagtgcccaccgcctgagcggtgatagcgccattgatcagcgggtccaggaagattgagcacatgattgcgaatgtacccatgaccacgtggcctgcaaacatattgcagaatagacgaacggccaacgtgatcagacgcaggaacgttgagaagacctcaatgatccagaccaaaatacggatcggcaacatgatgccgctcggcgccagggacttcacatagccccacaggccctttttgtggatgccgacgtagatgaagtagatgaaggacatcagagcaatggcacccgtaacgccggtagagccggtacccggcctccaggtcgggagcatgccgatgtagtttccgaacagaacaaagaagaacagcgttgccaggaacgggaaatgctttctccaggtgtcccccagcattgccttcgcgatatcgttctcaacgaactcgatgaggtactcgataccgttcacgatcacgccatgcggcaccatcgactcgctctgctttttggtgaacaccaacaaaacggcgacacacaccactgcagcgataatcatccatacggtatagaccgtaagtccgactgtcgtatcgccgacgactgcctgaggataaaacgtattgatgaggtcggtcatcgactttgaaacctcagcaaaggcttcgcccacggtaactacttcccttcatttacccacacacgtcaacgcatgcgcacaaacgtggatatacttgcgatcacatagagagccaggaacgtacctaccgcccagatactgaacagcaaaagattttctcgctgtgtcccagatacgatagcgatcgccatcgtcagcaacacaaaagagaagataaggcacgctattgccttccccattcccgctttggtccggttagcttgtacccgaataagaagcactatacccggtaatgctgccacgatcccacatatgacggcagtagggacaaaactcaccatccgtcctctcttcatgctttgcatgtacacggtgcaagaacataattatagagtactagtctgtacatatttttgcataattacaagaaaacacctgtgaatcaaacgatttttcaggtaattggg

SEQ ID NO: 356 - DNA, 18353 bp, Unknown
  Metagenome-assembled genome
ccgctgggtaggcttgttgaagtcgacgactctcgcgggtcttctccttttaccttaggattttttaaggtctaaaagctcatcttatctgtccatattccttttgggatatgcaggaatacgggaatactggatgtagctataccatagccagaaggaaagataggatctaggtgagtttatgcggcactgcgtggttagagacattttgagcaggtggcatacagcgtgcggctccaatgcctcatcgaggcgaattaatatcgttacctaggaacagcgaagagcccaaaaaaatgagcgggtaggggtacacccggttccctctttggtatgcttacgagtgtatcaaggaggccttcacagcttctcctttccccgccatatatggacactgactatctatacgatcccacatcaaccacccacaccacatacatacaccaccaaaaccccacccacctaaaacactccccaaaacaaccaaaacaccctcaccaccccccaatcccccccacaacaaaaatcacacctcaccaccaccaacacaccaacctcatataactccccatcagccaccccacaccaactaacacacaaccccacatccacccttctcctacccaaaccacaaggtcttgatctaccccccttaaatatgggggttcagcttaaatatattattttaattttttgtcaagcgctgagcttggactgtatcgggatcttctctatatactagcttgcggcagtaatgccgtgaatgtgactgatgaaggaggaagttgcctggtgcataccgcaaagcttccaaagccaattccaaaaaacgtcagcgtgtaagctagcaaagattccgccagtaatggagttgccgaacctcatccccgaagatgtgcaggcgcaagctgaaccgcctgtctcgcggaccgaaccgtgggagcggctccacccgtgcctcaaacaactgccacacctaaggcagctgcgtggcgcggcgcctgcgtccgcgtctgccccggcaaaccgcatcacgctcgattgaagatggacttgcatgatgcgcggccgcgtgatctgtgggctgcacgcggcaatcaacctactcgtcgccggagtccccggcccggaggacgctaaacgcgcggcggagggttccctccgccggggcgccagcccacgcgggcgactaggcgcgatcgatatccgatgaaacgcgaaccaggcgttcgggagaccgatgcgagacctggagctgtccctggcaacggggacatgcaagctagaacaaactagcttgctacggcaagcgcgatgatggcttccaggcgctgctgcatccactagcttctgcacaagatacaggcgcggctcccctcccggtacatgatgcaggaagccgaaacaggccacaagatctgcaggcgcgagcctttgcggcagcatgtctccctcattcagaagaccgtccacgatatcgtgtacatagcagtgtgccgagatgttctggggaagcctttcttcatctatgagaggacggcaagagtcgatagcctcatatgcaatccggacatctggcagcatctgcgccaggaagcggccgaagcgcaggtttccggaggcgatatccgtgacacggagctcgtgcctgccttccacagccagaagctctacaatctttttccagccttcccaggaattctggtggggcttggaaaacaatgcagcctcagcagcatggaactctcctgtcacagcagccagcccctttgccaaggcgcgctctatagtgcaatctcctctcctgtcatcttcttcacacgatcatagattctcgagagattgcgccagatatcctgtcttacctgcgcttctgctgctgatttctgccctgcaaaatgttgccggtatatttcctaccaaattgctcggaattaatgcttgcattctctctgcacaagcgctttactatcaaacaccaagtgttctggtagggattagaagctggaaggagaagacagacatggcagggatgcagaatatgatgcgctgtgcatgcatgcgctgtgtcacgaaggcaagcctgtccggaacctgtacgcgatgtcaggcgtgatatctgacactcatgtatggcaatgcttcgggcaggtccatcaaggacctgccttcttcttggagcgaaaggataaattatggaattcgatgcactctcgtttaccgcacttgccgttgctgccggtctcttcgccgtgcttgcctatctgaagcgaaagcgccattggggctttggcgctcgtgtccttctggcgacggcttttggcattggccttggccttgccttcggccaatcctatacgtactacgcccttgtcggcaccatctatgcaaacctgatctccgcaatggtcgtaccgctgctcttcttctccatcatcgcgtccataacgaacctctccggcctcgtgcacatcaaggccatcggctggaagtccgtcctgttcctgctcctgaacacgctgacggcgacgcttctgacccttctcatcgcgcttccgctccacatcggtcagggtttctcgctcgacgccgtaagctatgaggcaaagaccgtgccttccgccacagacacgatcgtcggtctcttcccgcagaaccttgccacatcctggacgaacaacgccgttgtccctatcatcgtctttgccctgatcgtcgctgccgcctataaccgtctcgtccagaagcagaaggaggcaccgtctgagaaggctgtcgatgtgaagccgttcaaggccttcgtcgatgccacgaactctgtcctcggcaacgccgtgagctggatcgtctctttcacgccatatgccgtggtctcccttatcggccgcgccgtgggccgcgctgatgtcgcaacgctcctgccgcttgttggtgtcctcatcgtcgcctacgtaatccttgccctccagttcttcggcgtcgagagcgcctttgtcgccttcatcggcaagctcagccctgcccgtttcttccgtggcatcgcacctgctgcggtgactgccttcacgacccagagctctgtcggcacaattcctgtcaccatctcctcccttacgaagaatcttggcgtggatgaggatgttgcctccttcacagcaggccttggcgcgaacctcggcatgcccggctgtgctggcatgtggccgacgctcgtcgctctctttgccctgaacgctaccggcactgccttcacgcccggccagtatgtcctcttagtccttctcaccctcgtcgtctccatcggcacggtcggcgtcccgggcacggccacgatcacagcaacagcccttctcgcagcgctcggcctccccgtcgagactattgccctcgttgcccctatctcctccatcgtcgatatgggccgcaccgctacgaacgtcgtgggtgctgcagaagcttcgcttctcgttgcccgcaccgaaggcctcgtcgacgaagaggtctacaacggaggcgaagcctacagccttccttcaagcaagaaggcagaagctacagcataaggtccagcgacttggatcttatctcctctccagaaatcgcacaggcatggccccatgtgccttcttctgtatcgggagccggtcttccgtgggtataatccttccatccctttctggagaggagcgatctatggaaagcgcagtcaccggatgcatcatctgcatcctcgtcggtgccttcatcctcgctctggccctctggcagatgaggatcggatccgtccgcctttctctacagctaccatacggtccatgtgccagaggagctggcagctgctcttgcccgtgagtccggatatcctctttccgccatcggcatctccgtcatgctcttgggacccgccctcatgttaccggcacctcttgcagatatcctcggcttcacccttgtcgcagccatgcttgctgctgtcgtgcttgcctgccacgcaatcgtgaagcacaacggctcgctcttcgggcgataggccttccgctttcaggatggaagcacgtcgtctccgtctcttggctccccttgcccctctataatgaagagccatagaagagctgatatatgacatcgtcgagcacctgaagtccttgccgaaggagcgtccgctcctgcctgaggagctgggccgcattattcgccagcacagcagggaacttcccggaagcaggcgcttcagcaagcggagcctccttccggtctgcctcaagattgaggaggagaagcctgggctctgggcaagctggaacgtgggtaccgccctcatggcccgcctctatgcaagcctccagatgaagccgaggcgcacagttgccacgatcaccatgatcacccggccctggccctgctcctcgaactgtcgctactgcccggcagatctgaggatgccgaagagctatctctaccatgagccggcctgccagagggcagagcagaacttcttcgattcctatctccaagtggcattgcgcatcaaggccctggagcagatggggcatacaacggacaaggtcgagctcactgttcggggcggtatctggacgggctatcccgcctcctaccatctcttccgcgtcctgaacgaatggccaccttgcgcagccgctaccagcactaccgcgacctcggctacgtgaactcagatgccgcgctcaagtggagtaacaacccttcttggggacatcctcttcagagactgagacccgcctttctgaaactccaccggactcatatagcccagcgtcaagggcagcctctcgttgttgtaccgccacacctaagcgccaagcttcacctgaaggtcgcagaggtcctcaaagcgcttgtggtgggcgaactcagccttgagcgccttgttgctctactcctccacggcactgtcgtagtgacagcccctcatgcaccgcaacctcactatctagaagacctccagaggctcgtctatagcggctcagtgactttaaagccgacttcgtgtgactcaccttgtcgactagcggaaaaactacagatgcagataccttgaccagccggccccgttccttctcgccccagacgtgtggctggctatcttcgctgtacggtcgacgagcaggcagtgtagcaaacaaacccccgctccccagcaacacaagacgtaaggtgaggactaaggcttctctgggcctgtcggggcgcgccttgaacttcgccttggtgtggccactcttaaggccacactcccttatggctgcggtgatgtgcctgctgctggagcagatcctgcacttggccagtgcccccttgtgctctgggtgctgtggtacccggtacttctttcctcgacggcgccgacgagaggtccctgtgcttctcaggtccgggtgtgccgcgcaagcctgcagtaggtcgacctcggagtagcgagctgcttacatagagctgataagcagatagagtccggcactttctgctatcgcgactacctcagtgcgactatcagtacagccgtccttaaaatgtcgagctccatctttaaggtgcttgttcttccttgtaagatcgagggtacactcctgcttaggtgtgtggctgtttgaggcatgggtcgagttggcgatatcgttgtcggcgcctatctctgggcggactcttgttattgtcgttaagctcaacgatctggcgtttgatctctcctgagaatttcctggagtgcttagggtccgtcatcgcggccccctttcccaaggcctcagtctctcatgggcttgtccctttcactgcagccactccatgtcgttttcgagctcctttttgttcttcggccctggcttaggtgaacttccctgatcttttcgcacttgatgatccactcatctaaggtcttgtcatagacctcaagctctttggtgtatgctctgatgcttctctttgagtctgcctggctttgccgcagcactggtagcctttaagcgctactcatctatatactgcctgggaagcttcgacttggactttgccttcttttgccttgcttgcactcactgacatctcatgacttaaatctacaggtggtgttgggtgagcatctgggaaaaggatacttgccaccagttgctggtgtcctcctgtccaccaaaagcttacagctcacactctgcgctcaagcgcgataccgagggtatcttgcgcatggactacgaggacatgacaagaaagatagaagggaacaagatccacctcgtcgtcttctgcaacctgcacaacccctgtggacgtgtttggacgcgcgaggagctcgaacgtgccgatgaggtctgtgcggcgcatgactgcgtcgtgatctcggacgagatctgaagcaacctgatcctgccggaacatacgcacatcccgtatcagagcatcaataaaaatgcccgcaagcgtacgattgccttctatgcgtcgagcaagacgtttagccttgcaggcctcgttagttcctaccacattgtctgcaaccgctatctcagggatcgcctcgtcgtggcaagcgcgcacgtactacaacgcgatgaacgtgctttccgccatcggcaccttctcgaaggaaggtggggcctggctcgacgggcttctgccggtcctcaatgcgaatgtcgatgccgcggtgaaatatctctctgcccgtaagggagtggacttctttcatcccgaaggtacctacatgctcttccttaactgtttggactggtgctaggagcacaagatctcgattgacaagctccagcgcaagggatgggatgtgggtgtcgcttggtaggatggcctttctttccaggtaggagacacgacccgcatgaacttcgtgctaccgacggtatgtgtcgaggaggccttcgaacgcctcggtcgttacatctttgcagagtagctctatctctctagaaaggggacgcaatgggaaaactcggctccatcgacatgggcaacatggcgcgggtgcttgcccagggcttcatcgtatcgggcgtactcaagtgcgagcaggtctttgccttcacgccacaccaagagaagcttcgcaggaatgcagagtgcatcggctttcagccggtctcatcgtttgtagaacttgccatctctgtagataccctcgttatggtttgcaagccctaccagattgagggcgtcatgggcgagctcggagctgcccgttcgggcaaagccctcgtctcaatcgtggcaggctgggattttgcgcgctacgagaacgtgcttcccgtagatacccgcttccagtccattatgcccaacacgcctgccatagtgagagaaggcgtgctcctcttcggggagaagacgagcctcgagaaagatgagcgtcagggccttatggatctcttctcgactgtcggcgttgtcgaggagatgccgagtgcccttatggtggcagctggtatgggcatgggctgcactccgccttcgttgacctcataatcgaggcctacgccgatgcagccgtgaagtacggcgtgccgcgcgcccaggcctatgcgctcgttgcacagatggtcaaaggctctattgccttggcactcgagacgaaggaacagccgggagtgcttaaggatgcagtctgcttgccgggtggcacaacgatccggcgcgtctgctcccttaaagcggatggcttccgtgctggctgtatccattcgatcgatacaatcctcgagtagtggaacacagtgccagagacagcggaacggcgcagggagctactccctgcgccgttttttcatgagaatggaagttctgtcaggaggcggaaggtgctgtcttatcctgccaaatattgtccggaacgagcttgcggtttctggcatagaggatgagtgccacgcaggcagcagcacagaccatgccgcagaagggcgaggcttcgataccgaagacggggtcgtaggcaaagccagcctgcggcgctgttccagcagcgaggccgaagagcgcgaatggggtcgtgacgccggagttcggaagaccgaagagtacggcctgcgtgaagttccaggccgtgtggcagccaaatgctgaccaggggctgcggagcttcgccacaagcaggcagaagaaggtgccgatcaggaagatattgaggcaggacacgaggctcgctccttggttcgtgaggtggagaagggcaaagagggcagaggtcaggacgatagaaagagtggagcttccgcaggtcctgagcgtgcgctcgtagagatagcagcggacggcaagctcttctgccgatgcctggatgaagacgcagacgaagacaaggatgaggcccagggcgtctgtccctatgaaggagagatggatcgagccggaaagggctgcagcaaggacgcagatgccattgagcgcacagccaaggcccaaaccgaggacaaagtgcctcaaggtattgctgccgtagtgcgggcccaaaatcccaagaatcggtcgcgaagtcttggagtgtgctagatagaggaggaaagctgcccatatgccaacaggggcaagatagcggccagcggtatagacgatgctcgtccatgagatgctgtagcctgtgccctgtgcaggaaggccaagtgctgccggaccttctcccataagagcatcccgcatgaggtgcatgccgtcttttgccatgagaccgtagagggcgcttatgagcgcagaggtcaggacagcgccgacgagacttcctgcgatgatgagagcgatggtccagagataactgccggccagactgaggatatcccggagagagatgcgcctgttcatgagagactcctatcttttagttgtcgcatttgagagctgagtatcgaatgctttcagatgcaatacagcatctggcagggagtgttgccgatatgtcagctgaggctacaagacctcgcgaaggagagtgacatcctaccccatctagagcaggccgcaaatgagctagatgaggaatttcacatcttgttacctttttaggaggttgcggttctactaacgaaggaggtcaggatgatctatgcaggtgagaacatcgcaaagatagactacctaatcgcagcggtgaacgaacgcggagaagagcttggccaagccaatgggctttaagaactcagctcaaggctttgagcgtgccgcaagctggcttaaagggggtaggtgaggaagccgaagggcgtggttgtcggcatgaaggccacaggccactgctggatggcctgcttatgctagcggctgtctcgcgactatgcggtctgtatcatcaacccctatgcaggccagagccgtctgcagactcaagggacttcccggcgtcaagaacgatcgggcggacagccgccttatagcaaagacccttacgcatagggggattcgacacaaccaaactcgccagcgacgaagtgcagtcactgcgcacgctctcgcgctacctgcagtcacttaaagcgaagctttgagataaagacccagtgcatctgtcttatggactcctacttcctcgagctcgacggtatcttctcgaacatgttctcccaaggtaccagggttgtgctctcaaagtccctcttgcccttcaagctcaaacacaaaagacaagacttgcttacccaagacatccaaggggcctcaaggcgagaagagagggccgcacgtaccaaggcaccagtgggcattgcgctgggacaggaggccgcatcgtttcaggtgcgctccctcgtgcaccagatggacttgctagacgaggagtgtgccaaggtataaaagctcgtgggcgagcttctcgagaaggtcgagccccttatcttggccatccctgccatctcctacacagggctgagctcacaggtgagccagtcgggcaggttcgacagcacgggcaaccccatcaccaagcgtggctcgccctacctcagaagggcaatctggcttgcggccagcagagcctgccggtgtgacttgaagcttaaagccttcttacgacaagaaacgccacgagggaaagcctcatagggtggctgtgacggctatagcaaggaagctgtgccatatcgtctttttctgtcatgcgtggccaggctccctgcgatcctgatcgctagaagcggtctccatgagcatttcgatattcaaactctcaaggtgcagctcttacttgcaaaaaaaacttgctccgtagaccactgtagatataggggagcgaaagatgtcacgggtcaccctaaaatcgggttcgactaagaaaccaacttgaagaaggccccgtatgctctacatgatatgccaaccagcaaagtagctgaccgcaaggagaaggtcgcacttctcgcgacctcaagaagatgaagccgagaaagctggcaaagcgcagaccgcgcaagtccgccccatgcccgcagtcaccaggcgcgagtgctcgcttacagcagggacaggcaagctgctcgcgcagtcgaagttagcagcatcccagtgatggcgcttaacaccccccccctgtgccctagctggtaggctcaccatgcacaggtttgcaacgcagattgcggcgtgtgtctgtacagcgctggttcatgtgccagcgcgaaggtggcacgagagccagagacccagctaaggcttaatttggactgtggcgccgccgtcaaacacttcacaagagtctagcgaccacgatggggcaggccagtcgaggacagtgctccccaagcacgcagcgcccacaacattgtgtgcgaggggctcttacctgcagatctgagggtagacaggcgtagacgagctcggacgcggacgtgagcaagcgacggtacaggggcaaactatgacaagcggctggccgacccctcggtgtagcgcacctcgcaggtcaacccatgcaccccagcatgttgtgggcgcgctgcggtgcttgggggagcactgtctcgactgggcctgccccatcgtggtcggctagactctttgtgaagtgttttgacggcggcgcacacaacttaagccttaacgctatcgctacatgcgcgctggcacatgaaccaggcgctgtacagacacacgccgatctctttgcacactgtgcagtgtgagcctaccagctaggcactgggtaagctccatccactgggatgctgctaacttcgactgcgcggagcttgctgtccctgctgtaagcgagcactcgcgcctggtgaatgcgggcatgtggcggacttgccggtctgcgctgccagcttctcggctatcatctgcttgaggtcggcgataagtgcgaccttctccttgcgggtcagctttgctggttgtatatcatgtagagcatacggggccttcttcaagttggtttcttagtcgaacccgattgtagggtgaccccgtgacatcttttcgctcccctatatctacagtggtctaacaggatcaaagtttttgcaagtaagagctgcaccttgagagttgaatatcgaatgctcatggagaccgcttctagcgatcaggatcgcagggagcctggcaccgcatgacagcaaagacgatatggcacagcttccttgctatagccgtcaccgccaccctatgaggcttttcctcgccgttttcttgtcgtaagaaggctttaagcttcaagtcgccccggtaggctctactggccgaagccagagcccctgctgaggtaggggcgccacgcttggtgatgggccgcccgtgctgtcgaacctgcccgaccggctcacctgtgagctagcccgtgtagcttacaagggcgcaggcacctttgaacttggagatgtcgccgatctgcggagacatgggctatctagcgcacgagggcgcacctgaaacgatgcggactctgtcccagcgcaatgcccaccgatgccttggcgcgggcggccctctcttctcgccttaggccttggagtcttgggtaagtaagtctcatcttttggtttgagctcgaagggcaaagtgatttgagagcacaaacctggcgccttgggaggaacatgtcgagaagataccgtcgagctggggaaggaggagtccataagcagatgcactgggtctttatctcaaagcttcgctttaagtgactgcaggaagtgcgagagcgtgcgcagtgactgcacttcgtcgctagcgagtttggtgtgtcgaatccccctatgcgtaagggctttgctataaggcggctgtccgcccggtcgttctgacaccgggaagtcttgtgagttgcagacggcttgagctgcatggggttgatgatacagaccgcatagtcgcgagacagccggtagcattaacaggctatccagcagtggcctgtggccttatgccgacaaaccacgcccttcggcttcctcggctacccctttaagttaagcttgcagcacactcgaagccttgagtgagttttaaagcccattggcttggccaagctcttctcgcgttcgttcaccgctgcgattaggtggtctatcttttcgatgttctcactgcatagatcatcctgacctccttcgttagtagaccgcaacctcctaaaagagatccgaggtaacaagatgtgaaatcctcatctagctcatttgcggcctgctctagatggggtaggataccacatctccttcgcgaggtttgtagcctcagctgacatgtcggcaacactccccgccagatgctgcattgcatctgaagcattcgatacagctcaaatgcaacaactaaaagataggagtctctcatggacagcgcatctctttccgggatccctcagtctggccggcgttatcggaccatcgcttcatcatcgaggaagtctcgccggcgctgtcctgacctctgcactcataagcgcccttacggttcatggcaaaagacggcatgcgcctcatggggatgctcttatgggagaaggtccggcagcactggccttcctgcacagggcgcaggctacagcatctcatggacgagcatcgtcttaccgctggccgtatcttgctcctattggcatatgggcagcttcctccatcatctagcacactccaagacttcgcgaccgattcttgggattttgggcccgcactacggcagcaataccttgaggcactttgtcctcggtttgggctttggctgtgcgctcaatggcatctgcgtccttgtgcagcccctccggctcgatccatctctcttcatagggacagacgccctgggcccatcttgtcttcgtctggtcttcatccaagcatggcaattgctattcgtctgctgctatcatccagaggcagaagagcatccttttaggcacctgagactgcggaagctccactcttctatgtcctgacctctcgactctttggcctatccacctcacgcaaccaaggagcgagctcggcggtcctgcctcaaatatttactgatccggcacctctttcttgcctgcttgtgcgcgaagtgcaccgcagcctggtcacagttggtggcccacaaggctggaaatctcaacgcagggacgtacctcggtcttccgaactccggccgtcacgaccccatttcgcgctcttcggcactcgctgctggaccgcgccgaggctggcttgcatacgacaccccagtgtcttcggtatgaagctcacccttctgggatggtctgcgctcatgcctgcgtggactcatacctcgtatgccagaaacccacaagctcgtcgggaaccatatttggcaggataagacagacacacccgcatctgacagaaattccattctcatgaaaaaacggcgcagggagctactccctgcgccgttccgctgtctctggcactgtgtcccaatacgcgaggatgctatcgatcgatatggatacagtcagcaaggaagccatcagcttaagggagcagacgcgccggatcgttggccacccggccaagcagaatgctcttgagcatccggcctgttccctcgtatcgagtgccaagcagcagagcctttgaccatctgtgcaacgagagcataggcctgggccgcgcggcacgccgtacttcacggaggcatcgggccgtagacctcgattatgatggtaacgaaggcggaggcacagccatgcccataccaggctgcaccatacgggcactcggctctcctcgacgacgacgacagtgcgcggaggtccattaaggcacctaaacgctaatctttactcgagggctcgtcattctcatagaagaggagcacgcctgctcctcacttatggcaggcgtgttggccgccacccataacggactggaagggggtatctgcgggacgcaacggctattagtaggcgcgcgaaaatcccagctgccacgatttgcgacgagggctttgcccgaaaggcagctccgagctcgcccatggacgccctaaatctggtacggattgccagaccataacgaaggtatctacagagatgcagttttgcaaacgatgagagcaggtggaaagccgatgcccctctgcattcttgccggaagatctcttggtgaggagctgaaggcaaagacctgctcgcattgaggcgcacccgatgcgtgaagccctgggcaagcgcctgcgactgtgcccatgtcgaggagccgcgttttcccattgcgtccccctttctgggaggaattagagctactctggcaagatgtaacgaccgcggatcgaagaactcctcgacaagtaccgtcggttagcactagtcatggggtcaggtctcctacctggaaaaagcaagggacagctaccaacgcgacacccacatcccatcccattgcgatggagcttgtcaacgagatcttgtgctcctggcccaccagcccaaaaagttaaggaagcgcagtaggtaccgtcgggatgaaatgacaagaagtagaagtcaccccttatgggcagagagatattttcacccgctgcatcgacaattcgcatcgaggaccagcagaaagaagcccgtcaaccaggcccgcctcccttcgcaaggtgcgtgaggaggaaagcacgttccatcgcgttattgtagtatgtgcgcccgctgccacgcgaggcgatccttgaggatagcggtcgtagaccatgtggtaggaaataggaggcctgcaagcgggtgaagtcttgctcggagcatagaaggcaatcgtaacgattgcaggtattttcatgatgctctgatacgggatgtgcggtctgtcccttgggcaggatcaggtcgctcaatctcgtccgagatccaggacgcagtcatgcgccgcacgacctcatcggcccgtcgatctcttcgcgcgtccaaacacgtacaaagggattttgtgcaggttgcagaagacgacgaggtggatcttgttcccttcatctttatgttcagtccttatagtccatgcgaaagaccccctcgggtattccgcgcttgagtgcaggaggtgagctgtaagattttggtgaacagggacgccaggaaactggaggcaagtggcaagtatccttgcccgaggattgctcacccaaaaaccacatatagatttaagccatgagatgtcagtgagtgtaagtaaggcagaagaaggcaaagtcaaagttgaagcttcccaggcaagatatagagaagtagcacttaaaggctaccagtaatgaggcaaaggccaggagacctagagaaaagtaataggggcgtgctacgccaagaagctgaggtcccccagtgacaagaccttaggggaaacgtgattaatgctatgccggctgcgaaaggccacgtggcggtaagtttctcccggcacatcatgggaataatcatcgtttccacgaggccagggccccgaagagcaacaggagcctcgaaaaaagacaggagtggctggctgcagtgcaaggacaatcccatgagagacggaagcgcttgggaaggggggccgcatggcggacctcaagcactccaggaagcttcagggagatcaaacggccagattcgttgagtttaccgacaaaccataagagcccggaccctgcccagaagagataggttgccgacaacgattcgcaactcgacccagcctcaaacaaccacacacctaagcaggagtgtaccctcaatcttacacggccgaacaagcaccttaaagatcggagccagacattttaacggaccggcgttgctgatagtcgcaatgaggtagcgcgatcgcggataagtaccagacgcatccgctatcagcgcatgtaagctgctcgctctacgaggtagacactactgcagcttgggcggacacgcacgagcctgagaacacagagcctctcgccggttgccggcgaggaaagaagcaccgggtatcacgggacaccagagccaaaggggggcaccggccaagtgcaggatctgtacagcagcaggactcgccgcaagcaataaggtgggtgtgaacctagttgccacacaaggcgaagttcaagctacgcacccttatagagggcaaggggagccaagagatggaggagatatgcttccatcctgaacgcggatggtctatctccgacagagcgttgtgaaccgctgtatttcacgatcgagcggcaggcaagggctacggcttgaaagcaggacgcggtgagggcaaagtccacagagatctgcaagaggtacaagcagcatgagagcaggtccagaacagacagggatgccttcggccagcaagcgggtgcccggactcggaggaagtacgggactacctcttcaggcacagtgaccgtatggtagcgtggagcagatcgaccgtcactgacccgtctcatcggccaccgctgccatgcccaggcatcaaagcaccaggaagatggtgatgcagacaatgcaggcggcaactatgttatctattgcaatctcattgagaaagactccgatggaacagattctaatggaagagtcacacaggggcagatgcctctgtgcggacttctggagaggagataagatccaaagtagatggaaattatgcggtagcttttgccttatggctgaaggaaggttgtaggcttcgcatcagttgttatgtagacctctcgtcgacgagggccttcggtacgaggaaacgagaagcgttgcttgacagcaccaacgaacgtatcgtagcggtacggccattgacgatggaggagaggagatagcgggcaccgagggcgatggttctcgccgggaaggccgagcgctgtgcgagcaaggctgttttgcctgtgtgatcgtagaccgtgccgggccgacgaccgtgccgatggagacgacgggagagtggaaggactaagagaccataatgcggcgtgatggcagtgccggtggcatgaagggcaaacgagggaggagaccaagtgtcggccacatgaaagcgacagcgggcagccgacggttcgagccaggcctgctgtggaaggactcactacagcccgcccacgcatgccaacatcctaattcacgccggattattagtaaggagagggagatgggattgacgggaatgtgcggacagagctctgggttgtgaaggagtaaaagcagcaggtaagatgccaaggcagaaaacgggaagggtgagctgccgatgaaggcgacaaaggcgcctctcgacgccgaagaaacgggagggcaaggattaagtaggcaacaacgaggacgccgaaagcggaggggcgtgcgacatcaaggcggcccacggaagggccgatgacgggagggacggacaacggcatatggcgggaaagagacgatccagtcacggcgttgaagaggattggagttacgtggcatcgccgaaggccttggaacgcttacaatcgacaacttctcagacggtgcctcttatgctttggacgagacagttgtagctggcagcgacgatcagggcagacgagataggacaactgcgttgttcgtccaggattgttggttgggggggccgggagtttgcgggcagagaccggaccgtcggtctgtggccgggaaggccagtcttgccccatagcttccggcgtcgagcgagaaaaccctggccgatgtggggggaaagcgcgatgagaaggtcagaagcgtcgccacagcgtgttccggagccggaacaggacggatccagcgatggccttggtgcaccccgaggtgctgcacaaatcgttagtgacgagatgatttgatggagacgaagagcagcggacgacattgcggagatcccgtttgcatgatggttgccggagggcgtcgtacgtctaggagtggcagaaggcaaagaccg

SEQ ID NO: 357 - DNA, 33153 bp, Unknown
  Metagenome-assembled genome
agacgacgttcacgtcgaaggaacagggattgagcgcaaagataattgattggtagacgttgagctgcgcatcggtgaacggtgccgccatgggctgctgtgagccggtgagcacgatcggtttggggctgtcctgcagaaggtaggagagcgccgccgcgctgtacgccatcgtatccgtcccgtggaggattacgaagccgtcgaactcatcgtagcgctcggcgatcactgaggcgatcgtgagccagtcacgtgggcgcatgttggtgctgtcgatgttcatcggctgcacggtcgtgatgtcacagagccccttgagctcgggtacccgctggatcaggtcctgacctgagagctcgggcgccaacccatcctcctgaggcatcgaagcgatggtgccgccggtcgcgacgatcagtatctttttcatggctccacctacacctttcctttggtggtgctcttatcccagcgtgatgccctgctcgaggagggcctgtgcgaatccgacatggtagtcggagaagacgcactcgccttcctcttgggagcggtcgagatcgaccgctcctgcgatcccgaagtcgtggtcgtcgtcgctgtcccgaaagatctggtgcactgaccaggtgtgcttccccttttcgtcgtcggtgttgaggatgaagtacttggtggagcgggcatcctggtcaagcaggatatcctcgtgtgcctcatggaactcatcgagcaggcgctgccacacgacttcacggtacccatagggcgcatcgagctcacccagcgcttcagcgtcgtctgcctgggcaaggcgcacgcggtgccacagggcgttacggaccaggatcgtaaggccacgccggtcgtggaccaccccgtccttatccggtggggtcgtatcctcaggcaaggtgcccgccgcttcccactcgtcgaagagcgaggagtcgatggagcgcacctgcagcgacagccaggcgatgatgtctttgaggtgatcgtcgagcttggctgtcgggacggtcctgtcgagcacacggtaggcttcggagaggtagcgcaggagggtgccctcagagcgggacatcttgtagcgctggatgtagctcttgaaatcagcggcggactcgatcatgtcccgcagaacactctttgggtgcaggctgtagtcgcctgcccagggcaccttggcgcagtagcttgcaaaggcctgattgaggagatcttcgagaggtttggggtaggtgacgtcctcgatacgcatggtgcgctcttcgtagtcgattccctcggccttcatctccgccatcgccttatcccgcgcctcatgctcctgggcgcgcaggatctggctcggatcttcgagtgtggcttccaccatcgagatcaggtctaaatcataggtgtccgattgaggatccagaagctcgagcgcagcgagcaggaagggggagaggggctggtcgagcgcgaagtcgtccggcagatccactagggtggaccatacctccttgccgtcttcggtgttgtgttgaatcacatcagcgtcgagcagggtcgccaggatctcatcgacgcgggcatggagcttctgcttctgttcgtcagtctgcgcggagttgtccacgagttcatgcaggcgcgcctgcgcgtccccgccctgctggatctccgagagcaccatcgagttcgtaatctgcagatggggcgtcagggtctccggcgtcgcttcgacgagccgggtgaaggtctgctcgttccaggtgacgaaatccttcggtggggtcttcgtcttgaccttgcgtgccttcttcgggtcgccgctgcctttgaggagcgcccgggctttctcgatctcgtagggagtggcctccgcgaggacgatcccttccgtatcgaaccccgcgcggccggcgcgccctgcaacctgatggaactcacgcgcactgattcggcggcatcggcgcccgtcgaacttggtgagctgcgccagtatcaccgtgtggatcgggacgttgatgcccacccctaaggtgtcggtgccgcaaatgacggggaggagtccctgctgcgcgagcttttcgacgagcaggcggtagcggggcaacatgccggcatggtggatcccgacaccggtgatcagcaggcgctttaaagccttaccgaaattcgtggtgaagcgggtgcctttgatcgcctctttgatcttggtgcgctgctctctgtcactcacgccgtagctggcgagtgcctgggcgctcttgaaggctgcattttgggaggagtgcacgatgtagatcggggcctgcccatttttgagggcgagctccacggtggattccagcggggtatcgacaaactgatagtgcaggggcactggacgtggggcgccgtcgatcacatcgacggggcgcttcgtgagctcctgcagcttatttcggattgcggtggtgtcccctaaggttgcgctcatcaacaggaagtggacatggggaagcgtcagcagcggtacctgccaggcccaaccgcggtctttatccccgtagaagtggaactcatccatcacggcgtagccgatatcggcgccggtaccgaagcgcagggagtcctgtgccaaaatctcctcggtgcagcagatgatcggggcgtctgcattgattacggtatccccggtgatcatcccgacattgtccttaccgaagaggtcgacgagtccgaagaacttctctgagaccaaggctttgatcggggcggtgtagtagcagcgttcaccggcgcacagcgcgatgaaacacatgccgagcgccaccatggtctttccggatccggtgggggtccctaagatcaggtggtcgccggtggcgatatccagaagcgcttcctcctggtggggccacagctccatgccttgtccctccacccaggtgaggaaggtatccagggcatcctccggtctgatgtgaggatcctcgacgttccagttagggcccaactctcccagggtgggcctctcagttgcttgattctcttcgtttgattccatcggtcgctaaactcttctcattgcgcctctatcagggttaaggatacgcccttgcgggtgtccggcgtatgactccatagttttagcgtgcgagggagtaggtgcgctctactgggcgttcagctgcatcagggggagcgtcgagccgccggcgggcatcacaaggatgcggggtgtgcgatgcgtagcgctcttgactgacccacgtgcggcatccagggctttctgtagcgagtggtagggcgtcataaagcagtccagcgcggcctcgtcagggagatcggacaccagatagaccgaggctttctgctcgacgcgggcgattgccgcggctttgtggccaccgagaacaaacttcttgttgagccgatcgatcacatcttgaggagctttcgcttcgtgcatccactgctcaaaggtggggtttcccaacccgtcctggcaggagccgacgaggataatgatgccgccgttgcggaccggatacttggcattctcgagggctttctgcagctggtagagattgaggtctttgggggcgccgccttgggagtccaccacgatgtccgcttgctctgaaagcggacagccaaagagctcatcgagctttttgcaggcgacgcggtgcgccttgacgacctctccggctgctgcaaagaccacatggtgatcctcgtcgaggacagcattgacgataaagttgagaccgacggcgcggcaggcttcctccacatcgagcctcacggggctctccatgttgcccgcgtgtgcggcatcgtcgagcatgagggagtggttcttctcgatcgctgcagaggtggagacgccgggcatgatggccttggcgccgccggagtagcccgcaaagtagtggtactcgacattgcctagggcgatccggaacgtggactcagcgatcggcgtcaggatatcgatcggggtgccgtgcttggtgtggccgaaggagataaactcgtcgccgccgttgacgatcgagtagtgaccatagtagggcccgaagatcgtcttgagctcttcctcagtctgggggcgatgggaacccaacgccacagcgaatgtgatgtgggaatccgccacgccggccgcatgcagctcgtcgaggaccggccccaagaggaccggggtagggagcgggcgggtgcagtcgctcgttatgatcatcacctgatcgcttgggtgaaccaactgatcgaggcgtggggtgccgatcgggtgtgcgagggcggacgtgacggcctcctgctcagagacggacgatgtgagctcgcgtgcgtgcatcacttcaatgagctcatcgtccgggacctcgaagcgctcttcccgctgtccgatttttacgctggtctgcatagctctccttcggtttgtttttctctatcctacccgtgcgggcacatggtggtacacgttgaccttattcggtaacccagagctcaaacctcgattacaatgtgggaaggacacattcagctagacgtgaggggagccaccgtgattcgtttagcactctcagatatggataacaccttggtcccgttcggggagccctatgtatcgaccagaaccctcaaagcgatccacgccgtgcaggatgcgggcatcgagtttggcccggtgaccggccgagattactttgagctcttccggttcttccagggggatatccagggctttcagaccggggtcatgtcgagcgggaaaaaggtttacgtcgacgggctgtgcgtctatgaacgggatatcgactacgaggcatttgtgcggctcaatgactgcgtgaaagagttcgatggcctcttctgcgtcggcttcccggccgacaccagcatcgagaacccggtgtggatcgtggatgacaaccacgatgaggtggcgccctttgaaaggaagttcggcttcaaggccaacttcgtggagaagctgccgcagatcccctacattgcggcgacgatcggaatgccgatgggaaagcccggctacaaggttgtgcaagagcaagtcgccccgcatttcaaggagttctactttgtgtccgccgcccccaactggttcgacgtggtaccgcggggcgtcaacaaggcgagcggcctcaggattttgatgggggagctcgcggtatcctccaatgaggtcgtgatcttcggggactccgctaacgatgtgccggggttcaggctcgtgggcaacaccgtggcggtggctaatgctaccgatcagatcaaggagcttgcccgctaccacatcggcacctcaacagatgacggggtcgcaatcgcgcttgaggatatcgcgtgcaatgcgaagcgggggcagcttcccgattttatgcgcaaccctcagtgattgtccttattcaagatctgctccatgcataggcagtaggtctgaaggcctaagtgctggtagaactggacggcctcagggtttagggtccaggcgtgcagcgtgaggcggtagcagccctcacgctgtgcgaagcctgccacgtactcgtagagcgctttgccgatgcctttcccgcgtgacttttcgtcgacgcacagatcgtcgaggtagagggtcttgatgcgcgtcaggttgttggccccggtgttgttctggaactcgcagaaggcgtgagcgatgacgcctccgtcctcgtcgagtgccacaaagatggggcgcttaggatccctgaggaggacttttaggtcctcaccggtgtacttcacgctgttcgggacaaagaggtccggacgtttgttcgcatggatcgccgaaacctgctcgagcaggtgatggatcgcggggatgtcttgttcttctgcaggcctgatctgcatagggatcacctacttgctggtgtcttttatcaactcggtgtgggcgttcacgcagtcgaccagtttgtcgaagttggtgcttgaggagtggaaagtcctgacacgcccgcgcaggatcagctcaagtgagtgggatttctcacggatatcgacggcagtgacctcgccccagccgaaggtgcgggtctgcccgatgcagttggtgtagtgtacgccttcctcgtcgacacagagcttgcggttgaaatagttcaggatctggatccaggccatcaccatcagcaccgcgcagaaggcagagccaacccaccgcagaagcaggagccagaaggatccattgaaaatcggcaggaacaagagaaagattgcgaaggctgcgaccagtagcaccccgatcccgtagtgcagattggaagagacgtgctcggtcgaagtgatgctttctgcggtgtgcgtatcttcctcagccacgtggtgcctcgatagatctttaagtgcgcgaacgatatgccgctcacagggtggtgcgtgtgcactttccccatacaacgggtgcgcacggtacctgaaacaggtaccattgtagctgaattacactagagatacaacggtgcaacagaacagacggccacacaggctgtcgaaagaggctatacgatccatggaactcacgtgcgaaacccgccggtataagcggttgatggcggaggtacgcatacagattgtcaatgggaacgacgaggagacctgcgcggccttgaaggccgtcgagccctatctgtcccagatctcacctttcgagaaggtcgatcttttggagcgtgcctgcctctggtcgagcaaggagatcgtggatactctcttcgatacgctcgctccctttgtttaccgtggctgggcgctcgcattggcgctgcgctcaggccgggaggagatcgcacgcgacctgttgaggcgcggggttgacctgctggaggatccgacgatcccgctcggcacccctaaccgcgacgagctcgtgaggcgtctgacgcgaggagggctaaccgaagtctccaaggagctcttcgagaatccctttgcggtctcggtgacccggggcgcctttgtgccgccttcgaactctgaggcgcttctgggtgccaactactcacgcggctactcgatcgtcactacggtggcgctgattgagaagatagcaagcgaggggcgtttctccgcagtggtcttcgacgacctgctgcgcactgccctgctcctagcctcctcggcgcaccggaaccccgcctcctatccgccggagactgcggagagctgccttacgttggcccgtgccctgctcaagatgtgcagcaacaataagggtgacactgaacggatcgatgcggtagccgccaggttcattacgccggataccgatgagaatacgatggcgtttatctgtgagtgtgccccacaggtcttctaccagaagcttgccggggctgactggctccagaagaataccgatctggtgagggcgatggtgaaccacctgacgccgggtacccagtaccaaaacggcgtgttgctcagggtccttgcccggggagcctgcctcgacgagctgaaagagatgcgcccctggaagaacaccttcacctccgctaacatcaatgcggcgatcgacgccgccagtgaggcagggcatgccgaagtcgcggcgtggctgctgacggtggcgcagggggtcaacgacagcaagaaaggtgccgcgccgcacgcaaaaccgcaggcaaaatctgatcaggccgaggaagacgacagggacgacctcggagatctctcggatctgctgctgtaaggatatggccgtggaagcaaacgatacacaaggtatagatctcgcgacgcagcgcaaaaagcagtttgcgctcgcaaagcaggtcgtggagcttgcgaaggggttggtggtctcagataaccactttctggcgcctgcaatcgggcaattggacattgtgatggcgccggcgcctatgcccctgagttttgcaactgacggtgagaagctctacatcgaccccactcgggtgctcgacgactttgtcaggaccaaggaagccccgatccgtgacgtcgtccacaccctcctgcactgtatcctgatgcacccctttgtcacgagggacattgaacagggcccttggagcctagcctgcgacatcgtggtggaaaatctggtggcggagatctgtgggccgcgacccgcagagcgcggtgactcgatcgagctcacgatccagcatctcaaatcgaacatgcaccagcagctctcaacgcagagcctctaccgggtgctgcagacgcgtaagtaccggccctacattcctgcctgggtcgatatcttccagagtgatatccatgacctgtggtacccaagtcccccaaatggggaagaggaatccggttgcgcgcacattgagcgcgataccaccgatgaggccaacgagtttgtcgagcaccaccacgagcagatgaagaccaccggtgagacccgtgaggggagcgaacggcagacgcagacgagcggctccggagcccgagcctcagaggctgaggggggtagctgcaccgcggagcaggcagcggaagaggcggcgcgcgaacagcagcgcaagcgtgacgagcacgagtggatgcgggtagccaagacgatcaacgtcgacctgcagactatctccaagcagcgcggcgacgccttgggcgatctgatggaagaactcgagatccgcacgcaccgaccggtggactaccggcagttcctgcgcaagttcgcttcggtgcacgagatcatgcatgtctcacaggacgagtttgactacatcttctatacctacggcatgcagctctacaagaatatgccgctgatcgagcctctggagtaccgcgatgagcggacgatcaaagagttcgtgattgtcctggatacctcaggatcggtcgccggtgagacccttcagcgcttcgtcgatgtgaccttcgatgtgctgacctcgagtggggcctttgctgacaaggtcaacatccacctgatcgaggcggatgcaggcgttgagtcggatacgaagatcaccagtgagcatgacctgaagcggtgggaatcccacatcgcagtgaagggcttcggggggaccgacttccgcccggccttcgcctatgtcaacgagctgcaggagcagggggagttctcccacctcgatgggctgatctactttaccgatgggtacggaatctatccaaagcgccgtccgcgctacaagacggcctttgtctttctggattccacctaccgaaaggaactagtgcctccctgggcgatccagctagtgttgccgccggaagaattgacgcgtgaggcggaagagatggatcgggacacgacatacgttaggaagcaagcatgaatcttaaaaccgcgacagagcagatcaaaggcgccgtgcgggcctacctggcgaaggatgaccaaggcctctatctgatcccgtcccagatgcagcgtccgctgatcctgatggggcctccgggcatcggcaaaaccgcaatcgtgtcacaggtagcccaggagctgcacatcaactatgtgtcgtactccatgacgcaccacacgcgtcagagtgcgctgggcctgccctatatcaccgaggcgacctatgggggttcgacctacaagatctcacgctatacgatgagcgagatcatcgcctccacctacgacgcaatcaaggcttccggcattcaggaaggcatcatctttttagatgaggtgaactgcgtctctgagacgctggcgccgtcgctgctgcagtttctgcagtacaagacctttggccagcataaactgccgaccggctgggtcatcatcaccgccggcaacccgcctgagtacaacagcgccgcccgtgagtttgatgcggcgatgctcgaccgtatgaaggtgatcgatattgaaccggatctcgatgtgtggatggactatgcccacgcccacggcgtccaccctgcgatcatcacctacctcacgaacaagccgcagaacttctaccacgtacaggctcaggtggacagcacttcaatcgtgaccgcacgtggctgggaagacctttcccgcatgatccaggcttatcaaaagctgggactcaagatcgacctcgacctgatcggccagtacctgcaggatccggagatcgcggaggacttcagtctctacctcgagctctttgagaagtaccaagacgactaccaggtcaacatgatcctggcaggctccgcttcaaacgacctggtgacccgtgcaaagcaggcgccgttcgacgagcgtgtggccctcatcaacctcctgatcgatgtcctgctgcgcgatgcgcacaagatcgcctatcggaagcaggcactgcttgaagtcagaagcgtcctgaaagacctcaagggcgctgaaaatggtgcggcgatcctgaaggtgatccagcaggcggagagcctgataaattcagagctcaagcgcctgaagacagagggcggggcgaccgtcaggcgccaggaggtcctctcacgcgagtcacgtaccttggcgcagctgcgccaggacgtctctcgtgcgataacccagggctgcggcgagctttccggtgaggaaggctatgacatcgtgaaaggaatcttcaacggactcgtgggagacctttccgcttcctcgaagagcctgaagcactcgattgacgctgcgattgactttgtcggtgccgccttcggagactcgcaggagatgctgatcctcacaactcacctcgcagtggaccacgacttcacccacttcgtggcggagaatggctccaagaagtttgtggatcacgcccaaggtctgatgttccacgacagaagcgcgcagctgctcgagcaggcacagaagctggagggactgtcatgagtgagcaggatcccaagcacagtctcgctgacgatatcgcggccagcggcctgcacatgtcaaaagaactgaaggaatctctgtgggaacaggatgtagaagaggtacagggaaccgcacagcctgctgcctgcggtgcggccttctcatcctccacacaggaggtcagagagaccgtcacaacggacacacaggacactgatcctggggatccgacaggaactgccttcttcaaggcgatgaatgcctatcgggctgcccgcaaagaaggggacaaagatagacttgcagaggcacagaaacatctgcaggacgtggtgcgttcggagctgagcggggacgctggctgcgaagctgtcggtaagaaataaggggtatatgggcaggagccgcatcgagagatgcggcgcctgccattccagctgtattcgatgttgcaaggataaaaacttaggctctcacaccgtacttggcatagtactcgtcgagcgcatgatcgatcttgggggtgatgagcgtaccggtgagggcttcacgcacctcctgcatcgtggtgatgcttgcaaccgggaagccgtagcgctcgtgaatctcatcctgcgcgctcttgacgccgccgcggccaacctccatacggttgagggagacgatcaggcccacaatctcgatatcggcggccgccttgatcttcggcagagtctcatcgatcgatttgccggaagtggtgacgtcttcgacgatcacgacttcatccccatcgtgcagggtagcaccgaggagctgccccctgtctgccccgtgatctttggcctctttccgatcggcgcagtaggaagcctctttgccatacagctcatcgagtgcgatgcatgtggtgactgccagtgggatgcccttgtacgcggggccgaagacgacgttgaagtcgagcccgaagtgctctttgattgcctgagcgtagaacgttcccaatttgtggagctgcgagccggtcgtataggctccggcattcataaagaagggggagatacggccgcttttgagcgtgaaggtgccgaacttcagcacgtcgctctgaaccataaagtcaatgaattctcgctgatagtccttcatagggtgaccctttacgacgaagtctttgcaaaaccgtatccattgtacgcacaaacctctcacagtgcctggttcccaaaggtcttgacactcccttttgtacggcgctgcaaaattcggtaggctagagggtggcagctttatatgagaagaaatggggagtatggctaaacgcgacacacacaatcccagcgctacgatgaacctgaaaccgatcatcagcgaatcggaagttctaaagcgcacccgcatgcggcatcggatgcaccaggtgactgagaactcagtgatcgctgcaggggtaatggtgctcgccacgcttgcggcggtgctcgtggccaataccccggcggccgacgctgttcagacggtgatgcaatggccggtggagctgcgcctcggggatctggtcggcaagctctcctttgagagctgcgtcaatgattttttgatggcgattttctttctggaagtggggatcgagctcaaatacgagatggttgtcggccaccttcgctatcctcgccaggcgatggtgccgatgctcgctgcggtgggcggcgttgcagtgcccgcaatcatctttacctgccccaactggggtggagcgtcccacggctgggcggtcccgatcgcgacggatatcgcctttgccctaggcgtgatgtcactggcgggggagcgggtggtcccggcaacgaaagtcttcttccaaaccctggcgattgccgacgatatcctcgcaatcgtcgtcctcgccctcttctacgggcagtccccgaatatcgcttggtgcgccgcttccggtatcgtcgtggtggtgctggcctggttgaaccatgcaaaagtctattcgctcaagccctacctgatcatcggcttcgccctgtgggtgtgcatgtacaactccggcatccactcgacgctggccggggttatcttggccttcacgcttcccgtgaagagcgatgtgaagcttttaagcctttcagattggctcaaagggcagtccagagagttggatgagacctacgatgaggattatgcggtcttagggcagcgggagttcaccgactccacctatcagatcgagcgcattttgcaccgtgtcacccctccgctgcagcgcgcgcagcgctacttctccactgcgaccaacttcgtgattttgccgctctttgcctttgtgaatgcccaggtccgcttggtcggggtggatatggcagcagttgtcagttcgccgatcacccgcggtatctacttcggtgcggtactcggcaagccgatcgggatcatcggtgtgacgctgctgctcgagaaattaggatttgcccagctgccgcgtgagatggatacggtgcaggtcgtgacgatgggacttatgggcggcgtcggcttcacgatgtctatcctgctttcgaacctggcctttgccgagcctgagcaggtcctggcggccaagtgcgcgatcatggcggcatcggtgactgcggcgatctcagggttggccttcctccacatcgcggatgcggtgcggggctcccggcgatcacggatatagcgctcaagcgtgatcaggacagcgtgccgtaggtataaccccagccgtgtgcggtgatgatggaattgagctgctcgacgaggcgggcgcgcttgtagttacctgccggcagcagctgcaggacttccatcagatctgggctcaggtcatccacttcgccgcgggtgatcacatcgatgctcgagatggagccggacatattgccctggtagagctcatcgacgagcttctggagctccccgtattcgtccgagcgggtattttcatgtatggaggcgtgtttccttttcatgaggacatagtagcagctttgcgtgagatagaaaacacaggttttacggagttggtctactatgggagcacacctaaagcgatggcacgccaccgtgcctacaaaggaggaccgtatgagcagtgcttttgcaaagctctcggatgctgaacttgatacagcgatcagcgatctcgaaagacaagcccaagatttgaaggctcaaaatctcaaattggatatggcgcgtggcaagccctctgaggagcagaccgatctctcccgcccgatgcttgactgtgtcaactcaaagtcagatctcgttgacggtggaatcatggtgaacaactacggcggaccggacggcatcccctctgcacgcaaactcgcggcagagtatttggatgtcgatcctgccaatgtgatcgtcagcggctcatccagcctgaacctgatgtatgacctggtagcgaacggctacatgcacggtatcgccggcaacaagccctggagtcagcaggggaaagtgaagtttctgtgcccctccccgggctatgaccgccactttaaggtaaccgcttcgtttggcatcgagaacgtcccggtcacaatggaggatgacggcccggatatgagacaggtcaagcagctcgtagaggaagaccccaccgtcaagggcatctggtgcgtgccgaagtactccaacccgaccggtgcggtgtatgcggatgaggtaatccgtgagtttgcagcgctgaagcctgctgcccctgatttcaggatcttttgggacaacgcgtacaaggtacatacattcagaggcgacggtactgatcagctcaacatctttgatgccctgaaggaagcgggacagacggatctggtctacgagttcggctccaccgcgaagatcaccttcccatccaacggtatcgccttcgtgaccgcatcgcctgcggatatggcagagatccgtgaggccttctcggtcatgcgcgtctccccggagaagatctcacagctggcgcacgtgaagttcctgaagaatatggacggaatcaaagcgcacatgaagaagcatgcagaaatcgtgcgcccgcactttgatctggtcgagaagaagctctccgaaggcctgggcgatctcgggatcgcgacgtggacccaccccgacggcggctacttcgtctcgttcgacgggccgcagaattcggcgacggcgatcgtgtcgatgtgcgcgggcctcggcgtaaggctcaccgctgccggcgcgacctggccctacggtaaggatccgaaggataccaacatccgtatcgccccgacgtttccgagccttgagagcttaggtgaggccctcgacgtcttcgttgtggcggtcaagctcgtctctgcccgcctcgagcgggagtcccgtcagaccaaataggcctgaaagggctgcgcgcctcaccgacgcttcggacatggagtagttgtatataatttctagatgcaatcctgcatagtatatatgtaggattgcattgttagatgtgcaggcgtcgtatcattcacaggatagcggggcgcgcaaagaggagaatgttagaggatggcaaagcagtcaaaacatgtacgcaaaccggcgaagaaagcaaaacacaagaaagtagcttcgcagggcgcccatgggaccggaacgatcaccgatagggatctgaagcgcgcggagcgctccttgagcaaatccagaggcctccagacgagcaagtacaataccctccatctgagcctgcccgtcaagatcatcctgatcatctttgtggtgatcatctccatctcgatgatggtgccatcgcttgcctctgtcgttgcgggaaaccggaaacaggaagagcagaagcaacagcggcaacggcagagcgaggacaccgatgccgccgatgcctccgagggtgagatcgaccagcgctaccaggcgctcgtcggcgagcagcagcagaaagtgggtgaggactcctcaaaccttgctgcacttctcaacgtgggtaatacctatatgcggtggggtcatgcgctgatgacaagcgaccaggcttcaggcgatgccgaccacatccacgatatctttaacaaggcggtcgccgcgtatgaccagtacctgtcgcagaatgattctgacgccgtgcgggtcaatcgggcgtactctcagtattacgggggagacacccaaggtgcgatcgactcactggtgacgctgacgcaaaacgatgccaacttcggtccggcctggctggcgctcggtaccctctatcagggacagggcgatatcgatgacgcaaagaatgcctacaaccaggcgatcgcggttgagccgaacgatgagtatggatctaagtcggcggcgcagagtgccctgcaggcaattgcacagagagaaagtgcagcccaatcgaagcagcatgcacagggcggtggtgacagctctcagagcactccttctggtgactcctcaggcagatcgctgcagggcgatctctctgatgccaccggcacgggtgaatagaaaggaaacgtacgggtatgcctttacagattagcgttgcagcgaaggacaccggctctaaggttacggtagccggggaggtggacgtctcgaatgcctcagagctcagggatgcccttaagaaagctatggcgcagcacacaggcgacgttgcagtcgatatggccgacgtctcctacatcgattccaccgggatcggcgttctcgtcggagcggctcacgcggcttttgacaagggcacaaagcttatcattcagaaaccccagagcaatgttgaacgcgtcctcaatctgttagggattgaagaccagctcaatattgaacactaacgtgtcggaagcgtgtggcatggcggaggtatagcgcgtgtttggtattggtgaaaccgaatttgtaatcatcttgatctttgccttcctgatctttggcccggacaagctgcccggaatggggcgtactatcggccgggcgttccgtcagttcagggatgcgcaggacaatgtgacaaaagtggtccagtctgagatcgtggacccgatcaactccggcatgaatgagccggcggcaaagaagcgggctgaagctgcgaaagcagcgcaggccgaggatgcggacatcgagtctgcatctggtgcggctacggcgagcgcaacggccgcaaagcccgaaacctttgcgcagcgcaaggcgcgcctcgagcgtgaacgcaaggctaaggagaacagcgaagctcagacaaatgccgcgttcgataggagcgatacggatgaggcaggggagtcacgccccggtgcggattcggatgaggatctccctgctgcggcgaagaccaggccggtcaagccctcgcttgctgacctctatgcgatgactccgaaatcccatgcagcgctcggcgcgaaagaggaatctgttgcaaagcaggctggggcactgtctgccgctgaggcgaagcagcctcaagcggagacaccgaaacctgttcaggaagagcagccggctgtagggcaggcagtacctgccgatcagcagacatctgcccctgcggcgccacaggctcagccggcaaaggagagggtaggcgaaagcgcttcaaaaccggccggtgcagctccagagtctgaaagcactgcgaccagcgaacctgctaccacaaccggagaggaggatgactgatgccgatcggtccagcacggatgcccctgcgcgatcacttaggagagctcaggcggcgtctcacgattgttattgtttctgtgttggcgacggcggtcgtgatctactttgctaccccgacgctgatcgatattctgctcgacccattgcgcagcgtgatgggcgcagacgcaaggctgacggtcctcacgatcctcggtggctttacgatccgctttaaggtcgcgttcttcttcgggctgatcatctgcaccccgatcatcatctgggagatcatggcattcttcctgcccgcactgaaggagagtgaacgcaagtgggtcatcccgacggtggctgccctcgttatcctcttcttcctaggtatgatcttttgctacttcgtgattcagcgtgccgccttcggttggctgctccagcagacgaacgaatttgccgatccgctctacaacgctgaggattacctggacatctttatgaaattggaggtcggtttcgggatcgcctttgagatccctctggtgatcttctacctctcgatcttccacatcgtgccctattcgaagttccgcgcgaactggcgctatatctacatcggtctcatgaccctgtcaggtatcattacgccggatgcctccccggtcacgatgctgctgatgttcggggctctgatcggcctgtacgagatcgcgcttgcgatcgcccgccggattatcatcaaccgtgacggcaaggcggcgctaaaatggacgcgcgaagactacgaagagcatgaatttgatgaagaatagaggatagatccttgatactggtcgttaccgagaaaaatgatgcggcgacgcagatcgcgcggctgctgagtgagtcgggaaaaccgaaagctgacagagtctacagcacacccatctactgctttaagcacgacggggaagattgggtgactatcggactcaggggccacattatggctcctggttttcctcacgagctgaaatactccaagaaagaaggctggtacggcttaactgacggcggggagaagctgccggcgcacctgccggacaccctggcgaagccgccctacccgaaagcaaaaaacggccgcatcaggaaaccgtttgaagccgacggcgtggacatcaagggctggaagatcccggcgctgccttacctggtctggtccccgatcgagaaagtccccgctgagaaggagatcatccgctcgctcaagaacctcgccaaaaaggcagattccatcatcatcgccaccgacttcgaccgagagggcgagctgatcggctctgacgcgctgcgccaggtgcgccaggtcgctccgaataccccagtgtcccgtgcacgctattctgctttcacgaaacaggagatcacccacgcctttacgcacttagtgccgctcgaccaggatctggcggatgccggcgagagccgccagtacatcgacctgatctggggcgccgcgctgacgaggtatttgacgacggcgagattcgcaggactggggaacacccgctccgcaggccgcgttcagaccccgacactggcactggtcgtacagcgcgaaaaagagcgtgaagcctttgtaccgaaaccttactgggttatttccggagagctctcgcatgcggatgacacctttaaggtccgccacacgacggcacgcttctgggataaggacaaagccgacgtggcctacagcgctgtcaaagacgcgaaaaaggctaaggtcgtcgacgtcacgaagaagagccgcaccgtgcgtccccctgcgccgttcaacaccacctcactgcaggctgctgcagccgcagaggggctggcaccgggccgaacgatgcggatcgctgagtcgctctatatgcgcggcctgatctcctatccgcgtgtcgataataccgtctatccgcattctcttgacctcaaggagacggtctttgcgctctcgggcgtcccgcagtactccaaggtgtgccgtgagctgatggcacagccaaggctgaccgcgacccgtggccggcaggagacgacggaccacccgcctatctatccgactgcagccgccgatcccactacgctgaccggtgcagactggaaactctataacctgatcgcccgtagattcctggcgaccctcatgggtcccgctacgatcgaaagcaccaaactcacctttgatatcgccaaagagccatttcaggccaccggcgatgtgctcgccaaagcaggcttcagggcgatctacccgtacggcttaaagaaggacgagcagctcccgccccttaaggttggggacgtctgcacagtcgagcatctcaatatggatgccaaggcgacggagccgccggcgcgttacagccagggcaagctgatccaggagatggagaagcacaatctgggaaccaaatccacccgcgcctccatcatcgatagactttacgaggtcaaatacctcaggaataacccgatcgagccttcgcagctcggtatggcggtgatcgaggtgttgcatacctacgccccgcacatcacgacgccggacatgacgagtgagcttgaacaggatatgaaccaggtggccgagggcaaagagacccagactgaagtcgtggaccactcccgtgcgctgctcgcgggcatgctcgatgcgctgatcgtgcacgaggaggatctgagcgacgcaattgcggatgcgctcaccgctgacgcaaagatcggcgtgtgcccgaagtgtgggcacgacctggtcgtgaagagctctgcgaagacccactccagctttgtgggctgcacgaattggcctgactgtgacgtcacctatccgctcccccggggacgcattgaggccctcgagggggatgccgcagtctgccccgagtgtggcgcgccccgcatcaaggtacacccgttccgcagccgcgcctacgagatgtgcgtcaatcccaaatgtccaaccaactatgaaccggatgtggttgtgggagagtgcccggcctgcgccaaagaaggcaagaaggctaagctgattgcgcacaagtcagagaagaccggcaagcggtttatccgttgtgagaactatgaggagtgcgggacgagctatccgttgccggcccgtggtaaactggaagcgaccggggagacctgccctgcctgtggtgccccgtctgtgatcgtccacaccgcgcgtgggccttggaagctctgcccgaatccgaagtgcccggataaccagaagcgtgttgcggcacggggtagtagacggcgtggaggtacccgtacgcgcagaagcgcgcggacttccaggaagacgacgaaggcatgagagacgggctctttatcagctttgaggggatcgatgggtgcggcaagtcaacccaggtagcgcggctcgccaaacgcctgaaaggccaaggccatgaggtggtgtgcacccgtgagccgggtggtacgcgcatctcagagaagatccgcatgatcctacttaaccctgccaatacagagctgacaccgataaccgagcttctgctcttggaagcctcacgggcacagctcgtacaggaggtcatcctccccgcacttgagcggggcgcgattgttctgagtgatcgctatgcggattcgacctcagcctatcaggaggcgggtcgagccctccagcatgcagaagtggtgcaggcaaacaagctcggcacctgtggggttgaacctgacatcacctttctgatggatatgaaccctcacgaagcgctcgcgcgcgctatggagcacggggcagaccgaattgaagcagcagggatcgcttttcaggagcgggtccggcaggggtacctcacgctggtcaaagagtatcctaaccgtattcaggtgatcgacgcctccatgtcgctcgaggaggtctccatatcgatcgatcaggtgcttgcgaaagaacttgacagactcgaggtccaccatgactgacgtgcaggagaagcgggcgctacctcccgcgctggcacggcttcgctatcagcccctggctcaggaatttttggcccatgcggtgaccgaagaccacatcgaccatgcttatcttttcgtcggcgagccgggatcggggagcagtgaggcggcggaagcctttgcgcagtgtctggtgtgcccccatgggggagacggtagctgcgatgagtgcatccgtgtccaccatcacactcaccccgatgtgcactggatgagtccggacagttcggtggggtatctggtcgcgcagatccgtggggtgatcgaagacgcacagctgacgccggtgcgcgctaagactaaagtgtacatcctcaccaatgcggcgctgctgcggggagcgagcgccaatgcgctgctcaagaccctcgaggagccgccggcacacgtggtctttatcctgatcgctcgctcggctgaggcgtgtatggagacgatcgtctcccgctgccaggtcgttgccttccgttccatcccgcaggaggtggcggtcaaaagcgtcgtcaatgagactggcgtgagtgagcgagacgccagaatcgcgctggcggtcgctcagacgccggaggctgccgtgcagtatctcggggcgccttcacggcgcgacctgcgcgctaagctggtccatgcgctgggggatcttcacggccaagacgactgggatgtgctgtgcgcggcggacaatgtggtgtcgatcgtgcaggatccgctggcccagatgcgcaaagaacagaaggcggcgcgggatgaagcggctgagtatctgggcgccaccgccctgaagaagcttgagaactcacagaaacgtgaactttccgctcgtgagcgttcaggtatgatggaggtgttcaccgtgacgcagtccgtgttgcgcgatgcgctcctcgagagcgaagcttgtgagcacgatcctgtgaacagtgactttacccaggttgtcgatacgatcgctgccgccggcacacagaaaatccttcgtgcgctgcaggcggtcgacgaagctcgcggcaatcttgaacatagcgtatcaccccagctgaccttagaggtcatgctgtgtgccatcaaggaggcactctcttgaccactattatccccgtcaaattcaaatattcgctcagagagctgtggttcgatcccaagaagaccggcgcccagcaggctgaccacgtgatcgtcgagaccgagcggggcactgagatcggtctggccgtcggggatacgaccgaggtcgacgacgagaccctgaaggcgacgatcggggctgccccgctgcgaaatgttttgcgtattgccaccgatcaggaccttgcccgggcagagcacctctcgaagctcggtgaagaggccctgccggtcttccggaagcgggttcatgagtccgatctcgatatgaagccggtcggcgtggagtacctgttcggcggcgagaaagtcgtctgctactttgcggcacaggaccgtgtggatttccgccagcttgtgcgtgacctttcccgtgacctgcaccagcacatcgatatgcgccagatcggggtgcgtgaggaggcagccctgatcgggggctacgggcactgtggcgaggagctgtgctgccgccgcttcgtgcacgagttccagccggcctcgatccgcatggcaaaagagcaggatctcccgctcaactcctcaaagatctccggcgcctgtgggcgcctcatgtgctgccttcgctatgaattcgaagcctaccgtgacttcaagagccgggcgccgaagcgcaatgcggtgatcacaaccccgttgggcaaggcaaagatcgccgagtatgacacccccaaagaggaactggtattgcgcttcgagaacggcaagagctttagggtcgcgctcaaggatatgaccgcaagccccgctgcgatcaaaaaggtgaaggaacagggttgcccctgcagaccggataccgtggagcgctcggttctggatcgacttgaatccccggatatccagatggcgctggcggaacttgaccgccagcacggtgtcgtcccgccaaaagagcgcggtctcgcggcagaggatgaaaatgacctgctgaacgggacaactacccgcccgccgcggacgcaccgtctcgttgcgcccgtcccacatggtgcgcgcagagatccctgaaggggaagaggctcctgcacgccgctccccggcgtcggaaagtccatgctgagcacgatttagacaaccatggaagcccccaacagccccaggagaagcgggcggcgcatacccccgcagacgccaccatgtggccgaaggcgcgcagaagccaatgccgcgcacacgtacggcagaagtggcagacaaagggccagcagaacaacaagccgagcgcaccgcagagatgagtgccgggtcgccctgatacccgccatctccgtgaccgggcaatgctggaacagcgcagcgctcgacactcgagacgggcgccgccacacggcagcgccgcaggcctcaacaggctaacctcagagtcaggggaacagcgcagaccatcggcccaccgtcgtcggcacagctccccgcaggggaacagcggcaatagtggtcgtgccagcacgcaaaagggtgtagcgcattgtggcttgtgcgtagcgcaagccacatccatgcgcagctctctgtgcatctagaacatatgttctatactgaaaaggtcggaagggacttgtgacagctatggatcaggatagcgaagaggcgaacggtatgtcggcctcatcgcccaaaccatgaggagggggaaccgtgccgttcacgccctgtgggaccatggggtgcactgctgtgggacaggggtcctcgaggtcaggcaggcctattcctctgtggccggcgatgcggcatgcgttacaccgatgaaggtcgaaggctacccacccatccccactgtgaagggctcaagtggttccgtaaaggcaaaatgggtgtgcctccgtcaactctgagggcaatgagacgtaaggatctgggggcataccatgtatcagctcaagacagaagcttcctttaacgcggcacacttcctgaccgactaccacgggaagtgcgaaaacctccacgggcaccgctggcgggtagtggcctatatcagacagaaggagcttcaggccgctggcacgatgcgtgatatggtcgttgacttcggtgagttcaagcgccttgtgcgcgcgatcgtcggggagtttgaccacatgttcctcgtggaggaaggctcactgaagccgacgacggtcgaggcgcttgagggggaagggtttgtcctaaagatgttgcccttcaggaccaccgccgagaacctggcgcactatttcgccgaacgctttgttagggcggggctccctatctcacaggtggatgtgtatgagacgccgcttaactgtgctacgtacatccctgagggggattgaggagtgctgtggcaggcaccggctatgatcgagtggtaaacattaggtaagaaaacgcggtgggcaggataccgagcgtatactttcttaggaagacagactcatacaggtaagggacggtgtaaacgtggagagtccaacgaaaatccatggggttaacttgacaggctggctgaccttggagtcatggatcacgccggaactctttgccgactcgggggcgctcacggagcgcgacctggcgcactcactgggagctgagcgctataaggcgctcgtccatgcccaccgcacagcctttatcaccgagagtgacttcgcttcgattgccctgcgtggcttcaatgcggtgcgccttccggttccgtggtacgtcttcggagatgaaggtcccaattcgggaatgtatcagggctgcctggagcaggttgacaatgcgatggagtgggccgagaacgccggccttatggtgctgctggtattctcagtgtcaccgggttcgacggtggcgcagtcagaccacgccacgagcggccaggaagtggttgcgcatcgacctgaggcgatcaaaatcacccgggagctcacgcaccgttatgtggacagcgatgccttcttgggcatcgagcttgcggatgatccggtggcacagcgccgtcaggggctgcatctgagcgaagggatccccatccatctgctgagaaactactaccgtgcagtgtacagtgccctgcgtgaagctgagggcccgaattttctgatcgtgctccccgatgctggcgccgaaaatggctgggataagttcctggccacgcaccgcgatcagaacgtgtggctcgattgccatctctatcagtacctcgacgacctgagcgtcaccgccagtgagctggatgtgcgcgatctcgtgaggaaatccctcaagaagctgaaccgtgcgcggcgctcacgtctgccggtgatggttggcaaatggtcaggggcgttgccctacgctgattcggtttcgacgccggaagggcgtatcgcgctcgagcgtgtctacgtctcagaacagctccatgctttcagggagtgccccgcctggtttttccagacctggaagaccgaaggaaagattgccggctgggatgctcgcattgccctctccagctttgagcggaggctgctcgactgatgggtggcgttctgtcgatggtcgggaccccgatcggaaatatgcaggacgtctcgcagcgggtggtccacactcttgaatccgcagatacagtgctgtgcgaagatacccgggtgaccgggaagctgctcagcctcttgggtgtacacacccggctcgagcgctgcgacgcgaatgtcctgcccttggagctgccgcacatcttggagcggctcaaagcgggggagcgtatcgcctttgtctcagatgcaggcatgcccggaatctctgatccggggcaacagctcgttgatgccgcacgtgaggtggatctgccggtggaagtcgtcccgggtcccacggcctctgtcaccgcgctcgtagcctcaggtcttccctcgaaccatttcttctttgagggatttttgccgcgcaagggtggggcacaacgttctcggcttgagatgcttgccgcgattcctgcgacgcttatcgtctacgaatcaccgcgccgggtggtgtccaccctgaccgtaatcggtgaggtgatggctgaccgtcaggtggcacttgtgcgggaactcacgaaggtacatgaggaagtcctgcggggcactgcccaaaacctgattgagacactgaatgcacgcgatagcctcaagggggagtgcgtccttgtgatcgctccaccctctgaggaagagcagcgcgcacgggcagcagtgccccagataggttttgaagaggcgctgaagcaaggccttaactccaaagaatcgacgagcgcgcttgccaagcgtctggccaaaacctacgggaaacctcgctctcgggtctatgagctcatagtatctgtacgtgaaaagctataatggtgcgtgcttgaacattggtactatgcgtgcccggatgtggtgcgctgaggagtttttatcatggcaaaagagccttctttttacattacgaccccaatctactacgtgaatgcggcgccgcatttgggaacggcctactgcacgatcctgacggatgttcaggcccggttccgtcggctggaaggctacgacgttaaattcttgaccggtatggacgagcatggggagaaggtcgctgatgccgccgaggagcacgggatgaccccgcagcagtggtgtgatgcccaggctccgctcttccagaagctgtggaagaccctcgaaatctcaaacgatgactttatccgcacgaccgaaccgcgtcagtaccatgcagtccagtatctctgggagcgcatggaggaatccggttacctgtataagggctcttacgacggttggtactgcgtgccagaggagacctacttcaccgagaatcaggtgaggaagtccgacgaggcgagccacaccgaggggcagcacctctgcccggactgcggacgccccctcgagcgggtgcaggaggattcctacttcttcaagctctccgcgttccaggacaagctgctcaagctctatgatgagcatcccgacttcgtgcagccgggctttcgcatgaacgaggtgcgttcctttgtagagggagggcttcaggacctatctgtctcccgtacgagcttcgattggggtattccggtcccgttcgataggaagcacatgacctacgtctggttcgacgcgctgctcaactatatgaccgccgtgggctatggcctggacgatccgaagtccaaggaagagtacgcctaccgctggccggcgcagtaccacatcgtcggtaaggatatcattcgcttccactgcgtgatctggccggcgatgctgatggcaatcggtgagccgctgcccgagcatgtcttcgcgcacggcttcctcactgtgaggaacaagaagaccggcaaagccgagaagatgtccaagagtcgtggcaacggtattgacccacaggaggttatcgacttcctgggcgtcgagggctaccgctattactttatgaccgacgttgagcacggtgaagactgcgcgatctcctttgagcgtatggaacaggtttacaatgcggatctggctaacagctggggcaatctggtctcccgctcgctcaacatgtccgccaagtactttgacgggaaggtcccgacgattccggagggctggaagagccaggacaatccgctgcagacgatcgctcagggcatctgtgagcgctactgctcccacatggagaagttcgactatgcgggcgctaaggatgtggcgatggagctgatccacgctgccaaccactacattgaggacacgacgccgtgggctgtcgctaaggatccggcgcgtaaggatgagctcacatcgatcatcctcaaccttctggaatctatccgtattgcggcgcatctgatgacgccattcatgccgacgacctccgcagaggtcctgtgccgcctgagtctcgaggatgagatcggctccgatgagacgctcgcgaccctgtgtgagtggggacgccttaagggcgacgtacctgccgcaaagggcaaagcgctcttcccgcgcctgcccaaactggacagataggatctatgtattcatacctggcaaatccccgtgcgacgcgtgaggtgctcgatcagtttggcttcaccaccaaacatcacctggggcagaactttctggtcagcgatgctgtgattgggcacatcctcgaacttgccgatctcaaggagaccgatacggtgctggaggtcggaccggggatcgggacgctgacctgtgcgctgcttccccgggcacaggcggttgtctcacttgaggcggaccgatcacttgaggcacttagccggtcttgcaggaggaccttgcgcgcagcggctcgatcccttgcgatcctctgggtatgcgctgagactgaccctcaagatatttcaacaaagcctttgcagagctggggtgcgtgaggctccggatgcctttgtctccaaccttccctatcagtagcggcaacggtgctcctcgcttgcttccagggattatgatgccctgagctgcgtggggtgtgatgttcagtgtgaggtgtgctgatcgcattgttggctcagcccggctccaaagagtatggcgccataccgataaagctgaggctctttgcgcgggtgactggccgcttcaatgtctcacccagcaaacttcatagctcaaaccgcacgtggagtcctgctggtacggctggagatgtgtctcaggaggcactgacacaagagctgcagaaggtctttcagtggtgtgaacgccgccttctgccagcgccgcaagacctccgtaacgcaatgagcttctgccgggtttgacaagactatgctcgtatgtgcctttgcaaagtcagtggattgagccttccgcacgcgcggaacggctcgaggtatcagatttattgacttggaacgcgccttggataaggcgggatttcgtgcatcataccgtaaataagggggatagagatggctcaaaactgcacaagctgtagcactctttcacgataaaagggaagagcgaaggactaccccgatggctttgttgcccctgatcgatacgcatgggcaccctcactgacttcgacgaaaacacgccgacgcgggcccttgcccgcgctgcacaggcaggcgtctgccatctggtctcaaccgtggaccctggcgctgacgcatgccactgacaccgaggcatctgagatgtatgccttccatagtggtgcaaatgcccacacgctgatcgatgctcatcgccaagcgggggtgagcttccccaagtttgaaggacagaagcccacggcgtacggcggatgccgccgaaatcgcgcactttggccgcatcgcgctggtgtggcacccctatggggctaaagcacctggaggatcccgagcgtgaaaaatctatctatcttcattcttagatgtccggtgtgcgtctggcgtgggtggagatcgagctgtttcaataaaagcggcgtctctgctcttcgtgtcccgcaccgacgtgtgtagtccagcccgaactccccccacgccgacgcacaccggacatctagaatgaagataagatgctttttcatcacctcgggatcctccagtaagcttagccccagagggtgccacaccagcgacgatgcggacaaagtgcgcgatttcggcggcatccgccgtacgcccgtgggctcctgtccttcaaacttggggagctcaccaccacgcttgtgcgctgagcatctatcatcattgtgggcatccttgcaccacattgaaggcataatcagaatgcctcgggtcagtcgcatcgtcagcggggtccaccggtgagaccgatggcagacgcctgccttgcagcttggggcaacggccccgtcggctgttttttcgtcgaagtcagaggttgcccatgcgtatcgatcaggggcaccaaagccacgggtgtccttcgctcttcccttttatcgtgaaagagtgctacacttgtgcagtttgagccatctctatccccctttatttacggtatgatgcaaatcccgccttatccaaggccgttccaagtcaataattgatcaacctcgagcgttccgcgcgtgcggaaggctcaatccctgcctttgcaaaggccacacgagcatattcttgtcaacccggcagagctcattgcgttacggatggtcttgcggcgctggcatagaagcggcgttcacacacctgaaagaccttctgcagctcttcgtttgtcagtgcctcctgaggacatctctccacacgtaccacgctaggactccacgtgcggttgaggcatgaagtgctcgtgagacattgaacgccagtccacccgcgcaaatagcctcagctttaccgtgtaggcgccatactctttggagctcgggctgagccacaatgcgatcagacctcacacgaacctcacgcaccgacgcttcagcgatctaatccctgaagaacgcaggagcaccgtgccgctacctgatagggaaggttggatgacaaggcattccggagcctcacgcaccgccagctctgcaaggcctttttgaatatcttgatggtccagtcctcagcgcatcaccccagaggattccgcaagtgagtcgaaggccgctgcgcgcaggtctcctgcaagaccgctcaagtatcgtccgctcaagtgagacaaccgcctgtgcccggggaatcagcgcacaggtcagcgtcccgatccccgttccgacctcttcagacgtatcggtctcctctagatcgcaagttcgaggatgtcccaatcacatcgcatcgctgaccagaaattctgccccaggtgatgttttggtggtgaagccaacatgatcgagcacctcacgcgtcgcacggggatttgccaggttatgaatacatagatcctactgtcccagttttggcaggccgggaagagctgctttgccctttgcgcggtacgtcacccttaaggcgtccccactcacccagtcgcgagcgtctcatcgagtccgatctcatcctcgagacttaggcggcacagaccctctgcggaggtcgtcggcatgaatggcgtcatcaaatgcgccgcgatacggatagatttccagaaggtttgaggatgacgatgttagctcatccttacgcgccggatcccttagcgacagcccacggcgtcgtgtcctcaatgtagtggttgccacgtgggacagctccatcgccacatccttagcgcccgcatagtcgaacttctccatgtggtgagcagtagcgctcacatgccctgagcgatcttctgcagcggattgtcctggctcctccagcctccggaatcgtcgggacccttccctcaaagtacttgtcggaacatttgaagtcgagcggcagaccagttgcccctctgttagccagatccgcttgtaaacctgttccatacgttcaaaggagatcgcgcaggtcttcgtccgtgctcaactctcatacgtaatgcgtagccttcgacgcccaggaagtcagaacctcctggggtcaataccgtttgccacgctcttacatcttctctggctttgccggtcttcttgttcctcacggtgaggaagccgtgccgaagacatgctcgggcagcggctcaccgattgccatcagcattgcggccagatcaccagttgaaagcgaatgattccttaccgacgatgtggtactgcccggccagcggtaggcgtaactcttccttgactatcggatcgtccaggcatagcccacgcggtcatatagttgagcagcgcgtcgaaccagacgtaggtcatgtgcttcctatcgaacgggaccggaataccccaatcgaagctcgtacgggagacaataaggatcctgaagccctccctctacaaggaacgcaccctttcatgcggaagctcggctgcacgagtagattggctcatccatatagctgatgcacttgtcctggacgcggagagcttgaagaagtaggaatcctcctgcacccctcgagggacgtccgcagtccgggcaaggtactgcccctcggtgtggctcgcctcgtcggacttcctcacctgattctcggtgagtaggtctcctccggcacccattcccaaaccgtcgtaagcccttatacaggtaaccggattcctccattagcagctccagagatactgactgcatggtactgacgcggttcggtcgtgcggataaagtcatcgtttgagatttcgagggtcttccacagcttctggaagagcggagcctgggcgtccaccactgctgcggggtcatcccgtgctcctcggcgcatcacgaccttctcccatgctcgtccataccggttaagaatttacgtcgtagccttccagccgacggaacaccgggcctgacataccgtcggatcgtgcagtaggccgtgatcccaaatgcggcgccgcattcacgtagtaattgtggggtcgtaatgtaaaaagaaggctctttcgccatgataaaactcctcagc

SEQ ID NO: 358 - DNA, 10814 bp, Unknown
  Metagenome-assembled genome
tcttgtctccggcgccgctgacggtggccgttccggtctgacttctgtcttcaccggcatcctctttatcatcgcggctttcttggcaccgctgatcagcgttgtaagttactgcggcaccctgcgcgcactggtatggttggcacctgatgatgaacgatgttgtcgacatcaactggaccgacatcaccgaggcattcccgcgttcatgatcattgccggcatcccaatgacctactccatctccaatggtattggctttggcttcatcacctatgtgattgtttccccctgatcgctggcagggccaaggacatcaagcccctgatgtgggtctccgccttgccttcctgatctacttcttgatcgtctaatgtgtgtgataactgatcccatcgatgtgtgcaaagcagcttcctggttatatcgggaagccgctttttttttttggctcttcgctacttatggtaggtgcatatctgcatcccttgagggcgtggactttaaacggcgggattttccccgacaggaggctgcgttcctaaggtggcgataggatgttcaggcagggatgctagcaaggctctttaagaggtcgatgggactcagcgacaatgagagctctgcgacgtctggtttaaggagcgcgagaagcgcaggacgagctccatgtgagggtcgcgcacaggaagggccaggcagtggaatgccccgtatgccacagggtgcggcacctacgacacgcgcgagaggaccttgtggcaatcttacatctggcagtacgagaccatcgtgcactgcgcgctgcccagggccgactgccccaaggacggcgtctgccgcgaggatgcctgaaaggtgcggccgaagacgcacttcacagcgctctttgaggcgcaggtgatcgtgatggcgctctttggcatgaagcgtctccgcgatagcgcatacttgcacgagacagcctacgtgcaatggtgcctgctgggcaaggccgtgaccgaggcgagggatgccgccgactactcgatgtcgtgcgcgtgagcatagacgacaccgccaaggcgcaaccaaagctacatcagcatcatggccaacctcgaccaccagcgtgccatagcccgtcacgcagggcagggacaagctcgcgttagcaggctctgcgccgagcttaagaggcacgggagggaccgggcgaaggtcttagaggtcagcgcgacatgccgaggcatcctcgcttggcgtagctgcagagatgccccaggctgctcagagcgtggacagttccattgtgtgcagctcctgatgagggcgacagaccctgtgagtgccaagcgcgcgagtccgcctcgaagcgccggcagcttgccccgacgaagtacctgtggctgaagaagaaggagtcgctcacaaagcgccagcggaggcacgtgctgccaatggcagaggcgctgcaggacgtctactcatgccccgacaggaatcggcaggcagggccccagaccgcctctgctcgtagatgatgcactctgcgtgccgagataagaacgtggcgagactctcaggaaggagcgggaggggataccacctggtggaagagggatccaccaactccttcctggaagcctcaactccgtgtccagtccgtcccgagcgccgccaggggcttcaggagcattgcctacttcaggacgatgaatcttcctcggctaggccgtctggacttcacagcccagaagaagctggcatacgctacccactagaaacgtcgaagagaccttttttggacttttttgtgcctataaaaagatcatttgcgcaggtaaataccctttttttcttacgtgtactgtgggagagaaggcgcccctcttgaggggaattccatatcgacactttatggagacaaaataattgtctgtcgtctgaaaataataccggtttactgggaaaaagttttactaatagaacttatcagcaggggagaagagataatggtagatacgcagaaagtactcgacacggtaatcatcggcgcaggtccggcaggtttaactgcagggatctatgcgcagcgcgcactgttgtcaaatgtaatcctggagcaggaagctgttggcggacagatcgttttgactgacacggtcgataactatccgggcatcccacacgccaatggctatacgcttgcagattccatgcgcaaacaggcggaggacctaggggccaaaatcgtctctgaacaggctgtttccattaccagggatcctgagacaaacctttttaccacgaaaacagctgagaaaacctatgtctcaaaaattctgattgtagccgggggagccacgccccggaaagcaggttttgagggtgaggatcagttcgcaggccatggtgtatcctactgcgcaacctgtgacgcgatgttttaccgcaacaagccggtctatgtggtcggtggcggcaactcagcggctgaggaagccctgttcctaactaagttcgcctctaaggtcatcatagtcatcagaaaggaccatatgcgcgctcaggcctccgtacagcgtcagcttgaggagaacgacaaggttgagatcagatacctcacgagcgtcgttaaactcgagggtaaccagttggcgactgagatcacgctcaagcacaacgatacacaggatacctatagtgagagttatgaggaaggtggattcggcgtcttcgtctttgtcggtagagtaccagcgaccaacctgatcaaggatatggtcgatgtggatgaccacggctacgtgaagagcgatgagacgatgagcacgaagacaccgggactgtttgtcgccggagacatccgtcagaagatgctgcgtcagattgtaactgcaaccgcagacggcgccatcgctgcaacatcagcggccgcatacttgggacagcacattgcgtcataaagaactatatatagatagttgtgggagggactgaattaaccggtctcccccgccgtttttatagatgtacgataatatatgttatgtaaagtaagacgttatgagcgatactgagccctctccttctgcttacctatttagacttgtcagaggggctctcagagcctgagtcaggtgatacagcatcagttgtaacaaaggcttgcggccgacagagatcagtgagctcctgttcggcgcttgccagattggaacggttaatcaacacggtgatcgtgtccgtcggttccagaaccgtgccgccctgtggagcgatcttggcaccggcgcgctcaaccaaaatcacgtgcgtgttgttcggccatggaatatctctgatagccttaccggcggctaggctgttcagtgtcacgttgtaggtacgcattgatacgccgtgcagcttcttcagctctgcatctcctggcaaggttcccaaaaggttctttaagaggtgctcgtagaacggatccacatcgagcaggttggcagtcacgaaggccaacatggagacgatgctgacggacaagagcgtatccaagctgccggtcagctcaaagacgaggacaattgcggtaaccggagcccgcaccacacccgcaaacaggcctgcgatacccaggtagatgaagttcatcatatacatctcagagaccccgaagaagcctaaaatgcgacagaacagggctcctgagagcgaacccataacaacaagtgggaacagcgtgccgcccggggcgcctgaggcaaaggaaatcgtcgtaaagaggtacttccccaccagcaggaaaataattgtaccgattgacaaggcataaggattctggaggcgctcgatgattgcatcgccgccgcacatgaggtccggcgcagtaaacgcgataataccggccagtgcgaatgggatcgcgattctggtatacggcacatagctgtggatcttaccgtagagtttctggcacccgaacatccccttgttgtgcagggctcccaagaagccacagtaaatgcccatgagaataacgagaacatagtttggggtgtgcggcagattgttcacgatcagctggaagttgagggttggccgcatacccaagacctgtgaaactaaaaagtctgacaccacggcagatgacatggcggtcataacgagagaagctgaaaagaccttatggatctcctcgaccgcgaagagcacaccggtaagcggcgcatgaaaggctgcggccatacctgcggcggcgccgcaggtcacaaagagactttcgatgtcccgatccttgtggaagagctttgagaccgctttaccggacataccgccgagcataaccgagggaccctcacgccccaaggaaaggccgccgaagcagcacagggtcccctccacgaacttggtccacatgaccttataccagggcatatcgaggcgtccgatcgcttcggcgtcggtctgtggaatgccggagccttgggtatagggctcgtagagcatgagcttaccgacgatgaagaccaaggcagccaacacgacaaaccagaggacgatgaagaagaggttgctctgtgcccacgacgtaatcgcacgcatggcgccttccgcccacgagagcacccgacggtacaggacaaccgcggctcccccggtcagaccgaccagggcgccttcaaaaacgagctttgcctgtgcgctgcgagaaaatcgctcagttaagggctgctgcttcatgctcataccacttcaatatcttgtatcgagttggatgttttttggatctctatagagcatacgcctctaggcgtcaggatttaatgctgtcgatcaggtctagtctaccttgaccaaggtgtagacctctttgttgccgcaggccttcgcgatagtctcacgtggatggagatacgtaagctcgagcatgaaggagaagccctcgacgcgtgcgccggattgcttgacgagctcagaggttgctactgcggtgccgccggttgccactaggtcatcgacgatcaggacgcggtcgtccttgttgagcgcgtccttgtggatctgcagctcatcggtgccgtactcgagtgcataggtctgagagtagacctcacgcggaagcttgcctggcttacgagccggcacaaagcctgcgcccaggcgatatgcgaccggagctccgaccaagaagccacgtgcctcagcgccgacgaccttggtgatacccttgctgataaagtggtcagtcatatcatcaatggcggcagacataccctgcgcatcagcaaagagcggcgtgatgtccttgaagatgactcctcgctccgggtagtcggggatgcttacgatcagcttctcataatcgatcttggacacagtggatcctttcttcttggttaggacttgctctcatgagacatgggttttccggcatcgtccacatccatatccttaaacgcagcttgaagcatacgtcttatcaacgtatcacgaatcgtatctgtgagcgccaacatctcattaacagcatcagcaaactcccgctgctgtgaggcggaaggctcgttgcccttcttcgcgtagagcgtgcctaaagactgctcgaacatgccttcctcacggttggcggcaaacgcgtacatacgcagattgcgcgggccgatgccatagtgacgcaggcgtgacgcacatctgattattttaaaatctttcccgtctaccaggtcacggccatggggggattttttcaaaacaataataccggcgtcagcgagctgcctcacaaaacttacaggggcgcccgttaactccggcatcttatcgatcgggtgtaatttattaattgtctcctgatcatcttgggggatcgcaacctgcgtggctcccggctccgcaaagcttcgctcggggctcacgctctcccctctgtcctgccgctccagctcctcttttatcacactcaagggtaaaaagcgcgtcttctgtagatagaggatcgtctcaagccgcttgacatcccgcggtgagtagagacggtatccgcccggtgtacgggcaggattcaggagtccttcgtcctcaaggtaacgtacctttgagaccgagagatcggggtaccgattttgtaggcgtttcactaccttgccgatagtaagatatcctgcatcggtcatacagtgcttacgctccggtctcgatacgggaagtaatccggttcgtatggaagacgaggcgaaaggtaccgatctgtaccgtggacccatccttcaagaaggttttgttgatgattgcgccgtcaacccaggtgccgttgagtgagcccaggtcagtgatgatcacgacgtcagatttgagagcggtcaagtcgatcactgcatgatggcgcgagacggtcatatcgttcaaacagatgtcatttgagggatcacgccccagcgtgatcttgtccttatcaagctcaaatgtctcccctgtctgagggcctttgactatggttaaggaagggttggtgtacggagatccgcccatcaagtccggaatggtggcgtcattgtctggcatacggaagatttgagtctgatcgggggcctcgttattgttgtgaggttgttgcatacctgtcccttcaaagcaatttcgtattatccctattctaacgctaacgacacgcaatgcaggcaatctcaacgcgcgcatttagaggaagtttttgcacctccaccaccgagcgcgccggcgcgggtctgccaaagcgcttcgcatagactctgtccattgcctcaaaatcattcagatcggtgaggtataccgtggtctgggccacatcggtgagagtcaaatcaattgtggaaaggatgttggcagtgatatcgagctcccgctcaacctgctgcgccacatcgtcggacacgagcttcttgttgtcgtgctcttcgactgggagctgccctgagacgaagataaagcgaccagcggtcgttccctgggaggaggatccgagggcttccgggacatgccgggcattgacagcatatttcatagggagatcactttctcttgggcatctattcttggacggtcagggcacgggctccgatgtagtcgtgctcgtgacgcaacaatccctgacgcatcagatcgtgtttggaggcctcatggggctttgcctcgctgagcggcgccagatactccaggttctccgcggcaacctgtgcggcagcagtgagacccaccggcgtcagggtattgaaggagagcagtgagcggaacatcacgggtgccgactgtgggggtaccaatagtatcagactcggctgatcgttgatgcgcatgttgataatgagggccgggatgtggttatcgagcaaggcgtcgtgtacctggttcgtctccggtacggcagaaccgtcctttagatagtctgagaggatctctgaggccgcctcaccccacaagaggagcggcgtcaggctctgactcacctcttccatctcaagcccctgatagggcgcgaagccgttctgattgatgtttgcaacaaagttgagccaagccgcgagaatatccccggaagcgctgatatcccacagcacgtactcctgatccccggtgcgagcaacgagcgggattgaggcgatcctgctgtcccccagaagaaccggctcaaaggcgcactccccgactccgagcttctgacctgcgcaggtcgcttcgataaagctctgagcgaccggtccggagagacgctcggaatagcacccagacaggtcggtgagtccagtcccgtgtctcagcgcggtgtattcctcaccctgattcttgtaggcaagggccactttggtgccctcttccacaaaactgccgagtgtcgcgcccagtgccagctcttcataagccaacacagagaggttgtcggacatctctgtgttcttagtatctccactcatggacaatattcctttcgatagggaaacagatggggataccggtatcagcagcggttttggggtgcgggttggtcgtaataaagagtatctcggcagcctgccggtccccttgcttccactgtgttgtttgatataagctccccggcaccgcgatcgagacatcgaccgcatgggatttttcggatgtgatatccccgtggttgggccatacatagcctgatgccggagcaacagctacaacatcttgtatccaacctacaatatttgcatcacgaaccgtggcaatacggacgccggggacgatgaaggttcgctggtgatcggtactataggtccaatcgatcagagttttagtgtcattgaagcggccttggcgggtcttgcagcccatcacgcaggtatagatacgggtagagccccgctgacaggcccccaagaatgttgtctcatcttctaccgcgccggttttgataccaagcataccggggacgctatttaagagcgtatcgcttgaccttaacgtcctggtttgttttgtctttttgtgcccgcgtgtggtggtcaccgtgacttttacggaggcctgtttcacagtctgcgctatcagcggatagtttgtgagcgcgtagcgtcccatcgtcaccagatcgcgagcagaggaatagtggttgtcctctttgagcccagtgggattgacgaagtgggtgttgtccattcccagctcctgggccttctggttcattgcgtcggcaaaggcatcccgggagccataggtggccagcgcgagctcttcggcggcatcgtttgcggaatagacgagcattgcggagaagagctctctgagggttggggtatccccctcctggtatcccgcaatcgaagctccactctccaacgtgatcttttggcaggtgaatgtagaatccatgtcgggattcgtgtcgagcaccaccatcgcggtcatgaccttcgtaatggaggcggaagccagatgatcgtcctcattggtcccccagatctcctgtccttctgaatcgacgatgatcgcagagcgggcctcactcaggctcggggcatccttcgtctctgccgcctgcgcctgagtgccacccgggagtgcgagcagggcacacacgaggcaggcgatgagacagataagtaaacgtgatttgtggatcaccgatcccccccagcacgagacgagtggaatagggcacctgtggttgtagatagtattggcgcgacaggtgcagagatgctgcctactgattcttctggtccttcttttcggctaatacctcattgcggataccgataccgatcttggtataggagatcgcggtgatcgtcgagaagatgatgccgatatagacgcagtagatccccggcgccatcggagtgctgttcaagccgggaagccaggagactgttacccagcccaagcccgggaggaccgggaagttgaccagcagatcgacaaagccgaacatcagaaaggccgttgcgaccttaccggagaagataacgtcaaccgggcgcttcctgaagcgctgcaaatagatgataccagcagcgaggtaagcatcacggccgataatgaagactgcgatccacacggggatgtcgccggcgatcacaaggccaaggacacccgcaaacaacagtacacggtccatcaccgggtctgcgatcttaccgacccagctcacggtctgggtgcggcgggcaacttgtccgtccagaaagtcggtaacacaggcgattgcatagcagacgagaccgacaatgcggtttccgtgggacgcaaagatatacaggaacacgatggtcaaaataaggcggcacagggtgatcaggtttgcgaccgtgaataccttatcggaaggattgttaggggttccgaccgggtcagtcgtggtacctgcgctctgttttgcaaaggtttccggcgcaaggtgcgcttttgctttttcagctagtgtaagtttcttctttgacacttgatccgccctcttagagtttccagatttataagtatcccttccatactaacgaatggcccgatttttataagaaattatgcaaaactcttcaagattatttctaacagtagatgggcggtagcgggtagcgcataaacggtaaggtgtaaccttcaccgaagagtctcttgatccgccggtgcagcttatatggcgctccaggggacacctatctaatcattcgctctatcggattctgggctcgatgccctgcgatgccctgagctattcctgccgctccgcttggctctggcggttttttgagccattcaagcaactcatggtcctgatacgctacgatgcttttgccttcgtcgccttcccagtcataagaagccttacccggtctccaagccatgcaggttggcattgactttccttgcgaggacaggtcctcttcggtcgtgttggctaaatcttggcagaggtacttagatagggcgtcgaagaatatccaaaccgcctggatcgacgcctgcaatgggttcgacgagcggcatcagctgaggtgttggtggctatagccactccgtcgccgacgctttcctcaacctcagcaaagatcgtcctctttgcggctagatcctctatggcaggctcaagaacaaagtcgacaccttgaaacgctgtgagattgtccctcgaaggggtaatgcgggctaagataccccttttgggctcacggagcatactgttggcctcaaaggtctccagatcgtgtgtgagcgctttcacaccaaggtctaggcccagcttgggtccttcccagaaggtgcacctcatagccacacagagcaaactacagggcggttgcatgtcccatcgttcccgcgcctattacctatacattttc

SEQ ID NO: 359 - DNA, 5938 bp, Unknown
  Metagenome-assembled genome
acgtcgaaagctagaaggaatgttgccactaccacacacttagcctacgagagggactgcatagccacgctgcatgcacagggaaggccaatcggctatatcgcggcagagatcggcagggacagctccagcgtcgccacaagctcagaggaacgcacggcacggacctttagggcatgtgctgcccaaaagaggcggatgagcgccgcaggagatgcagggcgaaaaggcggctttcagaccctgcgcttacgcagaaggtgcgcttactcatcatggacagacactggtcccagtgagatagacgacatctcaggctcgagggtggggcaggtgcgtcgttgagcctgccgactattctaccgtgaggtccatacaggcgccctcggcctgccggaagccgcccgaggccaggtgcggcgccgcctgcgcaggaaggggagcgatcccagcaagaggcctagacgagggcaagatcgagatcttacacccgtggaggagaggcccaagcaggccgatgagaggtccgctcgagagtgggtagacgacacgctcgtggcagcgggacccgtgtgcctgctcgtgcttgccgacagggcattgagctgcttgctgcggaagagccagcacgacagcgggagcgtctctaaggccgaggtcgggctgctacagggacgttcccttaagacgctcactcctaagtggggcaagcagctcgcaggcatacagatgtcacagatgccctttgaggcgtgcagttctacttctgcgacccccaccatctatggcagaagctaacagttaagacacccacgggctcctgcgcaagttcttccctaagggcagcgacttcggcaaggtcacaaacgaggaggtccagcatacagtggagctgatctgtgacaagcgaggaaggtcctgaaatacaggacagccaacgaggtctttagggagatgttgcactcagcttgacaatctgccgacagaaatattgacacaggtcactccataaagtcacagaagagcgcccataaaagcaacaaggcgctcaagaacctcctcatattcagctgcaactccctcgtggggacgaagaagcgcttcaggaggtactacgatgcctgcgttgcaaggggcatgagacacaacaaggcgctcaaggcactcgcacgcaagaggctccgcgtaatccatacaatgatgcgcgatggggtgccatatgtggagccgccggcaggcgatgtagaaaagtcacctgctatggcttgacaggactatagggacaccctccccgcacaatgcggccagacgaggcaagcgtctcctcgagcatctcccggttctcgagaagctttatagtcaccgacatggtaggtcctttcagaacggcggctttccctgaagtacgtctgccacatcccgctgaagcatcatcccaaggtatgagaagggatccaaaaccaacgcttcggacctcatcgctcaccctgccctagcgctatatgtcgagctcgctgacttccttcggatactcgcgaagctcatccgactcatggagcgggttccatacctgcgcgaagaagggatcgcgcttggcccgctcgccgtagttccagctcttcctctcgcactcggggcaccagtggccgccctcgagcacaaggcgcggcgatgcctcgaactcatggccgaaggcgcagcggaagcggagcttgcctgtccagtcacccttcttcatgctcgtggagaggagctcgccaccacggaacttggcggccttctgcatgtcctcgagcgaaagctcgctctcggacttggactcgtcgtagccgtgatcgatgcgcacggccgtatcccagtccgtgaatggctccatctcgctcactttggaaggcagcacctcccaggccttcttcgagccccagtaggcgtcgatgcggtcctccatgttggcctggatgaagtgacgtgttccgtggcccgcatcgagaagcttgtcgaaggtcgacttgttgatgatcttgcccatgagagcctcgccacccggaacccggcagaggaagcgcgagaagccaatggtagcagggtccatggcctcgaggtactcgtcgtagaaatactgcatcgagtcatgctgaaagtggaggtagccctcgagcttgttcgaatcgaggtagtactggccgtgaaagttcctcgtcgccgtatagcgcggatcgatcacgtgatcgaggctcttgaatccgagcgctccatagagcgtgcgatacatgtcgattgtcgaagtgcgacaggaggggccgccgccaatgttatagatgtggccccaaaacgaggagtcgagcgttcctgttgcctcgtagtctgcaaggtgtgccatcgcgcatcccgaatcgcggtcggagacatactcgagcacgttgtagaggcagttatggaactggatcgcatcgcggatacgcaccatcgcaggccccatgatgccggtttggcgcaggcttgcccagcgcgtaaggccggactcgatcacaagacgctctgctgcgaccttggatactgcgtagtagtcgaatatcgacggcttgatcggatctcccacacgtccccagtggatcggcggcatgcggtctccggtctccgcgaccgtgccgatgtagacaaaggcacagctcttctcttcaccgagctcgtagatgcactcgatgaggttcttcgtgccgccgtagttcacctgcatcgcgcgcttcggatagtagtcggccgaaggagagacgaaggccgcgatgtggatcacgaggtcggtgtcggagaggcagcgcttcagggcttccttgtcatcgaggtcgccccagacgatctcgaggccgtctttgcccttgaagggtgccatctccttgcggttcttctccgagttgcgcacgagtaacacgaggtcgtatgccttgcctacattgggcatcatctgcttcaaggactccatgcccatgccgcccgaggcaccggtcatgaagacacgaagattctttgccatcctactctcccttcatcgaaatcgtcttagccttgccttctgccactgccatggagagcttcacggagtcgccgatggcggcgttgatatcgtcgtccgtgactcccaggggcacagaccccagattcctgtcaatgaagagattcgtgcactggatgtcggcaaagcggaccatatcgaggccaccatcgataccgcgcttcttctgatcgcggcggatggtccagccaccgattgcatacatccacttcgggatcgtcttgatcggcttgccggcgcaacccatgtacttctggacgatatcgagcatgtccttccacgtcatgttccaccagccgatagggtagcagtttccgccatgattgtgctcgacggcaccggcaagcgcctgccccacctggcgcactgtcaccatggccgtgccgcccttcgtccagagcgttttgttcttcaacttggcaatggtttcgacgagaaagacccacacggggcgcctgcctggctgcgtgccgaagatatagggaagctcgagcaccgcgacatcgaagtggccatctgcgaagctcatggcagcctcctcctgctcgatgcggctcctgatgtaggggtgccacttcgtaagctccatgtcagggtgcgtctttgcaagataggcaaagtagctgccgcaaatcacgacatgcttcacaccacaccccttcgcaagcggaagaagccgcttgatcggatcgatgttgaacttcttgtacaggtcgtagatcggtgccggtccctcgacgcgctcgtcgacacctgccgcgaagaggaaagcatcgcagccacgaaagtgttctcgcagctcatcgtcagacatttcgaggtagttgccgaactcgatcttcatctccggaggaagcggggccccttccggcagtggtggcagcgccagcgttgccacctcatggccgcgagctatgagctcgcgcgccgcctcgcttcccagaagccccgtgccaccgattatgaacaccttcatggaggtcctctcaccatctgtcctacactctgatttgaggaaatgatagcggcgagagaggccctctgtcttatattcctgtcctcaatctttcatatctgtcatatcgtgcccgcaagatagagaatcactacaacgaaagaggtctaccatagagagcagcagtgcaaagagaaagggactacatggatatcaagatcaagcgcccctatgaggcagcaacacccgacgatggctaccgcatgctcgtggacaggctctggccacgcggcatcaagaaggagaatctcactatggacgagtgggcaaagtgccttgccccttcgaccgaagcgaggaaggctttcggccacaaaccggagaactttgacacgttccggcagcaatacctcgcagagctcgatgcctctgcagatgctcaggcagaagcagaaaagctcaaggaactcgcacccgagactgtgacgctactcgtcggtgccaaggacccaaccttgagccaaggaccgatcctcaaagagtggctcgagcagaagcttgcctgatcagattcccaagacctcgatagcctccgccaggaaagcggcagcgccctttcctgcccccgaggcgtagtactcctgagagcgcggatctaccacatacatctggcccaggctcacatgcatcttgtgtgtgagcctgcggtccctgccccggtgtgcctgtacccaagcagtatgggtgcgcatgagttttgtcacctcgctgctctggggattgcccgtcttcagagcgagcttgagctggtcgttgattcgatcttcaagcacgcgcaagttgttccactcaccctcgtccatgctcagcaggacatcattggcagcattcacgacggcatcgtcgtatttcgccttcaccttagccccgtagcaccattcgttctcttctatcgttgcttccttgaggctcgagaacctctcttatcctatcctcccttcctttcttcaacgccccaaacgtgcgctcggcacacttacgccgcctcatgctggtgcctgttcgcgcgctcttcgaacatcgctatctgttcctcaagcgcttcctttccatccataccattctcgtcgaggagctgctcccatgcgcacaagcgctcccgcagccctccaagcaggatctcctgcaggcgctcggcatcctccatccgtatagatgcggtagccatgtctctgctcgctcgggcatgagaagccaccactcatcggaagagcctaagggtagcacgctcacgccagcaagcgtgctcatctcctagggaacgatgatcaatgccccaattgttaactgtcagaggggaccgaccacacgacttttcgcggccggtatgtgggaaggcaaggcaggaatgctcatcagcacgtgcagaagccgccatcccttacatccgtcctgccccatgcaccgcaagaaggctccaagacagtcaagcgacctttttttgggttctggggccgggaggtgcagcctgccgtgcgaaatacacatggcaaggttttgcaaggacgaggcagacatcgagtgtgcaggccatcttctctatcctcctggtagcgcttccttaaggggccgaagcgccgcttcacgataaagacagggtgcttcgccctttgagcgacggatgccttccggcattcgatgcctttctcggacaagagtgcaaggcagtccgctctctagtcgaaggctttcttgcaccagcttttagcgcatgattaagaggtgtgggtctttatgcttcctaagggcgcttcctataccggtaataaccggagtctgcatagcagacctgtcatcttttcccttacgagtgcatgttgccacagtatatgtcagacacattctaagtgctt

SEQ ID NO: 360 - DNA, 4669 bp, Unknown
  Metagenome-assembled genome
ccctgcccgcgaggtgctcctataccttaagggagtaggcttcaggtgcgcctttaccttctgcgcaaagatgtgtgacttttccaggttctgttcggggaggagggtcacatcctggctggggctctccccgtcgcagtcgtcaagcgccgcctcccacaggatggcaggcatatcgaagcggccccaggctgctgagggcgctccttatgggatgtgcctgggcgtgcgcaagggcaaggcctactttttcgaagagctgccctgcgtcggtggatctacacatcagggagcgtgcacggctgctctcggaggaggcagttgctcgagagggacgtcttaccctgcaaggctaatgccgccacggcagccgagctgggaaagttcatgctcttcatcggccagcaggtacagaagcgggcctcaacccaggctgcatagcgccacgccgccatccatccgctcccttcgttgccttatactgccaatctccacgaaagccctgaatgccgctgtgtgcgtgagactcaaggcggcagggacgcccgcatgtctcatatacaggatgcgtccgcagcggaattcgtcgaatatccttcatccctgcagttcaggaagccttgtaggcgcctgtttcgcgactgcattgccacttgacaggggtttgggacatatgaggaccatgaacacgaaacgcatcacgataatcaccgcatcacgggcgggcagcctcccggtctggctcaaaacttgtaccacaaccatcgcttcctttcggaagaactgttgtcgctcgttctacaaattcaattgtgcttcaggctccagctcgcactcgccgactgcagcgcgcacatccgggcgaatataccgtccttgcgtgcacgcaggtcacgcggagaaccttcctctaccaccctgccccgggacaacaccaccaccttgtcggcgttttcgacggtccgcatgcgatgcgcgatgaccagcacggtcttgcccgccagcaggcgggacagcgcatcctgcacctgggtctcgttttcggcatccaagctcgcagtcgcttcatcgagcacgatgatgggcgcgttctttagcagggcgcgggcgatggagatgcgctggcgctccccgcccgacagccgcgccccattttcgccgataggcgtgccgtatccctggggcaggttctgcacaaactcgtcgcagtcggctgcagctgcagccgcaagcgtctccgcatccgtggcaccatgccttcccaggcggatgttctctatgaccgtgtcatcaaacagcgtgacgtcctggaacaccatcgagtaatcgcccagcagcacctcgggatcggccgtggagatatccacgcctcccaccgtgatggtcccctccgatgtttccagcaagcgcgcggccaagcgggcgcaggtgctcttgccggaacccgaaggcccgacaagtgctgtcacctcgccctcccgagccgtgaagcttacatcgtgcagcatctgctcgtcgtcgtaggaaaagcccacgtccttgaatgcgatgtcatgaccctgagggtcgaacgtgctcgtgcccgtcgccgtgggggtatcgtagatttccgtgagcctgcgggcagaaacctcggagtagaagacctcgccgatgagtgcgagtgcttagtcgaagggcgcatagatgcgggtgaccaccagcaggaacaggaacagcatcatgaagccgacctggccggagacgatcaggtatgccccggtcagaagcgtggtggccacgcccaagcgcatgaccacgctcgccccgttcatgaaaagccccgctgccagctcgcctttgaccatagcccgttcatgcgcatcgatcttgtcgtccaaggcagcaaggacgcgctgctcctggttggtcgaacgaatctcgcgcacgttctccaatgcttcctggatgccgtcggacacttccagagccgcggcccgcgtacgggcggaattgcgctcgatcagcctgcgccccgcaaacaggagcgcaaaggcaaccggcactccccacaggcaggcgatcgccaggcgccagtccatgacaagcagcacgaccgcaatgatgaccgtcgagatgatggcgccgtacagatagcccagcacatgcgaccacacatgctccatccgattcacgtcgcccatgatcgtctcggtcaaatcggccaagtcccgccggctgaagaagctcagcggcagcttgcgcaactgctcggccaagccgatgcgcacgttcttcacctcgtcgtagaccagaccgtatgtcgcccgatactgctgggaatgcaccgcaaacgatgcgacgaggaacacgatcgtgcagagggtgagcacgagcaccccgagcggaggcaaccccgccgccagcgtgtccatcagctggcccatgaccagatagaggatgcccacgccgcccatgactaccaggttcaccaccacggtccacagcgttcccttcttgaccatggccacgcctttgtcggaaagcgcgaacttgcgctggaaggcgctatcgaacagcattcgattcctccgcttcatcagttgagatctgccatttcgcagcccggttgtagtcgcaccacatccgagcatacaagccgtctgcagcaaccagctcatcgtgcgttccctcttcggcaacgacgccggaatcgagcacgatgatcttatcggcaccgaccaccgtcgacagccgatgggcgatcatgatcacggtgcgatcggccatgagcgtagagaacgccttctgtatgagcacctcgttctcagggtcggcaaacgccgtcgcctcatcgagcaccacgatgggcgcatccttcagcaacgcccgcgacaaggcgatgcgctgctgctcgcccccagaaaggtaggtgcccttcgacccgatttccgtatccacgccctgcggaaggcgggcgatgatgtcatcgcactgggcagcggaaagcgccgccaccagctcttcgcgcgtagcatcggggcgggcggcacgcacgttctccaaaatcgttgtcttgaacagacggttttcctgaaatacgaaggcaatctgatccatgagcacgtgggggtctaccttgcgcacgtcgactccccctacttccaccacgccgtccgtcgcgtcccagaaacgcggaatcaaacttgccgccgtggtcttcccgctgccgctggggccgaccagggccaccgtctgtccgggctcgactgcaaacgaaacatggcgaagcgccggcgtcgtggcgccctcgtaggtaaagctcacatccttgaacgcaacccggttcccctgcggcgtttcgggatggggatcgacggcaagcgtcggcgcctccatgatcgggcggatgagatccagcgccgtatcggcaagcatcatgccgccagcagcaaacatgatccgcgctagcgccgtcgagataaccgccgagaacaccgcatagaaggcgaggttggccatgaagaccgcgaagtttccggcagaaagcgctgccggcgcaagaatcaacgcgacgggaaccagaaaggcgaacgcactttcggcgaatgtcaggttgagggattgcggcgcgcggcagacttccccttcgtaacggctcgcctttgcgctgtaatcgtcgatggcctccttgaaggcccggaacgaatagaccgtttgctggaacaccttcaccacgggaatgccgcggacatattccgtacctgccttgctcatgcggtcctgcgcagcttgatatgccgccatgagctcggcgttcttaccgcccatcatcgagcccatcgccgctatggatatcacgacggcaaccaggcacgcagcgcccatgcgccaatcgaacacaaacatgaacacgagcagggcgatcgacatcgtcgcagcgcccacgacatcggccagattgtgtgcaagcagcgtttcggtatcggcagcagccccgtccagacgatttcgaataagacccgtcgcattggtgtcgaagtagccgagtggagcgttcatcaaacgggccatgccctgtttgcggatatttgaggcagtgcgaaacgccgccaggtgcgtacacatgagcgcaacgaaatagacgaggattcccactgccgcgaagaataaggccgcccatccataaacagcaatgccgcttgcccttccccaatcgggggcaacggcaacaaggtcgcgcaccgcaagccagatacgccagatacatatataaggcaccatgctcaaaaccatggcgaccgcagaaagcgcaagccccacgaaggtcaaacctccacgtttgcctgcgaaacgaagcagcgtatgcagatccccctgtttcttatcccccatgcacatcctccataagttttgcttggatagaagagtattctatagctaactttttaaaaatccagtagttctgtagatttttcttgcttcgctgcactgaaggaatctacctggtggggagaaatgatgattggagcggcatcggcacagcaagcgcgctcacacaggctaaattggctaagcttattcgacatgaaggggcgcttgctaccgaaagcccatatccgatggtgtccctatcctagcccccatccctcccgtctagggaaacgatgattaatgccccataacgtgt

SEQ ID NO: 361 - DNA, 29878 bp, Unknown
  Metagenome-assembled genome
ttgtatagccctgaggttcctgtctcgtgtcgtctcgaaggtcgatagaataggggaatagactccttgttgaacctgttgttaggatgtctgtacctttttgttcatgcaagccggacccctctcgtgcttttctgcatgtcagcggtgtttaccccgaaggtccctcaatcgttgcgggactgcggcaaagtggagaaagctaaccataccatcaattttccgaaaaagggcgggcggagaggaaagcaggccatgatgtcttgacagatgggcggttctgtagctgggagctgctacgatgctgtctggagcctctgaaaggggaaccttgggggactccaggctgcttgcactccagtattatggatggcacgtcttgaatctgccaagaccggaagctgatctggaggcacttggtcttgtctgcgcagaggatgaacttggcgctctgcgagaggaaagaccgtcatgtcgctactgtcctctcggcgatacgacgggccatcgctacggcgttttgtgtcgggtgcctgaacctatgacgtcgaggacgacaggagacgttcgataccattccttgatgctttggctcgccaagctcgagattgtgaagctgtcaaaagcagagcaggtgactggtggttgctcattctatccggactgctgcatctgtagagccgaaggatgcggacacatggacctcttcatatgagtgtctatcagagcatctaccacttgagggacgatctcataatgatgtagctgccgttttgagacacgatgtgtagaggtggcaatgtcaaagcgacaaggaagacactaacagcccacagttccgatgcaaggtggcgcttgaggctgcaaagagcaggagacactctctccgtagcgggcgaagcaacggcgagacctgtcgactggcggccaagctaaaagataagctgctggcgggcgccgacgacatagcggcaaggtcagaacgatgtgcgcaagaaggagcaggcgaaggatagacgatgccctcgtagacatcggacagctttgcgttaagcgcgactcctctcgcagttttgccgacgacaacgcatatagctccaagcggaaggccatagccagccggcgacatcaccagggtccgcagagggtccatggaggtgggcagatcctggttgggcgaggagagaggctccgcatgatcgatgcctaccatcgactgccccgcctttttgtggcaagaagatcatagagtgctgcaaaagcaaggagaggcacatgccacccgctacagggtgtttaaggtgatgagcttgcagcatctgcccatgcttgtacgctgccgtctccgggagccctccctgggctccaaaggttacctctatccttgaaggcaaggcatacctgtccccaaccgtgtgcgtccctccgaccatccgccgatgtccagatgaaggaagcactgtatctaagtcgtctcgacggtttagcgtacatgctgcctggaaggctctttgacaccatgcagagcacaggagatcgctacacgcgccaagcaggctttcagggagcatgggaacaccctttaccatgaacttcgagcaggggagtgcttttggctctaaggagtacgtctttctgctcgcatccaaagggatatcccagagcatggacgaaaggatgagatagaaggacaacgctttggtagagagatggtttcagaccctcaagagcgaatgcctaaaggcagacaaaatacagcacgcctgccagagctcaaggacaccatcgcaaagttcgttgagttctacaacagcaggcggattcaccatacgcttagctgcgacacgccggaagaatggtacatgagcggtatagccgaggctgaataggcctacagaggcggcgctgtaaaagccagggattcgaaaggaatagggcttctgtgtttcactacttcagccaattcacaggctttggtttggcatatctgtcagggacagtggttctcttctgatctgtaaagggggtgagccctttattcttaagctcgcgcatgcattttcctaccctgtagagggtagtgttggaaaactcatcagctagatagcagtgggtgtaaacctagtcccaaaacctctgtcagagtccacccacaagcgcctgatagcctctgtaagctcactgcacccgttttctggtgctcctgcgaaacacccatgaataaaagcttgagcgcaataccttaaggattaaagcccatatcttgatcgggaagttttccttctcctcaagcttctgcttgtaacaatctattgcgcttagatcctttgtaaagaaggcttaacagctgcctttaagaaggcatgttccatctcaagctcttagctgcgcttggcataaggcttttgagcttttcctctttagcctcgctgcgcttaagcacctgatagcctatctctgtgctcttctacccagcggctttagtgttttaggatttaagccctagttcggtggcgaggtgggctatcggcttgccggtggagatagtgtagtcagctgttttcaggcgctactcatcgctgtatttggtagcaagattgtttgttacctgtcgtcctttcggtcggcttgtcttgcagttaagaggagcctcataattcctcaagccgcactgtccgaaaaaatgatacaggtcagccggggaggacagggaggatgagacaaggaagggcgagaccaggaggaaacgggctctaggaaacgccgcgaagagcgctcctccgctgccgcctagattctgaccacaggaatcaacaaaggcttaatttaatctaccggtagaaaatagttttgggaaatgttaaggactcttgacatttcccggtggtgcaggataataagaaatgtaaagagatctttacattaaaagattacttccgcatctttaataggagaaaaactatgaaaaaaatggacgagatggataaaaatattcagttgcgctcggaagagcggggttataaagccgcgttgatagccctgtgcacatggacgttattcaatatgtatcagtcgcttgtaaacggtgcaaaatttgaaatactaccctgcttaattctgtgtttgtcaatgtgtgtccaagggttctcacaacttgcgatgaggcgaaaaatgattgccggcgatgaagaatataaagagccaaataaacttgcacaagcgatcatcgcagccattgtcattatcgttgttattctgtctgtcggcgtttatcttttcttgaaagcgtaatgcctatgagaaacataataaagcggttaagaaaagatgcaggattgcgtcaggaagatatggcaaaagagctaggtgtgagccgacagacgattatcgccatcgagaatgacaaatacaatccctcacttgaacttgcaatgaaaattgcgaaattgctgaatctccatgtagatgaaatcttctttttggatgaatagcaaaaatcacagcatgttgtacaccaggagcaaaaacaaatctctatgttagaccatgattgacctaagtccttgcttcccactcgtcccagaggggccacagcatgtcgacaagtgaattggctgaagtagtgagacacagaagctctattccttcggcggattagcattctgagtgcaacaggatggcccgctgaatgcaagcgtggcacactccggaaggctacgatgttggttatccaagtcaacgtcgaaagctggaaggaatgtgccactacacacatcttagctctcaggagagggactgcatagccgagctgcgtggcacaagggaagctccatcggctatatcgcggcagagatcggcaaggacagctccagcgtctgccgcaagctcaagaggaatggccgccacggacactttagggcatgtactgcccaaaaggagggcggatgagcgccgcaggagatgcagggcgaaaaggcggctttcagaccctgcgcttacgcagaaggtgcgcttactcatcatggacagacactggtccctggaggagatagacgacatctcaggctcgagggtggcggcaggtgcgtcgtgagtctctcgacgatctaccgtgaggtccgtagccgccaccctcgacctgccgggatctggcccgcaaggccaggtgcggcgccacctgcgcaggaaggggaagcaggtccgcaggaagaggcctaagaccaaaggcaagatcgagatcttacataccgtaaaggagaggcccaagaggccgatgcgaggtcttgcctcgaagacttggcagacgacacactcgtggcagccgggcccatgtgtctgctcgtgcttgccgacagggcagtgaggctgcttgccgcggaaagagccaccacgacagcggaagcgtctctaaggccgccttcgggcttttgcagggacgtccccttaagacgctcacttccggataggggcaagcagttcgcagggcatacagatgtcacaaaggccttgggaggcgtgcagttctacttctgcgacccccaccatccctggcagaagctaacagttaagaacaccaacgggctcctgcgcaagttcttcccctaagggcacagacttcagcaaggtcacaaacgaggaggtgcagcatgcggtggagctgatctgtgacaggccaaggaaggtcctgaaatacaggacagccaacgaggtctttagggagatgttgcactcagcttgacaatctgtcttccgaatccctggcttttacagcgccgcctctgtaggcctattcagcctcggctataccgctcatgtaccattcttccggcgtgtcgcagctaagcgtatggtgaatccgcctgctgttgtagaactcaacgaactttgcgatggtgtccttgagctctggcaggcgtgctgtattttgtctgcctttaggcattcgctcttgagggtctgaaaccatctctctaccaaagcgttgtccttccatctcgcccttttgtccatgctctgggatatccctttggatgcgagcagggagacatatgccttagagccaaaagcactcccctgctcgaagttcatggtaaagggtgttcccatgctccctgaaagcctgcttggcgcgtgtagcgatctcctgtgctctgcatggtgtcaaagagccttccagcagacgatgtagcggctaaaccagtcgatgagctagccgtgatcaaggtgcttccttcgatctggacataggcggatgtcgcggaccacacgggttggggacagctgcttgcccttcaagagatagagaacctttggatcccagggagggcttccacggtagacggcagcgtacagcactgtggcagatcctgcaagcttccatcaccttagaacaccctgtagcgggtgcatgtgcctctccttgcttttgcagcatcgtctatagtcttccttgcccataaataggcgggcatgtcgatgtgatggcatcgtcagtgcggacgcctctcgtcctcgcccaaccagatctgcccatcctccatgactcctcgcggacctctggtgatgtcgcccgcctagtgcatccgaactacacgcggtccttcccttggagctaatattgcgttgtccgtcgcaaaactgctagagaagtcgcgctgtacgcaagcttccgattccgctcgaggggcatagcgtctacctgtcgccttctccttgcttgccgcacaccgtttttgccttgccgactatgtcgtcggcccgccagcagctctcttttcagctggcgctcagcgacagctctgccgtgcttcgccgctaccgggagagtgtctcctgctcctttgcgacctcatcgccaccttgcatctgaactgtgggctgttatgtctttccttgcgtctttgacaattgccactcttacaatccgtggttcctcaaaccggcaagccacgtcatgatgatggaacacctaatgactgcgcgtgacaaggcattatgcttttccgccaaaagctattcgagcatacaatcgatttattctaccgtcctgcaagagagcaaaattatgcagcaaaaagacgatactcgtcgggtttgctgcatgtctaaaacactctcttgaagtacatagatctagtaagcagacgcggagaagagcctacttgtgcggcggcatcaatcttactctggggaacgggtattggtctgctggttcgatggtggctggaaaacaaccctttttacaacgcctcgtgctacaattcttgcaccgagtaaagggtcatttacattgacggagtgatgcttttaggataaggggacctatcgcaaaagtctcggatgaaccttccaaagagttttggccgtaatcctggaatgagcctacatgaacatctgtcctatttttgcggcgatgtaagggcatgtcgcatacaaaatccctagggagttgatcgacctactcccgagtttttcggttttactaaagaacacatgcgctgcccctcgcaatcattgtctgggaggtaatgaaaacaacgccttggaattgcaattgggggggggggtctctcattggatctcctcgctcgtgatcctggactagcctactgcaggactcgatcctgttgagataaccgcctactattcctgctggagaagtagttctcaggatgctgtcgtgatcatttcgactccattacccagacgtttgagttgtgtttgtctctgaaatgtcattctcattggaggaactcttaaatataatgggtctccgcattaggttctgaaagctcaagaggacacgtctggcgatagctatctctcgcatgacttggagtagttaaaaccgctttcgaacgcgtatctccgtttcaaatcttttttccgaagaccatggcgaaaggtgcgctttactggcaatccaattggcaaaggggaggctccagtaatctcccacactttgatgatgctacgtttatcaagctacacattgttacgtccactgacgcccataacgagagagcaatttccttaatacatacactcgaatcaatgcttctgcccggaagcttgtgacgactttcattgcgatgctgtctcatgcggctttggcgttcacagcctgcgaggtgctagtttgggctgcttcttgctgtctcttatgtagtgggggggtctcttagtgcagtagttttatccagagattatgcagctaatgaatttcaagagtactgcgtggagcaacactaccaaactgctgcagctgtagtatcccctttgcctgcaaacgtgggcggcggataattttgttgtctgatgtaagaaatcacacctgagtggagattgtccttacttccggatgggctcagccttccttgtatactctaccacaacttactatcactgctgtttcttcttattctgcgtggttttgtttgcacgcggttttgtcgttctggtctgtcagtactcgaagtctccttggagatctgggagctacaatcattttcttgatttttttagcttctctcctgccttgtatatattccgacaatatcagtagcttgcattaggaatagcgctaggagcaacgacaagtcaaagattttctcatctgtctatctcctactattgacttgtcactcatgtggagttcggggattgcttggtagcgtaatgcgacctcctgaagtactcggcacttttcgtgtaacaggcagatctcctcttgaattaattttctttgaaactcctttgtctgaagacctacactgctcctatagagaattcagcgctaccttttggaatctatagtccaagcattatcggcaattcacgtacgcagcagcaatgaacccattctttctactaactgttgcggctgccatgctgataacgtttcggttacatgcgggcaacagtgggctttaatctgccgaacggctgttttcccaagaccggacaaccgcaactgccaaagagagaactgccatcaaattgacttggtttagagcgacaagagcccgtatggtagcttggccctttaatcctttagtctttcgctcgtgccaatgctcttgttattccttcacagatgatcccattcagcgattgctgcttctctaatgtatttcgcttaccccggagctattccacctttttggagttagttgtttgcttaatgacgaaacaactggtcatacgaactgacaatctgcttacactatcgaatatctgcacaagtagacgccttatgattcctcttgttgcggctcttctgtcgctgctccttcaattctctttctggtcgtctccttttcttgcaacagacatgatggttagtcttttttctggagctgtacctgtactgtttatgggcgggattgcttcaactatggcatcgctaacccagaaagctgacattgcgggggtgatagcgtcggttgtatggaccgctctgaatctctctccagtacgcgactttttcatcactctacctggaagggggctatatccattcatggctgcttatcttacacatgaccagctgcctgtacagccgcttttgatagttcttacaggggcattagtcatgatcatcttcagtattattagggttactgataccccctaatgaagggccaatgaggattgctctcgtatcactaatttgcaccaagcccactttgcatagttgggctgcctgaaggtatgcggacggcccgaggcttgactatagtggatggtgcacgatgcctgcaaaatcttcccggcgttctgcggcgcccttacgatgtggtagtcccccagcggcgcgatctaccaaggcgatgggggactaccacatgacatgcaacgacagccatgaggctgtcggctctgccaggggcggtgaggccgaattcttcacctcatagatgccaaaggcctgctcatggtgcggctgtgcgcagtgcatgtgcgacagacatgagcgcaacggggtgcaggcatagcggggccggagaagcgcggggtcgttcacgccagacagaggcacggtcttcgacttaaggtggctgcccaccttagagtgggccatgttcctcccgaaggcactcgggtgcgaggacgaggtggcatgtgtgcgtgaccaccacaggtcgtccgctacttctctatactggacgagctcttctgtgtccttgccggctgccaggacgaagccatgctgtccggatgcacctggatcgacgagacctactggccgctcgacaggcgcagtcttacctgttcgtcgaaaaggcggcgtgggcgacctttgcaccgccggcgtcgatgacgacggcgacgttcacgtccctgtgggtgtcgacgccaacgtagatgaccctttccacctgtccttgttgcatggcaacctccgactgcctacgattgaacgatcgcctccgccatttgcctctcgggcgtgcggatagtcacctccgacgccaacgaggggctcgtggcggccgtaagggaggtgctccccggcgccgcctggcagcgctgccaggcccacttctcgcgcgcatggagaaggcgtaggcagggaacgcggcagcgattttacacacgaattcggacttgatcttcctgttccctcccttctgcgcaacctccttcttgccgaggagggcgctgcccctggagaccaccttgccggcccgtgcatcgcgctccttcctctcccttgtgttcgcacaagacataaggatgtatgtggagtgcttgagggacatgcggcctcggtgtcgccttcctccttaagccttgcctgcttatccttcctgaccttacagatgaccttctcgttaaagttcttcacaaggtggaacctgtcgtagatgaccgagagatgcggatggcgcttaaggaaggcgcgcccgaagtcggcgttcatgtcgcaggcgattgcctccacatgggacatccactcagcgagcacaaagtcacagaaatcatgcacgacctgcctcctcttggaatggacaagccacagggcatgccctgtccttaaggtcgatgatcacggtggcatatctgtgcccgccgtaaagcttgaacgtatctgcgcccagatagcgggcctgccgcttgggcttccggagtctggtctcgccgtcctcgcccttctccgtgtagagcccagaaagccttgcccggtcgatggccttgaccacattcttgtggagccctgccgtgagcgataccgctttgaaggtctgccccagggcaagcaggtcacacacgaacgcgaggagcaacagcatgatgcgctggcctggggccctgaagggcacctcttccgtgagggtgctcccgcactccctgcatgcccatcttggccgcaagacctctatcctcgccctctccatccccaggggaaatgtcgaagcgcaatgggggccttcccgtttttctccatcatccttccgtagcaggggcatgaaggtgcatccttcgctgccagtctgcccgggacagtgaggatctgcaccgccttcctgcatcttttggtcgacgtgccgaactcctccgtgcgtgcgctctccttaggctttcccgtctgcacgaagccttcgagatgcgaggggatctggatgaagccgggagcggcaatctcgtcggcatgggaaatggcggacagctgggctgccggcgatgctacacttgtcatcgcgctccatccttcttcggagtctacatgttgcgatgcaagattctagaggatggtcgcttttctgtctctttgagcatcaagccatgggcatctgcccacagcttttaggattgaacccaaaagatggcttattcgcgtgtgtggggatatatcgcctgtggggtcatatcccacagcgaacagggcagccaatacataagcatctaagcttgtctcccaggcggccgtgcacggcgtgaggcactcctgtaaggtacaccggaagcttccacgacagtgcgcaagcaaaatcgcttctcaaaacactcaagggcaagtggtaccaccacaagcgcttgcatcccaccacaaagcacaagggacatcgggctcaatcgagtcgtaactacaaccgtatttgtccgcacgactccataggtaggtgcgtgtctgcaagaaggccatacaggagctcttcgagcacttcgagagggccccttcatctgatatggcggccacgcaggccgcatagagatctgggacccctctgtcccttatattgatggggccatatccgccagacgatcacggacgacgatctgtgtgccattgcccatgacctcggcgtgacgccgaacgaagattttctcagtcagactttccaaggcttccccatacaagcacagacaattcccctgggcttactgcctgaggggattttcgttatggctgcagcagctggccggcccgatgctttctaagctttctatatcttctgaaatttctatagatactataatttctaaagatgacgaaggaggtcctcatgacaggcaagtcacgttatgtcaatccattcaaaccaaccgcgggtatgacgccgcctgtgctgattggtcgtgattcggtcatcgatgacttcatcgatggaatggatgaagggcctggcgcgcctggcaggctgctgcgcattacgggacctcgtggctccggaaagacggtacttctgacagagctcggaagcattgccagcgataggggctggaccgtcattaacgtctccgggaaagaggatctctgccaatcaattcaagagcagcttgcagccaatgcaagattgaagtctttggatatcaagatttcggtacccttcatctctgcagaagcccacttggggaatgctcagacggaaattggatttcgggagtctttttccagcgtggtacgggccctgacaaagaagggttccggcctgctcattgcgatcgatgaagtgcaggacgcatctccagatgacatggcagtgctggcaacgaatgttcaatacatgatcagggagcagcagaacattgccctgctttttgctggcattacgactggtgttctcaatctgctgaacggggaggggataacatttctgcgccgtgcaagagcagaggagctcggcagcattccggtcgatgaggttgctgccgctatgaaggagaccattgaagcatcgggcctgagaattgccgatgatgccctgtcctatgcggcggagacgacacacgggtatgcatatctgattcagatggtcggctattatgtctggcgtgctggacgaaggcatgtttcctcttcaaatctgatcatgctggatgacgcgaagcgcggctgtgcagaggcactccgtgaatttgggtcttcggttctggggactgcgttggcggggctgacacgtccggcaatggagtatctgtttgcgatgacgaaagatagtgcagcgtctgcaacctcgaccgtggcgggaaggatgggcataccaccgcagaacgcgaatacctatcgcagaatgctgatcgatcgccagataattgaacgtacagctcctggatacgtggccttctctattcctttcatgcgcgactatcttatagagaacaaggatgagatcctttcccgctatggagggtaggtgctggtggagcttgaggcgtttgctttgcggctggctgtttgtgctgtattcgccggcgatctacgtaccatcacccatggcttcggtgtaacaccgaacgagagcttcctcgaccaactcccacaagtctttctatacaagcacggaaagtccctccggatactctgtccgtagggatttttgtcatctccacatcagcctgctgggctgatagtttctacgtttcctatattttctaaaatttctatatcttctataaaaacgatggctgttgatgaggaccaaacagttctgaggctgtactgtctcgaagaatattccactatctgcccgatgctgcaactacctcatggtgccagtcgaggaaggctactacacagatgaggagcagatatccgagggaggttgtataggccgcgaacgtcgaatagagtgctacaagcacgaaggcagcactcaagcctagggcaatggcacagaagccattgaagagaggaaaggtgcctttgtgggcgccgcttcttgatttctccgcatagggccaggcgctaagggcaaggacgataccgaaagcgaggcttgcgtagatatagagcattgggcttcacgattttaagggcgaagatgaggacagtggcagtgagcgccccaatgcgggggctgctccttctccggatcggctccttcggccttgagacgggagacgagctttgctgcaagcacggccacgacggcaaagagtgcaaatgagagtgccatagggattgctatctggtgcaaggcgatgaggaagatgctggtggcgtacagtttctttcgcacttttgaaaaccggatagccgtatagagaaacatggccccgtctcactacgattggaagcgaccaagcaaaccaacggaccaaaggaagcgaaaactatgccacacgagacagtatcattcgacgagccgaagcttcaggactacctcggggagctcgtcagaaaaaccgttcaggactcactgaacacgctgctggataaggaggcaaaccagatcgccaacgcagggcgctgcgagtggcaggcctgctgttccggccactacaggcaaaacctcaccacgacctcggtggacgtgacgctcagcatctagaagctttcaggggtgcgaccttcgcgtcgaaggtcatcgagcactaccgcagacaggagagcttcctcgaggaggcgatgatggagatgtagctggcgggcgtcgctgtgaggaggatacaggaggtctcagagatcctctggggcttaagcgtctcgcccgccaccgtctccaagctgaactgtgagaccttcggtgccgtcgacgagtggcgacgttggcccctcacgggccggtacccctacgtctattgacctgtgtcaatacacatcgtcgctgtaggaaggctgaggatagacgacaggacttgcgcttaggtggcccgcaagatgtctaaggggcactccaagctcgaggcgatacgatgcgtcaagcgatacatagcgcgcgagctgtactacgacatcattgcccagagtcgcatgctcaaaacgacttgacaattagaagggcatcacacctcctgacgctcgtcacctgcacgccgtacggcgtgaacgaccacaggctcctcgtccactgtgagaggatagagtatgtccccgaggaggcggaggcgcagggaagccttgtcaaccgctgctgcgagagtgggcagtgctgattgtccttctcgtccttctcctcgtcttcctcgatgtggtgatccaccgcatccgccagaagcgcgaagcgaagacaactcccaagcacatggaatgacttcctcacccagaggcaaggaagagcgcctcggctcgatgagagtcgggacgcttgctttgaaggcctgtgtgttccttgacgcttatgccagataatggagaccgacccactgccagagcgtgacggggcagccatccacaagcacatttgtgccatcgagttccgtctttacggaatcatggtagacagggatccagacgaaatggccgatgtagcgctgaggctggccatactcgtcgcggtagcggcccgtctcgtcctggatgtggtcgaagcaggtgatatgcacgtctttggcgccgagcttccctagcctcttgtagtctgcgagggcatggtcctttgcggttacgatcgggtcgtcggtggactgtacgaaccagagcggggtcttggcaatggccttcatctcgtcgtctgtggcaagagatgcaacccatggtgcacagacgggaacgcctgcagcaaagaatcccggatagtctgccacaagccttattgtcatgaatccaccattggagagcccgcccacatagatgcgccgcttatcgatgtcgggatgtgcccctatgaactcgtcgatcaaggtcttcagtgccttcgtgtagatggacttgttgtcgtctgcgatctcgcccgcgcctgagtccatccagtaggttgggctcgaaggagcgaggatataggcagcgccgccgagcttctcctgaatctcaggcgaggagaggagcgtcacacggttgcccatgacggtacggtagggctcctgtccctctcctgcaccgtggagccagacgaggagtggcacggacgtgaccggcggcagcggattgaacggatgcgctgcgcgtgcggcattgatggcatcgaggtcgggcgtgaagaagctatagttcatatcgatatcatcgaagatgccagagccggtaaggtcccagcctgagagatcgggacagacatcgcctgtatcgacgtcgaataccatgccggaaagcggtgtctcccctggcacttctgccgggatggccttcgtctgcatgatgcggaagtccatcacacggatgtagccgcgggtgagcgctccgtcaatcctcttcgtgaggcgctcttcagggacctcgagcgcgatataggagccctgctcctgagggttgccttcgccgtcggaggcgtaggcagaaagcaccgggacatagcccttcgaagggaaggcctgtttgtccgtgtgatgctccttggcaagcacgacttcgcctgtctctgcgtccttgcgctctacgtagacgctgaagctgtccttgtctacgaattccgtgcgcaccttctcggggagctcgaggatgagcttcgagacatagggccccatgtcggcggccgaagtgaaggtcttgtatccagccatgcatatcccctttctcgtgcagcagggccagcatctgctggccctgccaagtctgtccgttggttgttctacccacttatctcagtcgtggcagcgaacctgccgaagggcagcctgccagcctgagcgcttactctggcggatgtcttctgccatcttgggtgcataggtctcatgcccatagcgctcatgtatgacattcgtcgtccagaggccggcacctctgcctgctgcaaaggcggctcctgcagcagagagctcggcaagcttcgagacctcgactgatgtctctgccatgtctgcctggaactgcatgaggtaggcattcttcgtgacgccgccgtcagctctcaaggtctccaaggcaaggccggtatcggcgcggagcgcatcgagcacatctgcaatctggtaggggatgcactcggcgcaggcctttgcaatctctgccctgccggtgagcgtcgtgacgcctgtgagcatgcctgtggcagcgctgtcccaccagggggcaccgaggcccgtgaaggcaggcacaaagtagcacctgtcgttcgggttggcttccgagatgagcttctcgagctcgctcgggctctcgatcaaatgtacccggtccttgagccaggtgatgacagcgcccgtgtagttgaggttcccctcgagcacataggagagcttgccttcgaggttccaggcaatgctcgagacgagaccatgcgtgctccggatcggggcatctcctgccatgagcatgacagaggagcccgtgccgtaggttgccttggcctgtccgggcttgaggcagtcctgcgctgcaagcgcagcctgggagtctccaagcatcgcatggagcggtacaggagcagaaagagctccgttgaagtcagagatgccgaagagggcatcggacggcaggacctctggcagtgccatgcgagggatgccgaagagctcaaggagctcatcgtcccactcagcagtcttcaagttcaggagctgggtcctgcaggcattcgaaggctccgtcacgaagggatggccttcgcagaggctgaaggcaagccaggagtcgatcgtgccaaagcagagcgtgcctgcctgggcagcctcttgaactgcgggaatgttcttgagcatccaggacatcttggtagcagagaagtagggagaaagagccaggccagaatgctcctggacgagcccctctgcgccaggatgtgctgccttgagctcgtcgcagagcacagcagcacgtccacactgccagacgatagcatgggccagaggcttgccggtcgtcctgttccaggcaaggcaggtctcgcgctggttcgagatgccaaaggcggcgatatcttccgcacgggcaccggactttcgcatcagagcttcgacgcagcagcagacgtttccaaggatctcttcagcatcatgctcgacccagccctgctcattcacatgctgcgtgtggggcagggaggtctttgccagcagggagccatcctcctcgaagaggagcgcctttgtgccctgcgtggactggtctattgcgagggcgatctttcccatcgttacttggctgcctttccgagaagcttctcagcggaggaggcgatgccttctgcatcgaggccgtagtagccgaagacctccttagaggtgccggtgacgaccggggcatcaggaagcgagaggttctcgacaagacgggggcaggaagaggcgaccgtctgggcaacacgggcaccaagtccgccatacggcgagtgctcttcgatggtaagcactgccttggcattctgtgcagcctttacgacagcctcttcgtcgagcggctttacgcagtacatatcaagaacggtggcagagatgtccttggcctcaagcagtgttgcggcatcgagtgccgggcgcacgagctcgcctgtggcgacaatcgcgatatcggtgccggtcttcagccaggttgccttgtccatctcgaaggggcagaagttttccgtgtagatgtcctcgacagcgttcctgccaacgcgcacgtaggcaggcttcgtgtcattgagaagcgctcggatgagcttggccgtctgggagcagtcgctcgggagatagacgcgcatgttcgggatggcagacatggctgcaatatcctgtgcagagtggtgggacatgccgagcgcaccgtaggagatgccgccggagatgccgatgagcttcacgttcgtgtcggagtaggcgcagtcgacctttgcctgctcataggagcgggtcgtgaggaagcttgcagggcttgcagcaaacggcttcttgccgcaggaggcaaggccggcagcgatgccgacaagatcctgctcggcgatgccgacctcgatggactgcccagggaacttgtcgaagaagggcgtaagggatgcagagcccctcgagtcggaacagaggacgcagacgtccttgtctttcgccgcagcctccatcagcacatcgcagatggcctgcttgttcgcgatcttgttaggcatggcactcccccttgtgcactgcgaaatctgtgctgacctgggcatactcttctgcattcggcaggtggtggtgccaggatgccttgttctccatgacaggagagccgaagcccttcgtcgtgttggcaatgatgaccgtgggcttgcccttcgtctcctcggcgagggagaaggctgcatcgagtgcgcggatatcattgccggggatggagaggacattccagccgaaggctgcccagcgctcttcctgggagtcctgcttcatgacatcttccgtcgagccggagatctggagacggttcctgtccacgagggcgcagagattgtcgagctcgaagttgccgcccgacatggcgccttcccagacagagccttctgcaagttcgccgtcgcccatgaagacataggtgcggtacttgcggccgtccatcctggctgcaagcgccatgcccgcagcgacgggcaggccatggcccagggagccggagttcatctcgatgccattgagcttgttgtttgggtgtccgatgtaggggcttccgaacttcgagaagcgtgccttcacatcggcgaggtcgaggaagccctcgtggcagaggacagcgtagtaggcctccatagcatgtcccttggagaggacgaagcggtcacggttggggtcgtctacagtctcgggcgtgatcctcagatggttctcgtagaggaccatgagggcatcgatcacggacatgtcgcctccgatatgtccgccacctcctgccatgatgatgtcgacgcaatcctggcgcaggtcccagcgcaggctctcgagcttatcgatttccacagctactctcccctcagataggccttgacgtcctcttcgatcggatcgtaaaggtcaggctggattcccagatacttgcaggcctcatagagcacgggcaccacatcgtcgtggatgccggcgcagtggtggatgtagggcccttccacgatctttgcatcgaggcgcttgatattcttgacgcggacccagaggtaggtgcccatgcccttcgggccatcgatgccttctgccgtgccgagcaggagtgagtacttgccgttgtcgccgtcgaagcggcaaagcgtcacctcgccatgcttggcctcagccgtaagggcgccattgtggtcgaaggcaagcggcgtggtgatggtcggcttcttcatggcaacagagcagggccagggtccgcagtgctgcaggagctcgccgttggggtcgtccggatggcggatcgtccagtcggcaaagaacgagcgcttgcggcccatgtctgctgcctcgatcatgagggacgtgatggcaccatggacatccgtctcgcaggtgatcggcgtgccctcctcattgagaatcgagttcgcagcgcagggcatcacgtggagctcatgctggagctcgttccagcactggatgcagccggccgtgcagtgatacttcttgagcatgcggcgcatcgtgacggccatggcggtaatcgtacgtacctgctcatcggtgcagttcttctcgaagtgctcatcgatccagataagctgcttctcgacgtcggaggtgccgttgcccttgtcctcagcaagtgctgccttcacgccgcgcgtgagctcgggcaggggcacaggtacgcactcgataccaaagcgctcgaggagctcgccctcgttgcacatcgtggaatagaactcgtagggacggggtccgatctgaaggatgcgggcagagcggaacttcttcacgacattgcagaccgcaatgaagtcacggagtccgcgctcgaagacaggatcgtccaccctgcagttcgtcatgtacgtgaatggcacctcgaagcggcgaagcaccttgcctgttgcgaagaggccgcactgcgtatcgcgcagacggacgccgtttgcctccgggcgctcatcgagcggtccccacagaaggacgggcttgccgaggtccttggcaaggcgggcacagatgaactccgtgccgaagttacagtggggaaggaagaggccatctacgctggcatcctggaacttcttcaggaccttgagacggtcatcctcgtcgaagagcaggccttcctcgttgatatcgtcgatatcgacaaactcgacgtcgagctcttcgagcttttctgtgatgatcttgcggtacttccttgcatcgggtgcgctgaagatgctcctgcgcgtcggtgcatagccaagaacgatcctgtccatgaggctcctctcctctgtccctgaatctgccgctcggcggattggaagggtagctttctttcctgagatagaggatatggatgaactcggctacacttaacgagtgggggatattactaaatatttagctctaaatagttaggcgtgggagcatggcagacaaggtcacggcgcgcgacgtcgcaaaggcagcaggagtctctccagcgacggtctctctcgtgttccgggaccgtccgggcgtcggtgccgagacaagggacagggtgcgcaaggtcgcagaggagcttggcttcgaatacgacgcaccatctcagccccggaagacctcgacgatcttgcttatcatctacaagcagcatggacgggttgtcgcagacactcccttctttgagagcctcatcaagggcgtctctgacatgacctacaagcttggctatcaccggctttctgtctcctacttctattctcaggagaacaaggcagagcagctgagcagcctgcgctccatcaagtgtgccggcatcgtgcttctggctaccgagatgcgtgcgaccgatgtgacgcagttcgagcacctgggcgtgcctatcgtccttctggacaactggttcccgacaaagaacctcgactcggtcgtgatcgacaactcccgtggcgcttggacagccgtgcgctatctcaggaacatgggacacaccgatatcggctatctccattccaatacggagatcaggaacttcctcgagcgcagggatggctatatccaggccatgcgctacttccatacgtcagatatcgacccgctccacacaatcgtggaagtgggctccacgatggagagcgcctacaaggatatgagccgctaccttgatggaaacccgtatctgccgactgcctacttcgccgacaacgacctcatcgcaatgagctgcatacgcgctctcaaggaccacggcatcagggtgcccgaggatatctctctcatcggcttcgacgatgtctcgactgccgccatagccgaccctccgctcacgaccatggcggtgcccaagacgaatatgggtgccatcgccgtgaggcgtctcgtcgagcatgtaaaaggggagacggatggcgaggtcgtgcgtatctcggtccttccggagattgtccagcgtgcctctgtcgtgaagccggatgaggatgcctgagagcgtgctttctaaatcacaactattgaatcttgtcaaccaagagtgctaaatattcctaaattctcgtaaacatgctactaaatcgatagaacggtcaaggcgagttcttccttctgtaatcttcaggtcagcaagcaattccggatgctcaggcaagggggcctggggccggaggggcaagaagggggattcaatggcagtcgacaaccaaaagattgctgagggcgttctcgccaatgtcggaggtgcagagaacatcgcgtccgcgacgcactgcatgaccaggctgcgcctgaccttcaaggacaaatcgaaggtcgatggagatgccatcaaggccatcatgggcgtcattgacatcaattgggcaggcgagcagctccaggtcatcatcggccagagcgtaccgaaggtctatgacgcggtgcttgcgatgggtgtcacgggtgaaggcgccatcgatgagaacctcgatgagaacctcatgaaggagaagctcacgccgaaggccgtcggcaataagattctcgactatctctctggctccatggttccgatgattccccttctcatgggcggcggcctcttccgcacgattgcagcaatcctgggcccgacgatgctcggcatcctttcggtggatgacccgacctacacgttcctctacacgacgctctatgaagcctcgttctactttatgcctatctatcttggctattctgctgcaaagaagctcaaggcttccgaggtcctgggcatgctctgcggcggtgtcctgattgcaccgacggtaattgccgcagctacgggcagcacggccatcagcgtctacggcttccagattgtcccgggcaactatgctcagtccgtccttccgatcatcctgacgattcctgtcatggcacagatcgagaagtggatgaagaagcatgttcccgatgtgctctccacgatgttcgtgccttggttcacgatgatcgtcaccattcctatcgagctcatcgttcttgcacctattggcaaccttatcggtaccggcattgcaaatgcgctcttcggtcttgctgacgtgggcggcatcggcatcctcatcgttatggctgtcctcggtgctttctggcagctcttcgttatcgctggcatgcatatgcctgtcatccttcttgcccaggtccagatcattgctatgggctatgatcccttcgtcttcgtctccacgaactgcgctatggctgctgtctggggctgcgctatcggtgccttcctgcgtatccacaacaaggaggagaaaggtatgatcggtggctacatcgcctctgcacttcttggcggcgtgaccgagccgacgctcttcggcgtgcttctccgctggcgccgcaccatgctcggcatgttcatcggcggtgcaatcggtgctgtgttctccggaatcacgggtgtcacctactacctggctggcggtgcttccaacttccttgttatcaccaattacctgcagggcggcacgcagaacgtgatctttgccgtcatcggcatggcaatctcctgcgtcattgccgcagtggtcgtctacatgaccggcttcacgaaggaagaactcgaggctctcgatcacgagaagagttctccggtagcagcctagaatcgtcatctcaaaacggaatgggtggctgggcagatgtgcctggctgcccgtttgaaaggaggcatgtcgaagatatgcatgcgaaagaagccctatacgatgtggcagagacctggcgcgagactgtgcttgtcttcgagacagcgcacgccttccgcgatcctgttcgtgactgctgcatcgtagcagacttcgcaggccctgatggtatgcatatcagacgggaagccttctgggatggcggaaacaggtacggcgtgagctttgctgcactgaaggcagggacgtgggcatggaagctctctgctcctcgcgagagcgggctcgatgggaagtcaggcacgatcgaggtgaagccgtacgctggtagccttcctatctaccagcatggctttgtgcgctgcgcccatatgagagagctctatgagggcaagctgctggcccggaacatccttgcctatacagatgggacaccgttcttctggctcggcgacacgcattgggagtttgcgctgggggagagctgggagcgctcgaaccatcctggcatagagagtcagttcaggggcatggcagataagcgtgcttcccagggatttacggtctatcagacgaacctcaggagcgatttccatgagcacagccgcttctggctgacaaggccggatgcagagcatcccatccccagcccggctgtctttgcagaagagatcgaccgccgcatgcactatctcgcagacctcggtcttgtgaatgcactcggctttgcctggggaagcagcatggagagcgaaggcgatgcgttcggcgccgctacgaccttggtggagcagaagacgcttgcccgctactgcattgcccgctacgggacgctgcctgttgtctggacaattgccggtgaagtctcaggctacgatccttcccgctgtgacttccttgcctctgcctggagcgaggtggcaaagatcgtgcatgagcttgatgtctatcatcatcccgtgaccgtgcactctgccaatgagtgtccgttctctgattgcttctacgataaggactggtacagcttcacgctcgaccaggctgggcacggagacttcgttgtagcagagtctgactgccgggactatttggccaagcaagcggacaagccgtttgtcgaaggagaggcgctctatgaagggtgctctttgctcgaggagaatggcccttgcaggatcgatgcctcgatgcttcgccgtgtggcctatctgaccatgcagttcggcggcgctggctatacgtatggtgcacagggcatctgggacaatatctggtcagaggaagacctcaagaagacgtcttttgcccgcatgatggcagccacttcaaccgctacggcgtcgcctggaccgaagcgatagatttccccggtgccaagcagatgggcatcaggcgccgcttctttgaggagcaggaatggtggacgctcgagccttatgggcaaggcggcagcgcgcttctcggcaggaagacccctctggctgcaaagaacgcagacggcacgcatgtcgtggcatactatgcagcgacgacgaggcgtcctcttgcagttgatggtatgaaggatggatcctgggtgctccggtggttcgatccggccacgggcacctatagcggagaagaagtacggcagatctcgggcgggcggatgcgtctgcctgacgagccgacgatggatgactggctgctggtccttaccagggctgacagcatcttttcgaagaggatggagcagacacaatgagcaaggtatcagtagagggtctgcatctcgtacgtgacgggaagccgttcttttggctggcagataccatctggacggcattcacgagcccgacggacgacgagtggatcgagtatctcgacctgcgtgcagccgaagacttcaatgtgctgcagatcaatgcgcttccccagtgggaccgctgcagtgtcgcaaatccgcgctatccgtatgcaacagctgatgacggcgtgacattcgacttcacgcaggaagtgcctgcgttctgggagcatgcgaagtggcagcttgcagaggccgtgaagcgcggcttcatgcccgccatcgttgtccagtggagcaactatgttcccaatacctgggcctcgaatattgcctcgcagaacatcatccctgacgagctcgtggatccggtcgtgcgcaagatctgctcctcgttcaacaagttcgatccgatctatatcgtgtcgggagatacggacttcgaccacgaggagccgatcgatcgctacatgctcgtgacagactgcgtgaagaagtacgcacctgacgccctcatctgctaccacatcaagggccgctatgatgggctgccagagtgcctggcagagcgtgctgacatctatctctaccagtcgggccacaacatcacggcacaggctggtgcctacacgctggccaggagctttgcagcacgtctccacaagcgtccgatcatcaactccgagccctgctacgagcagatgggctactcgcacatgctctacggccgcttctgccaagaggactgcaggcgggcgctctggctctcgcttctgggcggcgcatctgcaggtatcacctatggcgcacatggtgtatggaactggcagggtgcgggacagggcaaagggctcttcgaaggcgaaggcttcctcaaggccctgccgcatgaggtgggcctgcacttcccgggagcacgtgacttcggctttgccaagactctggcagagcgtctcgatctcttcgagcttgtgcctgcacaggaggtgcttgcgacgcacgcagacgatgtcttcgcctcgaaggcagctgatggctcgaagcttcttgtctatgtgccgtacaacgcagacatccgccttgcaggggacttctcttcctcccatgcccgtgctatcgatctggctgagcgcaccattgtaccgctcgaggcaagctacgacgcggggaaggggacgacgcttctttctcagggaacctggctcgaggatgccgtgctcgtgctcgacctggcataagcacaaggcggcatagatagatattattcactgcgaaggggctgtactcttgagaggcggcccctttctgcttcagcgcctatgatacggatacaccgatttttgctgcttgtacggtacagttgtggtacaaagagcgggatgaggcatgaaaggggagagcatgggcaaggtgacgctcaaggatatcgcacgcgaggtgggcgtctcgccctctacggtctcgcttgtcctcaatggacgctatgtgcgcgcctccgatgcaaagcgccaggccatcctcgactgcgcacgccagaagcactatgtgccgaaccagattgcacgaagcctcgtctcccagcgctccgatacccttggcctcatcattcccaacatcgagagccgcttcttcagctcgcttgcgaagcatctcgagcagcgctgcaggaaggcaggatatgccctcctgatcgcaaactcggacgatgtgccggaaaacgatgcagagctcgtgcgcctcttcgtgaaccgtggcgtcgacggcatattcctcgttgcggcaggaggtctggcacccgaccctgcgctcgcagagatgctctcgtctttgcctgtcccattcctgatggtcgaccgtgtgctcgaaggcgttcagggcgactccgtgagcttcgacaatgtgcttggcggctacctcgcgacaaggcatctcctggagcaggggcaccgtcgcatctgctgcgtcgcgaacctgcaggaaggcacgggcaggaagcgcgtccagggctatgagaaggcacttcgcgagatggatgttgtgcctgagcacacactcgagctccagagccgctactacatccccgacgcctaccatgtgggggatgccgtgattgcgacaggggcgactgcggtcgtcgccacctcagacaacatcgcgctggggcttctgaagcgcttccttgagcgggggctccatgtgccggaagacctctctattgtgagctacgacaactcggcagcaggcgtgctcttcgagctggcacttacctcgattgagcagaacgtgaacgagctttccgaagctgtcctttctctcatgatcgagcggctcagagggacgcttccgctcgagccgaaagcctgccctcttgtgccgaagctcgtctacaaggactcggtcagggtgccctgaggggcatctgctagattgagctaaattttttggtaaatcatattttcatatggtgataaaacgttttatcacctatattgcatttcagaagcaaacaagggagagaaggagtgtcaaatggctcagcctgttttgggtacgccctggaagaagctcaaccgcactgtctcggatgaggaggtcgcctggctcgaccgctactggagatgtgcgaactatctgtccgtcggccagatctatctccgttccaactcgctcatgagggcagacttcaagaacgaggatggtcctgacggtttcacacgcgaggatgtgaagcaccgtctcgtcggccactggggaacgacgccgggcctgaacttcctctatgcccatgtgaatcgcctcatccatgaccaccagcagaacacgctcttcctgatgggcccgggccacggcggaccggctggcacctcgcagagcctgctcgatggtacataccgcgagatccgtccggacatcacggacgacgaggcaggactccagaagttcttccgccagttctcctatcctggcggcatcccttcgcactatgctcctgagaccccgggctccctccatgagggtggtgagctcggctacgtgctctcccatgcctatggtgccgtgctcgacaacccgagcatgctcgctgtggcagtcgtgggtgacggcgaggccgagaccggtcctctcgctacgagctggcagacgaacaagttcatggatcctctgacggatggcatcgtcctgccgatccttcacctcaatggctacaagattgcgaacccgacgattctggcgcgcatctctgacggtgagcgcgaagagttcttccgcggcatgggctaccatccgtacagcttcgttgctggcttcgacgaggaggaccacgagtccatccacaggcgcttcgcagcgctgctcgaggcagtcttcgacgagatcggacgacatcaaggcggcgctgcaggcgaggctcctccgttctatcctcatgatcatcttccgaccccgagggctggactgccgaagaccatcgacggaagaagaccgaggttcctggcgtgccatcaggtgcctggcatctgcccgcgataccgaagcacacttccaggtgctcaaggggtggctcgaatctatgagccgtaggcctcttcacgcggagaggccatccgtcccgagtcacgagttcatgccgaaggcgaatcaggatcggcgcgaaccaatgccaatggcgggcatcaggaagccgcttgcatgccaaggcagagactagccttcgagtggacgggcatgggcagggcgaccgagtcgacgcgcgtgctgggcagtacacggccgagcatcataacaaccgtgacgcttccgatcttcggccgacgagacggcatcaacgtctgcagccgagctaccaggtgacgacaagcagtggttcaacgggacctcaacgacgatccggcaaacgacgagcatcgctcctgtcggcaatgtttcgagcagctctccgagcaccagtgcgaaggcctgctcgagggtctactcctaccgggcgccatggctctggtcttctacgagtccttgtcacatcgtcgactccatggtgaaccacatgccaagtggcgaggcaacgtgcgccccatcccctggagaaagccatactccggcctcaacatgctcttcgagccatgtctggcgccaggaccacaatggcttctcccaccaggacgggcttgtggatgtcctctcaacaagtgctggaacaacgaccatgtggtgaacatctactatccggcatgcgaacatgctgctgcggcgcagagcgctgctacagtccacgaactgcatcaatggcatcttcgcaggcaagcagcctgaggcactggctctcctcgcgatgccgcgaggagctcagaagggcgcgccgagtggaagtgggcatcaacgccaaggcgggcgaggagcctgaatcgtcctcgggtgctgcgggacgtgccgacgcaggacgctctgcgcaccgagcttctcgatgcgctcggcgtaaggttcgtgtcgtgaagtcgtcgagctctgaagatccagaagcgcaggagaatgagaggcactctccgacgacgacagtgtccgcatt

SEQ ID NO: 362 - DNA, 26982 bp, Unknown
  Metagenome-assembled genome
atatccattggtatcagacatacttttcaacttgaacacctaaggggaaaagtccagctgaacctgtccgatagtatgtggatcaccacacgacaacaatctagtgaaggtaacagatggactgcccacattctaccattgaggcacagcagaaggaaaagcactctacatttgaagagcgtgccacactacagagctgcctggaaggatggctttgctgagaagcatctgcctgagagctcagtcgacctgtatgctccatcagctacgtggcagggtcgagctctgccacggctaaggcagtgcgctacagaaccaaacaagggcagggcatctgtaaggaaagacgcaagagctgttgtcacagaacagaatctcctgaagaggccttagctcacacactgtgtagagggccacctcttcaaaggtggctggtcacctgaggcgtgctgcaaccgctcaggggcagcaggggagtttgtgtagaaggacactttatacctacactgaccaaagcttgctgggtatccacaactatagcctgcctgaaaagcttaaaagtgcaggctgcctgtttgtcagaacaaagaagagctcgccacaagcttgaaaagcgcccctaaagacacaatgcgcacgtctgaggttaggcgcaaggggagtgatttggtcttgagccacaagaccaaaggcgataaggcacacctaaccttgtctgagtgtttgagccgtgagtgtctcatccatccctgtcctggatacaacagctgccaagcaccatgcaggctttcagaaagctacagggccactgcagcaagcaccgctacgctacctttcaaaaccatcacagctgacaggggcttttagtttgtagactcttacagctaaaggacatctcagagatactcatctgctgtgtccacctcctacacttcctgtaacaagggaactactgagcggcacaactgcgtagcctgcagactcatcccttaaggggaccacagtgccacctgctcttttcaagacatcatgccgaagcctggcatagctcgttgccaagagagatgttgggctaccacataccgggtgaactattcaaatcagagctagattgcctctatcagacagcctgattaggagtgttcaaggtactcctgcaaggtaggaagaactttttctatgtagtcctatatgttggctgttatgtcaggcgcttcttaacttcctgagctaaatcatcaaaggggacctgcacctgctcgtggctctgcatgtcacggatggtcgcccgatgggcacttacctcatctggtcccagtactacgcacagacgagcattgagcttatcagcctgcttgaactggctcttcagggaacgtccctgataatcagcctcagtacggatgccggcctgacgcaacgcgagggttacgtcaaaggcggcacgacgctcatcctgagaggttgcggcaacatagacgcagctcggtgccggagtctcgaggtccttgccctgtgccttcagcgccaggtagatgcgctcgaagcccaccgcaaagccgatgcccggggtctgtttgccgccttcgagctgcatcagtccgtcgtagcggccaccaccgccgatagcgccaacctcggagtccttcacttcaatctcgaagactgtacgggtgtaatagtcaaggccacgcacaagcgtcggatcctcaacgtattcgatcccggcagcgccgagataggactttacctgtgcatagtgctgcttgcagtcgtcgcataagtagtcagtaatgaggggtgcagacttcataacgtgctgacagtgttcattcttgcagtcgaagcttcttaaggggttgatgttggcgcgctcgaggcagtcgtcacacatctcgtctttatgatcgaagataaactgacgaacagactctcggtaggccggacggcatttctcgtcccccatcgaattgatgcgcaaccgcaacgtcgagggatcaaagccgagacacttgaagtattccatcaacatgatgatgcactcggcatccgctgccggatcctcagtgcccagccattcaacgccgacttggtgaaactgacgcaggcggcccttctgcggacgctcgccgcggaacatcgcctcggcgtaccagagcttgaccggtgcggcgccctggggcacaaagctgtgctcgacagcggcgcgtacgacgccggcggtcccctccggcctcatggccatccgctgcttcggtttcaggctcttctcatcgccggatgcgagcaagcgatccaagagcgccccggaaaagacacggaacatctctttgcgcaccacatcggtcgactcgccgatcccgtggacaaaggtagctacctgctcaagggccggggtctcaattctgtcaaagccataggagccgaagagatcccgggctgtgtcgcacatatattcccaggcacgcatgtagcggccgtaaagatcctcagttccctgtatacgttgtgccaaagtacttcctcctcacgcgcacttgagcacttgcgcgtctcccgtcgggccacaaaccttttcagcaaggcctccctcgacatgcctggttaagtataccttcatgcagtcctcttcagaaaaacacgacacctcccatttgttgtgaaacaaatgggaggtgcgaaggatgacctcactattatagagaaggactaggcaacgttgatctcctggacccagccatacttgtcctgaatctcgccggactggatgcccgtcagggtctcacgcagcttcttcatgaccggaccgacgtgatccataccgtagacgatctttctgtcgccggcatcgatctcaccgaccggggaaatgaccgccgcagtgccgcacataccgcactcagcgaactggtcgatctcgtcgaagcggacctcacgctgcacgacgtccatgttcagataacccttggccacatcgacgagcgagcgacgggtgatggagggcaggattgagtcggttgcgctctttgggacaacgagcgctccgtccttatcgacgaacaggaagttggcaccaccggactcctcgacataggtcctggattgggaatccagatacatgttgtccgcatagccctctttgtgggcgatcgtggacggcagcatggacattgcgtagttgaggccagctttaatgttaccggtgccatgcggtgccgcacggtcatactcggagacgcggaccttgaccggcttgacaccacccttgtagtaggccccgaccggggtgaccaggatacggaactgatattcatccgccggcgcaacaccgattacgatcccggtcgcgaacattaacggacggatatacagggttgcgccggtaccgtagggtggaacccaggcagcgttagctttcacgacctgctcgaccgcgtcgacaaagcgctcttttgggaatgacggcatcaccagtcgctttgcggagtcatacatacgtgcggcgttctgatctgggcggaagaccacgatgcggccgtctttggtggtgtaggccttgaggccctcaaagacttcctggcagtagtgcagaataccggagcactcggaaatcgtgacagagtgatctttggtcagaccgccttcgtcccatgcgccgtccttgtaattggagacgtagctgtagtcagttggctggtacgagaatgtcaggctgccccagtcgatatctttcttttgaaccatgacgtgctccttcctgcatatcacgcagccacttcaacaacaggttaattgcctgtgattgtacaccgcatgaaccaaatgaacgaagatcgctacaggcttgaaacatccttgctacgcagtcgttacgtcgctgagagctcaatctcttccccaacttctgtaattctcctgatgtccaggcttacgcagtaggattgatcgtgataaaaaaggaagcatacagcatgagaatgtttcaaaacgactattcagaggatgctgcttcggagaccctggtggcactgtgcgcggctaacctcgagcagcgcatcggctacaccaagggcgaccctcactgtgaagaggcccataagttgatccgtgaggcctgcgaggatcccaccgcagacgtggagttctacatcggcggcacttccaccaatatcgtagttctaaacggccttctcaaagattgggaaggcatcatctgcaccccggatgtccacatcgctgtccacgaaaccggagcactcgtcgcggtaggcagaaccgtccttcccacccacgacaaagacggattcctgagccccgaggaagcagaacgggtctctcgcttccaaacttcgaccgatcagcgcatgaccaaacccggcgcggtctatatccccgacaccaccgagctcggcggcgtctggaccaagcagcgttttgacgcaatctgtgactgggccgacgagcatcagctgccagtcttcctcgatgaggcacgtttggcgagcgcgtcggtcgcaccttccaatgacctcactcttccctacattaccaagcgctgcgccgccttctacctaggtgacaccaaaaacgggacgctctgcggtgagacttcagtaattaacgaccctaagcttaaagaagccttcccctacctgatcaaggagcgggacaaatttctggcaaagggaagactactcggtgtgcagtttgagcgcgcgtttatgcccgaagacaccgagccgttctggttcccctatacctgccaggcaaatgactgcgccataaaactgcgtgaaagcctgatcgaagaaggttacgagccctacggtgactccgacttcaaccagcagttctttgtcgtgacgccgaaacaagtcgaagcgtccgcagaagcctgtggctgtgagaccttctacaccctgaagggcggcagacaggtcatccggtttgtgaccagctgggcaaccaccgaatcgaatgtagatgaggtactgacctttgcgaagcaggtgattgcgtgacctatggccaccatatcgtctcaacgtaaacccctgacaaacacacttgccgtcgcgacacttgcgaccctgtgctgtgccctgtggggctctgcggtccccggggtcaggctgggctatcagctctttgcgatcagctcctccgatgtgggctcgcagctcatcttcgcgggcagccgtttcttctttgcaggtctcgcagtactgatcgtctttcaagcgcacacccacgccccgcgcctgggctcccactttatcctcaatgccttagagctcggagcctttcagacctatgggcaatacgtgctctactacatcggcctcgcacatgcgactggagtcaccggctccctcatccagggcgtcggcgtcttcgcgatgtctttgttctcttgttttgtctttaggttggaaaaaatgaccgtgtgcaaagtcctcggcggtgtgctcggttttcttggcttgatcatctcaatggggatcggtgcctcaacccagttcggctggggtgaagccctcatgttgtccggcaccatctgctcgacgatagcgacagcgttgatgcggcagaagtcgcagcacttgaatcctattcagctcaccggctggcagtttgtgctgggcgggatcggcctagtcctcaccggcttgctcctcggaggagccttcacgctcaactcctgggctgccgcggggatactcgcctggctcgtctttgtatcagcggcggccttttcaatctggagtttactgctgcgtgacaacgatatctcccgtatcgcgccgtatcaattcttcatcccgatcttcggagtgctcatctcacttctcacgctgggagcagaaggggctgaggtcggcgtcaataccgtgatcgcgctgattctcatcagcctcggtatcataatcgtcaaccgcagccccaaacagacaagctgatactcagttagcgccgaatgttctggctgatgttgtcagcgatatctttgccacgctggaacactgaagtcagcggtgttgcagcgtcgagcttctggcgcacgacgtcacaggaggcgtggaacgcctgaatctcgctgttgttcagatcgtactcgaggaccttttcgacgccctgctcgcttaagattgcgggcacgccaatggagaggtccttctcgccgtactccccatccaggtgcacggagagcggcaggatcgtgcgctcgttgtgcaggattgaagtgacaatctcaacgacgacggaggcgataccaaactcggtgacgttcttgcccgcaatgatgcggctgccggcctcgcgaaccttcttcttcacctcagtgaagtcgataccctctctgcctctgccggcgagcttcatatactcacgcagcgggatgccgttgatcgagatatgggaagtcgggataaaggaggagtcaccgtgctcgcccatcacgattgcgtcgacctgacgggcgtcaaccttgagctccttgcccaggacgcggcgcagacgcgcggagtccagtgcagtgccagtgccaaacacgtggccacgcggcagatcgaggccgcgatagaggtactcggtcacgatatcggaggggttggagacggagatcaggataccatggaaccctgacttcttgatctcgggaacgatgccatccagaattcttagggtaccgcccagaagatcgaggcgagactggcccggacggcgccccttacctgcggtcatgataataaaatgggcgtccttgcaatcagcataggagcccgcacgaatctcaaaaccatcgcctaagccggatgccaaatcgttcaaatccattgcctctgcttcggcacgctcacgattgacatcgaccaatacaatctggttgaccagatggccaaacatcaggcagagcgcgcagtgggagcccacatgccctgcgccaatgataacaaccttccttgtcctcattgccattcctttcacttcaggtccgccgaaacctgtaacacgctggaaataattaccatatactgattctagcatgcacagtatacgcgtttatgcatcgatcccccagcggattgaaaagagacgtcaaatttgtagttcagtcctgaaacctgtgtgcagacccatcacgcaccagccccggaacccttcgagtagcgcctgctggcaccaaatatcttgaggaagaggtattcgtcgttaggatatccctagcctgcccttctgagcgtcttgatcatctggttggtgccttccaccttccccgaggatatctgatgcctggcatgtgcgatgattccctccatgtggccctccacgaggcgggcaaccctggcgaaatgcctgtctttcgtgccgcggcacatgtccacgatcctctccatggcagcacgtatcgcatccgcatcggtgcacgaataggcctgcgcgagcatctcatctacgatgtcacaggcaaagggcagctcgttttgggatatgaggtcctcgtagcgcttcctggctcctcgcttctgcacaacctcctgcttgccgaagagggcgcttccccttaagaccaccttgccggcgcgtgcatcgcgctccttcctcttcctggtgtccgcacaggacttaaggatatacttcgagtgcttgagggcacgcgcggcctcgacgccgccctcgtccttaagccttgcctgcttatccttcctgaccttacagatcaccttctcgttgaagttcttgatcaggtggaagtactcgtagacgatgtccaggtgcaggaacctcttaaggaatgcgcgctcgaagtctgcgttcatgtcgcaggcgattgcttccaccttcgacatccactcagcgagcacaaagtcacagaattcatgcacgacctgtctcttcttggaatgagcgggccacagcacatggcctgtcttaaggtctatgaccacggtggcatatctgtgcccgccgtaaagcttaaacttatctgcgcccagatagcgcgcctgccgcttgggctttcggagtctggcctcgccgtcttcatccccttccgtgtagagcccagagagcctcttcttgtcgatctttttcaccacgttcttgttgagccctgtcatgagggacacttccttgagcgtctgacccaatgcgagcaggtcacacacgaacgcgagcagcggcagcgtgatgcgctggcctggggccctgaagaggacgtcctcgatgcaggtgcccccgcactccctgcatgctcatcttggccgcaagacctctatcctcgcccttcccatccccagagggaggtgccagagcatgatggggccttcccgtttttctccattgcccttccgcagcaggggcatgaaggagcttcctgtgccttaagcctgcctggaacggacaggatgcgcactggcttgtggcatcgcctggacgacgtcccgaactcctctgtacggacgcccccgcatggttcccctgtctgcacaaatccttcgagatgggaggggatccggaagaagacagagtcttctccggtatgggaaatggcggacagctgggctgccgtagatgctacacttgtcatcgcgctccatccttcttcggagtctacatgttgcgatgcaagattctagaggatggccgcttttctgtctctttgagcatcaagccatgggcatctgcccacagcttttaggattgaacctttttcctaacagtctagataacgggtagatctggcacctcacaggcatatccacggtcaacatgcaaaagctacctcaactggtaggtctacctcttccaggtcaaccaagcccgtgataggtggcctgaagctgcaagggtggttcgccatatggtgatggtcgatgcaagcctccgcagctcgacgtaggtatactatcacccggtatctagactgttagaaaattttaaagaacaagaacggacgaacatgttaacttactaaagttatgcgctcttcattatgacggaacggacgattccagctacttcatccaccgcatcgaggcacagctccatacggtcaaagagtctcagccacgccaccacatgcccggggcgccggtgcggggaatcctcctcacggaagaggttgcgcagcccggactcgtacactgagtccccttcgtcctcaatcgagtcgatcgaggtcgcgagttccatgcaggtcgggtcgttcttgtagtttgggagcgcatcgatcatgcggtgcatctgcttgaccgcgatcacggtcaggtgtgccatctctttcgcctcagtgtgcatgcctgagacattgaagaggtcgaaccgcatcgttacccccttgatatggtccgggacatcgtccattttgagcgtcaagtccatcagatcgttacggtcaatcggggtgatgaaggaggcgtagagctctttcataatgttttggaccgtctgatcgcactgcgactcgcgcaatttgatttctgggatcagatacttggtgtcagggtagccgtcgaccagtttttcgtagagctgagcgtcatcttcgatctgcgtcgcgaaatctttgagcatcgtgtagaacggatcctctttcttagtgcgaggcatgcgtgctccttcctatgcgtgccaaacaggatatgactagaaccaaatcaaaaagagttttgccagaacaaatccgataatgccgcagccggggaacgtgaagatccaggtatagaccatctctttcgcgatgttccaatcgactgagtgcacattcttcgcggcgcccgcgcccatgattgcggcggtcttcgtgtgggtcgtggagaccggaaggccagtcaaggtcgcgaccagaagcgagaccgtagcggagactgaagcggcaaacccctggtacttctcaaggggtaccattttcataccgaccttcttaatgatgcgcttgccgcccacagcggtgccgagcgccatcgtaccagcgcagaggacctcaagccacagcgggaagccgctcatcgagtcaagcgagcggcccgcggaaagcgcgatcgcgagcagagcagtagacatgaacttctgtccgtcctgcgcgccatgcatcaaagccacgcctgcagcgcctaagatctgcatcttgccgaagaaatcattagctttccgtctgtccgcgtgtcggcagcagagcggaatgatctttgcgattacccagcctgcgagatagccgagcaccgtggagagcaccaggccgtagattactttggcccactcccccatattgacgccggcgatgccgccggagaccgcgatagcgccgccggtcaaacctgcgatcagcgcatggctctcagaggtagggataccgaagatccaagcgcccacaccccaggctacaataccgacggtggcagcagcaagcgcgatcagtgcggcatggttatccccgccgaagtccaccatgttgctcatcgtatccgcgacggcagtcgagatcatcgtcatcgtcaccaacccgacgaagttgcagacgaccgacaccgcgatggctgagttcacatcgattgagcgcgtgcccactggttccgcgatcgcattcgcggcgtccgttgccccattgacgaagatggtagcgagaatcaggacgataacaatagcgagaaatgggttggtcgctaccatgtccaaaaactgagagaagcttatcaaggttcctcctgagggaaggtcctacccgcacgaattatccaaccacccaaccattgtacgggatatatccaggatatccacagccaaaagcgcaggaaaatcaaggatttctgatggagggcggcgatacgccgccctcacatgaaaagggacatcccatttgaggtgccccttaaatcagattttaaagtaactctctatgcaatgaagttgcggcggtcatagcactcatgcttcggtgcgccgaattcttttgttccgagctcgattgacttcatcagaaacgccatgttgtgtgccagattgcacacgacaccgatgccctcggtgtcctgctgcacctcaccgggtgcagaaccgaagagatcgttccagtaggtgctcgtcgcgatcggcatgctgctgatcgagaagaacttgttcagctgatcaaaagtggagacggtgcccgcacggcgtgccaccgcgacagctgccccgaccttcatcgagggatcgaagtgaatactgtagaacaggcgctgcagcaaggcttctagggtcgcattcgctgaggcatagtagaccgggcttgcaacgacaaggccggctgactcctcaaacttcggggcgatctcgttgacaatatcgtcgaagatgcacttgccaagctcagtgcagcgatggcaggcgatgcagccgcgaacatccttggtgccgacgcggacctcttccgattcgatgccctcctcggcaaagacatcctccatccgctcgagcgccacactcgtattcccatgaagcctcgggcttccgttcaacagcaataccttcatgatgttcctctcccttttgcagtaacctaaataaaactttacgcattgtccaatctaccggcaaggacgttccccaattctttcttgtccttctcaccggtgaacagtgcctgatagcgctctgtgaggtcgtcaatcatctcctgatcctgcgcctccaccatctctctcagcgcttggatcaacgcacgctttgccaagtgtgcgggttccacatgctccttcgcccggcggagcttacggcgtgcctcttttgactccatcgacgagaattgccccgggcggttaaagatgtgatcgagcccatagaggagacgatccccactcgaagttacctcgtcgtcgacaaagtcacgctctaagactaggtgcgctgcaccgagcggcgtgttgcccttgtggatcaggtaggtgccgcggaagaagtgatagtggcccaaggcagtgggcgttgtgaggaaagcatagctctcctcgagcgcctgggccccctcacgctcacggtccatatcgatcagcatgcccgcgcgggaaaccaaggtatccccgtcatagggatcccaggtgatcgcttcatcgatcgtcttgagggccttgtccatctcatctttttgctgatatgcctgcgactgcaggaacagcgggccatagtgaggagcaaaagagaacgaagcaaccttgaatttagggtcaagcagctgagcgaactgctcatcaaccggatccgagaagtcgtagacacggccaccccgcttgttgacttgcttctcgagatcgttgccgccgtcgtctttcatcatatcgaacatcgcctgaacggttttgatcgcctgatcgtagttttcattgatgaacgcggcgagtgcctgatcatactggtcatagaggtcgtggctgaggtcctcgagctcctcgatgatctttttgctccgtacatcggaggcattgatcgcggtgccgagccgctggtcctccttctcacgctctttctcccgctgtttcatcgcgtgctgtatctcaagcgcctgggttctcagtcgtatctcagctgcactgtgggggcggatcccggacagcgaacgcgtgttgttctgtgcatcagccatacctgctacctcatctactctttaagaagttgtggctctctagcctagtttattccaactacttccttatccaatcggcgtagcggggtaggatagcgaaatgaggagagaacatagttgatacacgaagtcaggagaacctcatgcatatgaaaaacggacaaccggtcgataaaagcggtctgacagaagcagaattcttagcctcctacacctccaaggattatcccgccccgtcgctcacagcggatatctgcgtcttccgcatccataggcagcacttagagttgttactcgtccgccgaggcggccatccctgcatcggccagtgggcgacgccgggcggtttcgtcaatcccaatgagaccgccgatgaggctgcggcacgcgaactcgcagaggaaacccatgtcaaaagtctgaagctcgagccgatgatgctgctctctacccccggtcgtgaccccagaggctgggtcgtctccaatgcctttgtcgccctcgatgacacgggtgcaatcgctgaggcaggcgacgacgcagcacagactcagtggttccgtgtcactgcccataaggagggtgaccacacacagctgacgctccacggtaaagacgaagagctgtcctctgactttgctatcacgcatcttccggtgtccgggcacctctgggccaccgatgccaacggcaagggcttagcctttgaccatgcaagctcaatcgcgcaggcatggctcaccctccccgaaaagctccgtgagctcagcttgaaggactaagccgcgaattgcctgtctcatcctgctcgatctcccagcgcacggtacacacttcctgaagcaacgtctgatcgtgtgagatcaacacgactgccccaggaaaagcctgcagtacatgggaaagcgcctcgattgagtggatatctaggtgattcgtcggctcatcaagtatcagcagtgccggatcctgcagcactgcgagcgcgaggcagagcttcctcagctccccggggcttagggcttccccttccaggaaagtctccgggcgtgcattgagctgtgccgccaccgacagcacctgtccgcactcacgatcagacaattcatgcaactggttcagcaccgcagagcgctgcggtgctttcagctcctgaggcaagactaaggtagcgatatcgtccggtacagccttaatcagtacccgtgccagtgtcgtcttccctaccccgttggctcccatcagggcaatcttgtcggaggaccccacatatagctcggatatggagacacccgcctcagcgtccgggccaaagggtatggtctggctcgccaagtgcacgagcaccgagcgagcggcacagtgcccgaacgtggggatttcaccgttgtacttgccctgcggccgtgtgtgggcatcacgctccagcttcccgaggcggctgttcaatgcagaaacctgccgggtaaggataccgtccttgctcgtagctttggcatggttcgctttttctcgggcatcggaatctcggggagaggccttcggagaccgtcctttcttctgggcagcctttgcacgtgtctgttcccgtactgctttaattcggacaagctcgcgccgttccttaaggtagtcacggttacggttgagcgccgccttccggcgctcttctactccttgctcgtaggtgccatggatgagctccatggcacctgcgtcgataaaaaggcaattctgagtgattacattgagcaaagcccgatcatgggagatcaaaaggccgataccagaaaagccccgcagtgcctcagcgactgcctgtctcgagggaagatccaggtggttggtcggctcatctacgattaagacatccggttgctgccagagcgccaacgcgatctgtatgcgcttcttttgccctgcagagagcgtatcatagcgccagagccattcgtcctcaatagagagtatctcccgcacctccagggcttcctgtccatagtcacaggcaaaatcggaaagcgctcgaggtacttctgaggtatcttgctctgccagtgccaccacaagcttgggggcgatcgaccctgcatccggcgtgagcgtgccggcgatcagatgtgccagcgtagtcttgccgcatccgttatccccgatcagggcagtccacccctgtgaaaacgtgagattgacgtcgttgaaaagcgcctcagggctgtcaggataggtataggaaaggtgggaaatagtaagttgagtcatgcaaacctcgcaaacacatctaacaatcaacaaaaaacaacagatgatcgtcttgaaaagacgtgcttacttgcgcaagtttgcagcctccttattcagagccgtcgtgtagtacgtcccgtactggtcttatggccgaagctattgtatcgaaaccacagagcgctgcaaatgcctctacaaggtccccatatcgcggcgcaatatggtcgcctcataatattttccgctctcacgtactgattgtgagtacaatgttctatattgcatattgctagctcgaatatacgggcgttctacttgtctacacacgagaaagggtcatcgatgaaacctcgacctcacagtcgatgacccctcggtgctccttgagcgggtgccgcggggtacccgaaaccaagcatccatcaaggagtcccaagtatgatctatctctcccaactcctcggcaacccggtctacgacgtcgatggtgaaaatatcggtcgcgtcaacgatctgggcatcgcgacaggcgaagtattcccacgggttacctcgctcgcaatcgagggtcccagtcgtactccgttcatgctatcgtggcgcaaatacgtcgacacatataacgaacacgaagtccgactgaacgtgatcaagaccgatacccgcttcagctacctacaacccgacgagatcctgatgtcgcgcgacctgctcaacaagcagatcgtcgatacgcggggcgtccgtgtcgtacgcgtcaacgacctcaaactttcagataccaattcttcccagctgcggctgctcggtgccgaggtcggtatccgcggcctcctgcgggctctctccccgaagcttgagcgctttgtcttgaagatcgcccatgcgctcggcaaggacatccccgagaagatcatcgcctggaactacatggacctgctcgaccgtgacctttccgatgtgaagctctccgtcacccacaagacactcgacgatatgcatccggctgacatcgcagacatcatcgaacgactcgatccgaggctccgtggtcagatcttcgcccagctcgatgcagagcagaaggccggcactatctctgagttcgacgacgacacgatcgccgccgacatcatgtctggcatgaacgactccgatgcttcccaaatgctctctgagatgggcccggacgatgcagctgaattggtcagtgagctcgattacgacaaggcagagaaactgctgcgcctgatgggtgtcaaagagcagcgcgccgtgcgtcagctcttgggctacaaagaggacaccgcaggtagaatcatgacatccgaggtggtggacctctacgaaggggacaccgtcgaggacaccctcaaagtgatccggaacctcgatgaggactttgagactgtcacctacatctatatcaaagacagagaggaccgcctgagcggtgtgatcccccttaagactctgctgctcgctgatcacacgtcctacctcaaagacattgccgaaaccgaagacatcaagactgtgagccccgacgacgaccaggaggaagtcgctgacgatatcgtcaagtacaacctgctcgcaatgccggtcgtcgacgacaagcaccacctgcttggtatcgtcacggtcgatgacgccctcgatgtcttaaacgaagagcacgccgaggacctgcagattgcaggcgccggccacaacgatacctcctccgaaggccgcaccggcgatctcacctggctgctgcgcaatggggcttggttcctggtatggatgatcggcgtcctgatcctttccgcagtactgcacgaccacatccctcaactcgatgtgatcacgcttgccttctgcatgccaatcgcagtgatcgcgggaaacgacgctgcagcctacgtcacgaagaactacttcgaatatgattcggacaaagatgcgccgtctaccttaggcatggtctttaagggtgtaggcttaggcctgctcgtcgctttctttatcgtgcttgtcgccggcagcattgtgaccggcctcatgggggcgacccccgaactcaccgcacgcggtgtcggcgccgcagcaacagcagcctttatctgtttcgcgctctccccggcagtcttagcctggatcagaaaacgcgacgaagacaataaggacacctccggcgcaacgatggcggtactctacatgatcctgtcgcttgcgatcttcttcgcctacgtctctatctcactcttcgcagtgggagcgtgagcgcgctatggcagacaacaaccagacgcaaacgacagatacgaacactaccacaaccgcacaaccgctgagcagaaaggcaaagttcctcgcaatcctgggcgccatgggccctgggatcctgacctcttttgccggcaacgacgccggcggaatcgccacttactccactacgggcgccagctacggctacgggatgctctggaccatcccgctcatgtgcctgcttctgatcgtggtacaggaaaccgccgcccgcatgggctgcgccaccggcaagggcttcgcctccctgatccgtgaacgcttcggcgtcagggtctccgcaatcgcgatgctctcgctcatcgtttcaaactttgccgtgtcgctctctgagtttgccggcatcgcctcgggcatgcagcttttcggcgtccctctccaggcgagcgtgccggtcaccgccgcagcctgctggatgcttacgatgggcggctcctaccaccgtatcgagaagatcctgctgagcatcagcgcgatctttctgacctacatcatctcagcattcatggcaaaaccggactggggtgcagctctgcaggcgacctttgtaccgacagtctccaatgacctcaactacgtctccctgttcgtggcaaacatcggtaccacgatctccccgtacatgatctttatggtttcaagcaacgtcgtcgagaagaacctggatgcgtcaggcatccctgcccaacgtgcagacaatacctccggtgccatcgcggcagagctcgtgagctggttcattatcctgaccaccggcaccgtcctctatccggaaggggtgcaggtcaacacggctgcagacgccgcaaaggccctcgtccccttcgccggtgagaacgcttccatcctctttgcaatcggcttggtcggtgcctccttcttggcagcctgcgtgttgccgggcatcaccgcaagcgcagtgtgtgaggcctttggctgggagcgtggccctgaccggacctggcaggaagccccggcctaccgtggcatcatcactgcgatgatcatcctctccgcagtcgtggtgttggttcccgatatcgacctcttcgggatcatgatggtggcgcaggtgatcaacggcgtgatcttgccgatcctgcttgtgtgcatggtgatcatcgcctcgagccatttcattatgggcaaatacgccaatggccgtgtctggaacttcctcacttggttcattatcatcctcgtgacggtcctcacagcgatcatgttcgtcctacagctgatgggttactgacacacaggggataatcaagaaacaaaaggtttacacaaaaagggttgtcaggaacctgatgcgtgccctatagtttgagctatgcaagcaaacgattcacgagggagagaaacgagggcgacgatgtcccagcttaccaacaagcagtggtggtggcgttgcactcgtatgctcggtcaatcatgagtcttgcacgctgataatagataacagtggaaagaggactctgggattgaccagagccctcttttttcatgactaattaccaggaaaggatacccatcatggcacaagcacagggaacccatcagcaggcacgcaccgtcaccactgaggaccacggcaagctcaacatccgctcgctggtcttactcgcgatcctcttagctgcgggcttcatcctaaacttcacgctcgggcgagcgatcagttccgtcaccggtggcatgatcagccctgagttcattatctccgccttctgcctcacgatcctcgtcgtacgtccgaaggtcccacaggccctgatcatcggcctcatctccgccgcagtcattcagctcaccaccacctccccgggtgtcgactttatcgctgagagcattgccgcaatgctcatggccgtcatcgtccgcgccggtatgaggaccagtgccaggaaggccatcccgctagttggctcctttgtcaccaccgtggtctccggcgtgatcttcatgatcatccgtattgcaatggtcggcgccgcacagcagctcgctgccgctatgctcccggtcgtctttgcaacgggtgccttcaacgcgatcctggtcgctgcgctctatgtcccgatctgcaaggcactcaaggtgcagccattccaagcagagtgactatgatctttgtactcaagacaatgtgaggatatgggttgccccacggtggggcaacccatatctttgtgcattacactcactttgtcgcacaatagatgagcacgcgtttttagtgagtaagaaaggcagccatggagagacccatcatcgatatcaaggatgtctcattcacctatgccgcaacggacgagagcgaagatgtaactcctgccctctcccatatcaatcttaaaaccaatcccggggaatttgtgggcatcttaggcccttccggcgcgggcaagtcgacacttgccgcgatcatgtccggagccatcccccaccacttcaaggggacactctacggctccaccctgattgagggaaaggacacctgcgatatctccctcaccgatatctcacagacggtagggtcagtgctgcaggatatcgacacgcagatggttgcctctgtcgtcgaggatgagatgctcttcggcctggagaacttcggcgtcccacacaaccagattgagcaacgcatcaccgataccctgaataccgtcggtatcgctgacttaagagaccgcgaaatcgccacgctctccggcggccagaagcagaaggtcgctatcgccgccatcctcgcgatgcagccgaaggtgctcgtactcgatgagccgaccgcggcgctcgatccggcctcttcaaagctcgtctttgataccctgcgcgacgtgcacgaacagggcgtcaccgtcatcgtgattgaacagaaagtggccctactctcccagtactgtgaccgcatcgtcgtaatcgaccacggtaagatctttctggacggcacccccaagcagaccttcgcccacgcagaggaactgcgtaagctcggcgtcgacagcccgcgcgtcgcgcgcgtctcaaattcgctggcccatgacggattcattaagccggggcatccctgtctcgacgttccggaagctactgcaatggtcgagcagttgatcccccatgacctccttaattcagacattgtcgaggatgacgacccagtgtacaaaggctccaagcacgtcgtatcgccccgtccccacgcacaggacgcagaaccgatcctcagtatcaggggcgtcagctttcagtaccctggaggcggcggccgcgtcgacgacctcaacatgtccgtctatcccggtgagatggtcggcgtgatcggccagaacggcgccggcaagacgaccttgatgaagttaatctgtggactgctgaagcccaatagaggcaacgtgctcttagccggactcaacacccgcgaggtccccacgagccgcatcgcgggccattgctccattcttttccagaaccctgactaccagctctgcaagaacaccgtgaccgacgaggttgcctttggtctcgaactgcagggtgtggacagtaccgaggcacgccgccgcgccaacaaggtgatcgaacgcttcggccttcctgccgaagagtcccccttctcgctctcacgcggacaacgccaagtagtcgctctcgcctccgtcgtcgtgatgcagcctgatcttgtgctcctcgatgagccaacaagcggcctcgattaccgcgagtgtatgaccgtgatggatacagtgagtgagatggcaaacaacggctgcgctgttgttgtggtttgccatgacatggaggttgtctccgactttgcggagcgcgtgatggtgatggcaaacggaaagatccttggacgtggaccaacccaacagatgtttgagaacgcagacctgatgcaccaggcctacatccaggccccgcagatcgtgcaactctcgcaagagcttacccacaccgtaagccccgaattctctggcatcagccaggtgtccggcatggtggatttgattgaggagatggtgagacatggttaatgtaatcgactatgtgccgggtaataccctgctgcaccgcctcaatccggtgacgaagttagcgattgccgctgcgatcattatcgcgacgttcttggcgcagacctattcgatgctcattatccttctggccctaacctttggtttaggcttctatgcgcactcggtctcaaaactcatgtcgctgttgaagctcctcatccccatcgcgatcatcatgctccttttgcagaccgctttcgtccgtgacggcaccctcgtgatttggtggatgacggacgtggggctgatcaccggctcaaaggcttgccttagattgttgggtgtagcgttgccgttgatcctgatgctctcagtcaccaagctgaatgatctggctaatgcctgtgtcgaagtgcttcacatcccctatccctatgcgttcacctttacgactgcgctgcgctttatcccagtcttcagccaggagatgaactccatcatggaagcccagaccgcacgcggtgtggaatttgacaccaagaatccgtttaagaaatttcagttgatgctaccactggcgataccactgctggtaacttcagtgggtaaaaccgacggcactgcactcgccgcagaggagcggggattctatctcaggacctgcgagagcagtttcaagcgctaccccatgaagaccgcagactacattgtacttgccctttgcgtcggtctcgttgtactcggggctttcttctagtcgctcttgacattcccttaaactaaagtctcgctgttagaccatgattgacctgacgcccctgtcgacgcccctgtccttccaatagctccagaagggctgctccatgtctatgagcacacgcctggtatggacatacctgcctcctgcaagcttgcctgagagtatatccttcttctcccgctcagaatgccttacctgctctatccacagaaagcaggcaagacaagtgccccagccacttcgtagaagaccccatggaagaaaagcaggaactcgcgcagccttcgctgcatcgcattgacgaggctaagctcgccgtgtgcttgaagaccccaagcgaggagagccacgcgcatagcctgcatgggcgtcagtggcgacccataagctgtcgacgatacctgaaagggcatctgtcagcttcccgtcctcgggtctgcccctgccgcagaggatggcatattcgtcgcttaagtcatttgcgcagcaccccacgcagaccttcttgttcgatatgccacggcaatgcacaacatggccgtgcgtgtgcgcctttctcagcatctggatgttgggccttgccctgttgttcgcaagcgactcgtcgagatagatcccgatcttttggcaggagacggtgggtccatacctgaaggtgccaagagctgcctgcagcagctcgaagagcctcatgcgcataaaaccacaatgtccttaaggctcacatggcagctcttcacaagctcctttaagcgtcatgcctgcaagcgtgtcctttgcatatgcggcctatgtggtggccgtgggcttggacatagccaggacagatcttgtctttacaaagaaggtcttgcctcacgagcaacacttccatctcttaaggccacacgcgtcgtggcccttgcaatagaaactgagcgatttgcacctcgagcacctcttgggtgttcccgcaagtgccgagcctgccatcttcttggctatgagcgccttcagcctctctaagagctcgcgcttatcggcgatccccatctttttgatctgctgcagtatcattggatccatccggggcctctgctccacgatgactttgtttgacgacatacattgtaggcaaaggcccggacacttttgggcccttcttaggtcaattatggtctaacagcgagtcttctctatgaacaggttggtgagggtgcgtggcgctttgagcatgcagtctcgcacacgccgactccctttgtcggctacctgtcggaacttgcctgtgtctagtcggcttttcagatacgccaagtgcctgttgcaatagtggttggctgacttgagttatcgcctgccaactaagcgcccatggccggaggtgagccgtacggcgagattgtcagcttctatatccactcccataacacagcactcatccaagctaaggggctgctgggctttaagcacatattggattttgaaagcagctgttggctgtttaggaaggatacccttgatacactgccccatccaaacgttcgacatggcccggataggtttgtagaagctgcctgtgagcgggcagcctctacaacccgttcgtgggaagtatcagcaaaaacacgccgccttttgccctgtagtgtgagatcaacacttgagagtagctatagtcgccactcttgcatctcctcaatactgtaggggaagcttttatgctataggcgacaacctttatcgtgtgtagggccccttaggcttgcagcatcttgtaggtatcgttggttttgcacagatgatagttggtctttcagctgagaagcccgtctgcaatgaagagatgctgtcttgtttgatacaaagccttgctgtagaggttgttcgcatataggtaaaggcatttcaacttgcgatagtggttggcgctgagatggcagctgtagttggtttgcgctccatactgcatgcttgtcttgcctgcctaaatatcgatagcttgctgtatgcaatatattcactgacacctaagagcaagaagcgccaccttgaacaatcactgtgagccagaaaacccttcgagatacctgctttgctgccacctcatcctttccaccaactatcaaaggaagacactcatcacttaggtgatgatcacaaacatcacttagctctcactaaagaatcgctctgcagcacaccatccaaatacttcacatgcaaaccgacaagagggggtgtccctatagttctgtcaagtcgtagcaggtgacttttctacatcgcccgccagcggctccacgtacggtacccggtcacgcatcattgcatagatgacacagagcctcttgcgagcgagtgccttgagcgtcttgctgtgcctcatgccccttgcggtgccaagcgtcgtagtacctcccgaagcgcttcttcgtccctacaagggagttgcagctgaatatgaggaggttcttcagctccttgttgcctttacgggcgctcttctgcgaccttatggacgatccggagtcgtggtctgcaggagcaaggccgcagtatgcggcgagcttgctgtctcttaggaagagcgaggtggcgagcaccgaggcgctcttgggccctatgcccgggatggtgagcaggcagcggtaggtcttatcgtcctggggcaggcggcccagcttggagaagagctccgcccctctcggaatcggccgcaaggatctccctggccaggctgcttgccagcatgtcctttgcatcgggatggaaggccgaggagcccgagcgcatggacagcttccagaatgcgtcccttgcccgggcacgccctgcctcgcgcacagcgtgcagtagtgcctcctgcctgccacggcaaggctctttgcccctccatattcggccatggccgcgagctgccatgcgctcgagagctgcacggcgggctcggacttaagcagcaccgcatggagcctgttgcaggccggcgcgcctcgtggcatatgagagctgtaaggacactagcgagacgcaggtgctgaggtcgtcggtctcggctatcggcctgatggccgtcctgatcccgatccccgcctgcgcgatggcttcggtatctgttcggtcactcttggccgttccgggaaacatctcccgggcgtacttcatcgccttccccgggaaggtatctaacattaatccttttcgcgcaccacctgtacacgataagcgagccgatgttgttcttctggtccacaattgaccagggcgccctctcccgcctcgtcgagcagagcctcgacatcctcctggcacctgtcctgcctgcagctgatcgcgatggtgccacccgggctcaagcccactgcccggaggaatggcctccccacatctattccgagatagaagcgctgcggcccgaaccagtctttctgcttgcacttcatgatggtaccctcctcttttgccggcaggccagcgtgtctgaggggcggacatccacactaccctgccgtcacggcatgccgtgcggcacatccctatcagccgttctcggacaaaaccaccatcccttagcagcaacactccctgggccttcgtaagaggcaggggcggaaggctgtccggggaaggttagccagcagcccctttcagggccatctacaaggttagggaatccgcaggcacctcattgtcgaaaccccaaagctcgaagaggcccccaggggccgtctctcactgtaatggtacagacagaatcttggaaaattctgtccgcaccccccataaggaagctcaacgatgcacggataacacagcataggagcacaaaaagagccccgaagggctctcgagactgcaagtgccgcctacgcggtgccccggaaggagcttttttggctaaagccgtattttgactcgcagttacgttctgactggtaatcaggacgaattgatagtagcatacaacccaatacaagccaatgagacaaaatgagaaatttggcaaatggtcggaggaacgaacatgaatttccgcgattccctgagaactaccttatggcttggataggggcaccggctcagtttgctgggcgttaaccgatacagaagcgcatctgatgcactttaaacgggcctccgacctagggaagccttaatctttttccacggcaagcaccgctgccgaagccctctcacacacatcgaggacagcgccgcgtttatgaacgccgtcgtcagcgtatagtatgttgtccaggatttctttaaaggacgaaatggataaagtcgatccagacttttttccttaggctcaaccagtccattgttgtatgttagaagaccgcgatgatcacatctcatcgatgtgttgccctcttcaacgaaccagggctttcactataaagatactactataagtatccgaccatataaccacttgcgtaaacgccttttgatctaataccctacaaggctgatatccgccttgtatatttggcgctacatcacatccgttaagcccaccgtggggcaattttcttacatcaggaacaacataagctctccgtgccagcccctccgatcatgtgggctcggtccgagcgtttcttgaaaagcatttgtggaattggtgtgacaacaaggatatcagtacatccctgagcggggacgcccgacgcctctcgatgaataccgctcaaagatcacggcaattcttgaagaatcctcatatcagcagagggcgacaatacaaacaattctctcgctgatctgctcaataggaaaaggcgaatacaaaaagagctgtcgctgatcactcgggcaaggcgccatcggtttaaggtggacctaacacgacgtttttagcattgaaggggaactgaacttataagctttaatgctttcttgaaggatgagaaagtacaagaaagagttaaatcatgccatcgtgaccatgatgactgtcagtatctaggagatttgaaattctttcaaatgataatactaccaagcctatataaccttagcgcaaa

SEQ ID NO: 363 - DNA, 64230 bp, Unknown
  Metagenome-assembled genome
acaaatcgtcgcttgcacaaatctcccccctcagttatattactaagccgcacctgaaaaggcgcatgagtagtgcattgagatatcgtctaatggtaggacagcggattctggttccgtcacgggactttgacacttagccgacaatcatcgaaccaattcaagccacaaatttctggatctacctgggatttgtggcttttcttatacgtcggtttatggtagacgtatctgtggtatttggtgtcagttgcatgtggattgggtaaagatatgaaggttcagctaacaaggaccaagaccagcgagaccttctatatagccaagacctatcgggacaggaagaccggcagatccacctcaaagatcgtaaggagactcgggactagatccgagattgaggggatgctccccccgggcacggacgtgatgggctgggccagggaagaggcaaggcggatgacacaggaggagcgcgggctcacccgcaaggtcacggtgtcctatgaccctgcgaggcagatagctccgggcgagaggcgcgcctccaacgtgggctacctcttcttgcaggacatctactccgcactcgggctggacgggatctgccgggacatcgcctcccggagcagggcgggatacgacctggactcgatactctccaggctcgtgtatggacggatccttaagccctcatccaaaagggccacctccgaattcgccaaggagctcctcgagcagcctgccttcgatgcccatcaggtctaccgggccctctcgggtgttgcaaagcattccggggagatccaaaggagggtcttcgagaacagcaggaagatgctcagccgccgcctgaagacgatgtattgcgactgcacgaactactacttcgagatcagcgaggaggacgacttcagaaggtatggcccctccaaggagcaccggcccaaccaatcgttggcatggggctcatgatggacaaagacggccttcccgtggccttcgacctctacccaggcaacgagtccgagcagcccaccctcatcccttaggaggagaggctcgaaggcgagttcggcctctcgaagttcatcgtctgcacggacgccggtctctcaagcgtggccaaccgcgcccacaacagcaaaggcagcctccagttcgtcaccacggtctgcctcaggggccagaggaaggaggtcaaggactgggtgcgcgatccttcaggctggtcgtgcacaggcgaggcgggcacgttcgacctcgaccaggtccggaaggcggcagtggaccccctcacgcccgagaagacgcgccgggccctcttcgctaagaccttctacaagacaatgtggacgtccctgaaggaccctgcgaccggcgaggagctggggcagaacctgatcgtcaccttctccctcaggtagcgcgcctaccagagctccatcaggaaggcgcaggtggagcgggcgcgcagggcctgcgaggacgggacggccaagaggcagcgcaaggggcccaaggaccccatgcgcttcgtctcctccacctccgtgaccgaggagggcgaagtcgccgagaggtgcatcctctccgtcgacgataggaaggtcgaggaggaggcctcctgggacggcttctacggcctggctacctcgctcgacgacgaggatgtcctgggcatcgtgaagctcgccgccggacgctgggaggtcgaggagtgcttccgcatcatgaagggcgagtttgaggcccgtcccgtcttcctctcgcgcagggaccgcatcgaggcccacttcctcacctgctttttggcgcttctcatctaccggatcctcgagaagaggctgggcggcaggttcagctgccctgtgatcgtcgacaccttaagaggcatgcagatggaggaggttacaggcgagggctggcgccccctctacatgaggaccgaggtaaccgatgcgctccatgatgccttcggcttcaggaccgacttcgagatcgttcctgtgcggcagatgaacaagatcgtcaggaagacccaccggaagggcccgattaccacaaagaaggaggctggcaaggatatcaaatagctatctctaccagcccttatgtgcaagctatgtacggttaagtgtcaaagaccggattatgacccgtaggggttcccatcggataaaaatcagaaaagaccgaaaacttcgggtgagactatggggagaatgtgatgaaggacggctctcgcgcagaattttcgatattatacaaatcgtcgcttgcacaaatctcccccctcagttatattactaagccgcacctgaaaaggcgcatgagtagtgcattgagatatcgtctaatggtaggacagcggattctggttccgtcaatgggagttcgactctctctatctcagccatatggcccgttcgtctagcggtctaggacgccgccctctcaaggcggagatcagcagttcgaacctgctacgggctaccaaacgtacaaccccgctcaaagcggggtttcttttagaccttgagacttagggggcttaagtcacgaagacggagatcagagcggtcacggctgacgatattgcaccgcttcggaggatctcccgcgtcaccttcaagaggaccttcgatgcggtgaccgctccggatgatatggcccgcttcctcgataccaaatacgataccaacgtcttgcgtaaggaaattgaaaatccggagagcaaatttttctttctgctcgtcaatagtgccgttgccggctacctcaaagtgaatgtgggatcggcccaaacagagcacatcgccaggaatgcactagagttggaacgtatctatctggatgccccctatcaacaccagggcttggggaacctgctctacgataaagccgagtccattgcccgcgcaaaatacaaatccgccatgtggctcggcgtctacgagcacaatatccctgcccaacacttctaccgcaaaaaaggctttaagcgcatcagccagcatatttaccaggtgggagacgaccctcagatcgactacctgctgatcaagtatctcaactaatctgtcagctctgcagcatgattgcgaacgaagctgaccagttcgtcgtgattgttcgaaacagctccggccgtcacctgatggagaatctcattcataacattaccgaccttaggtccgggttcaagcttcaggagctccatcgcttcacacccagagaggacaagctcagccggcttcagcggaagcttctctacacacagcccagtgagcagtgtctttatggtggcaatattttttcggcgttcatccgtccagcgctccacaatcgagcgcgcctgccacagctcaaccagttgaaaactcagcgggaagccggatccctttgacatccgttcaagctcactgaccaggttgagcaccttctcacgcgtcactgattttctttcaagcaggtctgcatcagcttcattctccatgaggagtgcctcgacacccgccaccacttcagtccgctgtgccatccgcttgagcgcattctgcgcctctttgaccgtattctgagagaacagggcagcccaacgaagcgtctgagggcagagccctcctgcgagagcttctatgagggaggcctcttcacagagcacctcccactgctgtttcgagagtttggcaagctcagacactgccgcacgcagcacgatgtgctcgtacttcagggcccatcccaatcgtttgctctcaaggatcctgttcagttcctgtccgatacgttctgaggcgatgagggcaagctcaccggagcattcctcaagtgcttgctgcgtctccggatcgatcacaaagctgtagcgagcggcaaaccgtaccgccctaaggattctgagggcatcctcgtggaaccgcttctgtggatcccccacggcacggataatccccgctgcaaggtcttttctccctccaaaggggtctttgagtccccgtatcggatgccaggccatcgcgttaattgtaaaatcacgccttgagaggtcttgctcgatcgtgtcgacaaaagtgaccgaatccggatgccggaagtctgagtaggtgctttcagtgcggtaggtcgtgatctcgatcggtttatcgtcgaccaccgcggtgatggttccgtgggcagtcccggtctcatgcacgtcgatgcctgcttcacgtagtgcttgttcgcttttcttccagggtgcgtttgatgccatgtccacatcgtgcgccgggtcccctcgcagggcatccctgacccaaccaccgacaatccaggcttcccagcctgcatcttcaagagcggagagcacccgcatggcataggcaggcaacaggccaggggaaagcgttttcggcatagtcataggacagatccttacagcaacaatcaaagcggactcttaagcataccgcaagctgtgggcttgttgactcaccggtattttaagcctcttgtctgatatgcttgtagaggtcaattatagaaaggatcactatgacacctgatacgtcaatcagcgcgcaggatctggagaggtcgaaagacagcttcttctccgagcgcgccgatatcgtggcgaagaatgccgtaacctcacaaggtatccgtgccgccgcacgcgtcccggaggctgtggcaaagaactcccttgacttcgatatcgacctcacccagggcgagcgcactgaccagatgcactccggccgctgctggatgttcgcatcactgaacaccatgcgctatcgctccatcaagaagttcaacctcaagacctttgagctctcacaggcctatcctctcttctgggacaagctcgagaagagcaattggttcttagagaacattatcgacaccgttaaggagcccctcgacggtcgcttagtctcctacctcctcaccgacccgatcggcgacggtggccagtgggacatgttcaaggctttggtaaagaagtacggcgtcgtccccaaagaggctatgcctgagaccgcctgctccaagaacacccgtgagctcgacatgtacctcacccgctacctgcgcggcgccgccaagcagctacgcgacgcagccgaacagggcaaatcagcggacgatctccgcgctcagaagaaggccatgctcgaggacgtctaccacattctcgtcacctgtttaggtgagcctcctgcgtcctttgaggtgcgcctgcacgacaaggacgacaagcttgtcctgagtggtaccttcaccccgcaggagttctttgacaaggccgtcggcatgaacctcgacgactacatctcgctcatctctgcccccaccaaagacaagcctttcatgcacacctatacggtgagcagactcggcaacgtcgtggaagccggcggtgtcaagtatctgaacctcgaagccgaagagctcaagcgcgtcgcgatcgcccagctcaaggacaacctgccggtctggttcggctctgacgttatgcagagctaccttaccactgacggtatcatggacaccgccgcagtggacgtcgattccctcttcggcttcccggtggagacctgcctcgacaaggccacgcgccttgactacggcgagagcctgatgacccacgcgatggtgatcgaaggcgtgaggttcgattcggacggtcagccgaccctgtggaagatcgagaactcctggggcaaggaccacggccgcaacggcttcgataccctgaccaacccctggtttgacgagtacgtttatcaggtcgtcgtcgataagaaatacctgaccgaggaagagcgacatatttttgagactgagaaaccgacggtgctacagccgtgggatccgatgggctcactggcgctttcagattaagcacaacaacaaaacattcggcatacgaaaggatttgagcgaagaactatggggaaagcacttgatcccgactgggcggcacaacagaaccaagagtttcaggagagccgcgccaaccacatcgcccgcaacgcggtgaccgccaccaacgttatgcaggccgcccgtgacacctccgtgatgcgcacctaccacgacacttacgggatttccatctctaagaccggcgacatcaccaaccagcgccagagtggccgctgctggatgttcagcgccttcaacgtcgcccgccacgccgcgatggactatctggacgtcgacaccttcgagttcagccaggcctatggcatgttctacgacaagcttgagaaagccaacgcgatgctcgaacgcatcattgagaccaaagacctcccctacgacgaccgcagcgtctgcgagatcttagacaatgggatgtccgatggcggctactacagcttcgcgatgaacttaatctccaagtggggcttggtcccaaaatccgcaatgcccgagactgcagcctccaagaactcctctgagatggacgcgcagctcaaccgtctacttcaccgtgacgccgggatcctgcgtaaagcatacaaagacggtgctagcgaagagctcctcaagtcccaaaagggcgacatgctggacgaggtctaccgtgtcctcgctatctgcttaggcgagccccctgcgaaattcgacctcgaggtcgaggtaggacccaactgcaaggctgaagaatccaagatccaggaggtcaccccaaagcctgagcacgaggacgccaaagatagcaagcccaagcgcatcctgcgtgatttcgatatcaccccactcgagttcgcgagccactacgccccgtttgacccgaacgactatgtcgacctggtctccatgccgggagacgcccgcccctacggccacgcctaccacctgacgcttaccgactccgtcgtcgacggcaagccgaaccacctgctcaatgtgaagtcagaggagctcgacaaggcagccatcgcatcgctcaaggccggtgtgccggtcagcttctcctgcgacgtaatgcagcagttcccgcgccacatcgaggactacaagtacatcctctccactgacggtatagacctcgatggcctcttcaacgtcgagttcaagatggaccgcgcctcaatgatcgatatgcgtgagacctctctcacacatgcaatgacatttgagggcgttgaactcaacgagaatggcgctccgaaagcctggaggatcgaaaactcctggggcaaggatcagggaaaagacggttatctgatcgcctccgccgactggttccacctttacggcggcgaggttatcgtacgccgcgagttcgtggatcctgagatcctcaaagcctgggatgagacccctgttgaggacgtcactccctggagcggcatggcccaagcctatggtcgcaaccgccagtagttccacccagacgtagacccgagctattacaaaggcctcccacgctgagcgcgggaggccctctactaacatatgtctttacagggcgaatccacattctaagtgcaacaactaattacgaggtagcgacccacgcacgaccctaaaatggtgcttgcgaagacatcaccttggaggcaggcatgggccgctacagccatcttagcatcgagaagcggagaagcgcgaggacatcatggtttgctaggggtgtccctatgatgcccttctaattgtcaagccgtggcaggtgacttttctgcatcgtccgccggcggctccacatacggcaccctatcgcgcatcaccgcatagatgacacagagcctcttgcgagcgagtaccttgagcgccttgctgtgcctcatgcccctggcgctgccaagcgtcgtagtacctcccgaagcgcttcttcgtccccacgagggagttgcagctgaatacgagcaggttcttgagggccttgttgcctttatgggcgtcccttcgcgaccttatggacgacccgaaatcatgatctgtgggtacgaggccgcagtatgcggcaagcttgctgtcccttaggaagagcgaggtggcgatcgaggtggcgagcgctgaggcactctgaggccctatccccaagatggtgagcagacaccggtaggtcttatcgtcctggagcaagcgtcccagctcggcggagaactccgccctctcggaatcggcctcggcgatctccctggccaggctgcttgccagcatgtccttcgcatcgggatggaaggacgaggaggggaagagcgtgggacagcttccagaatgcgtcccttgcctgtacaggcacgccgtgcttggcgcacagcgtgcagtagcgcctcctgcctgccgcggcaaggcccttcgcccctgcgtattcggccatcgccgcgagctgccctgcgctcgagaggtccgctgcggctcggatttaaacagcaccgcatggagcccgttgcgggcaggcgcgcctcgtggcatatgcgagctgtaaggacaccagcgagacgcaggtgctgaggtcgtcggtctcggctatgggcctgatggccgtcctgccgccactccctctaccgcgcgatggcctcggtatctgttcggtcattcttcgcgattccagggaacatctcacaggcgtacttcatcgccttcccgggaaggtatccgacatcgatccttttcgcgcaccacctgtacacgataagcgagccgatgttgttcttctggtcgacgatgaccagggcgcccgaccccgcctcgtcgagcagagtctcgacatcctcctggcacctgtcctgcctgtagctgatctcgattgtgccacccagtttcaggtccactgcccggaggaatggtctcctcacatctatgccgagatagaagcactgcggcccgaaccagtctttctgcttgcactccatggtggtactctcctcttttgccggcaggccagcgtgtctgagggacagcatccacactaccctgcttatcgtgaggcacatccctatcagccgttctcagacagaccaccatcccttggcagcaacactccccgggtcttcgtaagaggcagggacatacggctgtccggggaaggttagccagcagcccctttcagggccatctacaaggttagggaatccgcagacacctcattgtcgaaaaccccaaagctcgaagaagtccccaagggctggctctcactgtaatgggttctttgggaccatgaagagcaagatgctctatggaaggggctggtcagccgccaccctggatgagctggaggcaaagatagacaaatatatcgtctgatgcaacgagaagtgccagaaaatgtcactcgcaagcatgagcccactccaatacaggcacagcttggggctcgcggcttaggagatacaggcacgaattcccgttaccacccctgctgtacaacattagcttcctctaccgagtgtattgcacattctgcaagcctgaaatacaggcatgcaaccctccagccaaaaagaagtacaaaaaggagccagaccagcgcttgtagtgtgctgatctgactccacacagagggaagatgcacgcgtatcagttgattgatcggtgaagctactcctatgcgagcatctcctgaagatccttctcaggcgtagaaatcggggcgatgtgatacttgtcgaccaagatcttgaggacattcggtgagatgaaagccggaagcgtgggtcccagatggatgttctcgatacccagatacagaagtgtcaggagaatcgcgacggccttctgctcgtaccaggagatgttgaaggagagcggcagctcattgacactgcagttaaaggcctgagcaagcgcaagggcgatctgaaccgcaccgtaggcgtcgttgcactgacctacgtcgagaatacgtgggaagcctgcaaccgtacccaggtcaagatcattgaagcggtatttgccacaggccagcgtcaggacgatggaatccttcggggtctgcttcacgaactcggtgtagtagtttctgcccggacgtgcgccgtcgcagccaccaaccagaaagaagtgagagatcttgccgtctttgactgcctgtacaatatctcctgcgtgggagagaacagccgcacgaccgaagccagtcgttacctggtgaccaccgttgatgccggtcatttcgtgcttcttcggatagccgccaagcacttttgccttctcgataatcggcgtgaagtccttatcctttccgatatggaccagacccgggaagctcactacatcagtcgtgtagacgcgatccgcataggagggacggggcggcatcagacagttggtggtaaagagcaccggagccgggatatccgcaaactccttctgctggttctgccacgcagtgccgaagttgcccttgagctgcgggtatttcttgagctctggataagcgtgcgccggcagcatctcgccatgagtgtagacgttgacgccggtgcctttggtctgctcaagcaacagcttcagatcgcttaggtcatgaccggagacaacgatgaaggggccaggctcgatatcgagcggcacctgcgtcggctcaggatcgccgtaagtctcggtattggcctggtcaagcagcttcatgcaggcgaggtttgccttgcctgcgttgagtgcggtctgcagcagctcatcggtactcatatcgcttgccagggcgcgcaggccctctagaaagaagttatccacttcgcggtcacggtagccgagcagcgcggcatggtgcgcataggcggcgatgcctttcataccgaagaggatgagggacttgagtgaacgggtatcctcatccgcgttccagactgtattcatatcgaagtcgtcgagtagcttgtcagtgatgcactccttgatgaggcaatccttgagagtatgaatcgcgttcaactcgttcttgatcgactcgtcgtcgaagttcacattcgtcagcgtcatgaacagcgaatcgatcagcgaatcccaggctgcaggcttaagctgtgcgtcttgcggcaccatctgcgcaaaggcgacaagcgctccaaccagctcatcctggtcctgcgctacctgtgcactttttccgcagacgccagccttacccatgcatcctttgcaggcgagtgtctgttcacattgaaaacaaaacattagatctctccaatcaacatccgtgtttctcgagccagtgcttcgcgtacaagcagtcaggtctcacgcgcgagccacttgtatggatcagatccaccgcacggctcatgagctttccagcaatgccttggccccgccgttgctcgcacacatatgtgtgcgtgattgccacggtggttgagtcaacacgcttcatatcgaggcgcgcaaccgttgcgcccgtttcatcgatcactttgatgccatcctcagtcgccatccatgtcaaagtatccattgtgcccctctcgccgtgctcctttattagggtagcaatatcacgtccaagatatgttgtacagacaacatttagtcgggctttcgcataccagaaagcctataaccgagatgagggaaaaccaggaagcgggaataatcaaaactatcgtgttcgatgtgggcgacgtactgatgaagctcgacgcgatggaattgtgccgaatgctgaccggcaatgagagggatgcccatgcgatcgatcagattctcttccaccatgtcaaattgcagttcatggacaccggtacacttaccgagcacggcgccctggtgatcgctcacgcccatctcctcaagcgactgtggaaggcagccaacaccgcgctagccgactgggacctctactgcacgctgatatccctgagacaaacgagctggcggcgatgctcctgacgcttctattggtgtcaatccccaagccgatcccatagagaaacggactaaactagaacacaagaaatataatacgacagtgggttagagcagctgaggagaatcacattgtctaaatcgtatcccttcatgaccgatggagaataccgcttggcgctgaaggctatcagatcgtatatcgagacctccgtcagcagctatgatcccggctatcaggcgctctatgacgcatgcgaaaggtatccgtttccccagcccgaagacctcgataaccctgcattcgagagtgagtctacgtctccctatgagcaggcagagcagcacatttcccgtgtcagaccgacaagccaagaggtcaccctcgcagatcagttgtggctcatcggaagaagatgcccacctccagtgcagcgctatcactatcggaattcctttgtgagaccgacagaacaatatcttccagacaaggagcatggctcgttctatggtgacatcgcactcttgttaatgaggggcccaggaaaggacggaagtattcccgtggggtacctcagagattgtgcggtaccgctcactgaggacagagatgtgctatatgacggggattttttcgactatctgcgtatgcagtcggtcaggaatgcctgctacctattgaggaaggaatatcggaaatctttcttcttgcggttttataagctctatggtgagaacccatgggttacgtctcaaaagtcactgatcgacacaacggcacagacaacaaagctgattgcccagttcacccagctgattatgagcgcccggctcctgcgagatgccgcgattctcaaagaatcctcgatcatcctgaaagaccctattcagagagcccagatatcagctgatctcactaattggaaagaggtcctcaacgactggagggacacgatccaggaagggaaacaatccatctgcatctccttcagcagcaagcttctccacttccaatgcccagagcgcttcttcctgtttgacagcgtttcctcgaacatgactacgggccagaatggcatgaccatgcgaatcccaacaaggaagcatcctgaagggttccagattatcttgagttttgacaaaacctggacgaacgaagttgtccgaaacgtcaactatgtcagtgccttgccaaagatcagcatgaggggcgatgaagagacattgcagcgctatttcgatcacgccgcaaaggagcttgcactcagtcagcttatcgccgatgctatggacggggaaccactgtcctggcctctcacccgcttgactgacctcctggtgacaaaagcatcgaagtgatccgacagctcattcaaggtaccttataaggatgtcataatgggatgaatactaagtaattaaatcttcatctgtacgtttggaatatacatggttccaggagaatcccagtgagtaaaaagaaaagtagagcagaacaattaggaggccagcctgcctagttcttattcgtttatgactttgttcagagcaagtgcaacgactggttatgatagacctcccagggggcacttccacccaggccacttgcgtggcctgtgattgagtccatcatacgccacctggacctccgcgccgctgacagccgacaggtcggcgcccttcgggaagtacccctgtgatgcccttctaattgtcaagttgctttcagcatgcgattctgagtgataatgtcgtaatagagctcgcgtgcaatgtatcgcttgatgcatcagatcgcctcgagcttggagtgtccctcgaatgacctgtgtcaatatttcggacggcagattgtcaaactgagtgcaacatctccctaaggaaacgataattaattcggctcgatgaggccagtggagctgcacactgtatgacatcggcttaaaaatgtctcgaaccacgcagttgcccatatccacatagatgcctatctgtctttctggatatggtatagctacagcaatgtattcctgcatatccaaaaggaagatatggacaggcagatgagcttttaagaccttaaatcctaaggtctgaggagaaagactgggtgagaggcactcctggagcggatggatgcgatcgttgtgtgggacagctggattgcactggtagataccagctaccgctgacaggctcttgtcaggcatgtgcgcgctgcaaagacaaagctttaggatgtatcctgctgcaggtcatgttcgctctcttaagacgagggaacttacagatgctatcctggattgctactcctggcagcgcttctgtgcacgcagacctcatgcaggcgcaggtgccagatgcaaccacggcgcggggtggctccatggtggatgcgaccttcacctgggccctaaagcttcacgaagaacaaggaccatgcacgcggcccttaaagcgcaccagtccaagaaagggaaagagtggcgtatcggatacaaggcgcatatcggcgtagatgccgcaggtggccttgtgcatggtgtggagacgatcgcctagaatgtatctgacatatcctgtagcacatgcactcgtaagggaagatgacaggttctgctgcgcagactttaggctaggctatataggtatagcgaagcgcccttaaggtcacagcagacccacacctctcatctgtgcgctggagtgtcgcaaggaagccttcgaccatagaaggtcttgcctgtgcgctcttctccgagaagggtatcgagtccaggaaggcatccggccgcttaaaggtagagcatcccttccttatcgtgaagcggcgcctcaaacacgtaaggaagcactacagggggatagagaagacctcctgtatgctcgagtctgcctcacccttgcaaaccttacccatgtgcatcttttgccggcaggctgcacctcccggctcccagcgtcgcttgatctgtcttggagccttattgcggtgcatggggcaggacagatgtaaggatagtggctcctgcacgtgctggatgagcatctttccctgcctttcccgcataccggcctagaaaggccgtgtggccggtcccctttgacacgttatggggcattaatcatcgtttccctagattgccattaacaacatcccttgcagagatagcgctgcgaacccctagcgtcacacctggtgaactcaaggcatccacagtgcggacatgtggcagacttgtcggtctgcgctgccagcttctcggctatcatgcgcttgaggtcggcggtaagtgcgaccttctccttgcgggtcagctactttgctagttgtcgtatcatgtagagcatacggggccttcttcaagtcagtttcttggtcgaacccgattgtagggtgaccccgtgacatcttttcgcttccctatatccacagtggtctaacagagtcaaaatgaaagtgttatagacctactaagagactaaccaagcattctcattactctcgtgatgaagtgaccattgtgttcatgtccttcaccgaaacgtctctttatctcttccgtatacatcagatgttccaatcttttcgtctgatgtgcggatatttgtcagcaatcccttatcttgtgtcccccatgcagcagcacaggattttcagaacccaacctgtataatattgaagaacatgtagatgtaagaaaggctcaaatacgatgaggaagaaaagtaccgtatcgagacgaatactactgttgtggacaatgaaaccaagaactgcttccactcccgaggagcaagttaaccttgatctcaagagtctatcaattctgagcgcgagtattcccggcttggaccgcatatccccttagaacgaaccggaagggcatcaagaggtcaagacggcgcgagtatcccaagagcggaggcctgacccgagcgggacccaaaatcctctttcgcgttcaatgcgctttctgagatggcgctctcataggtgccccaccgctaagtgatacgatgatgagttgctacgcgccctctatcgaccccgaatgcgacgaggacgcgcggcgagcctcgtcgaatgctcggcgggaggaccaggattactctggcaggagaagcagcacgggcagactgttcaacacaacatctcctcgatgcggatccgacctacactctaatcatgtccaaaagtccacaggtcaatagtcactgaagctcagcgcgcccaacagcttcccgcgatcccgttcaaagatcaggcgccttcaacggctgctccaaccaaggcttacgccgtttggcgaggccagcgaagcaggctaacgcgactgggaaagctttgtgatccctactcgaccagatcgctggaaagcatcgcttcgaatcgcccaggaaatcgattccggcacgacccgcctacgatatgtggcctcgccttttccgaggaaggttactgccgcacgttctctacgatgcgtgtcttctcacaggtcaagagaccgttgtcgtccactcttggaatgatatcaagcgcgcccccagctttccgcttcacgcgccctgtgtgtgagggtccacttgaggcgaaaccgccaagttgtacctgccccaatggaaccagattggttctccctcgaggggcttcgaatccccgatgctatggtcttaaccagcatccgagcatcccttctccgactgtctacgacaactatgcgatcatcgcctgccgatgtctatgaggacctgtgctctccaacctctacaacgatgctaaacgaggaggggcgccactgcctctacgagaccggtgtcgatccgaaattcaactacacttctccttaagcagtgtggtttccatgggcccagcacgagtggcaatcccgcttacttcttcttcgagaaaccattcggcagagcaggtaggccccttcgccaccgacgctgttggagctgctccgtaagaactccccggtgcacaggtttgtgatgggtttcacgcacgtcagttctatcaggcggcaaaccgcgtcgagccgggattgtctgcgcacggaggcgacgacgagcttacctatccccatccactatctccttcagatcgagaagcttgctgatggccggttagatacatgaggcacgacccgtaccaagagagtgggggacgaccgatacaagaagtatccctcggctcaccgtccaaggactacacccacggatccctgatgatatgcactggccaaacggtatgatcgcttacgtctcctcacctatgccttgggcggcgcctacggcgcgcagctacatacagatatcaaggacgggatgattcggacggcgtcctccgcgaaccggaggacatttaccccaatctgtgagtggttttgcgcagaagaactctggcaatggggcccacatctaccccacaggacctatcgagaatgcctgcggtgagggttttctcggccacttactaacacaaccaattaccgactgacaagttcaccgatcttacgatctgaaaaggccgccatagcgtgacacttcttcaagtagtcacaaggcccagttagcgtcaatcaccgggtggtcggcgctttgttgtgtgtggccttctgtatctttctcggcgtcgaactccgctgataccaaagcacccgcagacaagctcttggcataatcagtaaccttcgagtcttcccgaatgtaggacggcactttgaacacgctccctccacatattgagggccaagtgctgatcatcagcaattgtacactctgcctcgtcaaacacggcacaccgacctgcctttactgagcgcagccggacacagcagccaaaccgtagctcacatgactatgtgtgcgatggcccgtaaagatctcggagctgggaacgtcggcaccgtgctctttggggcggatatgagacgtatagagctcggctaacgaaggcccttgcacgatttggatcgacacgacacttgtacgatcacaagcttccagcagcgatgggagattcaaatcatcgtaaccaaacaattccggattgcaggtatgcgatgtctcgggctggggacgacctcctcgacccgctcttcatttcgagaagagctcgagccgcttcttcttgcagtgagcgcctcccactgcccgaagcgcctgtatggccttgaccatcctggctcgagcaggatgtccctcgacagacatctcctgccaccgtgctgcgcgggtgtgagacctcccgaatgatgagggcgctcacgagcaggaacgaacgtccagtccctgcttgttggcagtgtcgaagagagtctcgatggaccagcgctcctttgtagagcgcccatatgtcctgggcggggcggccggcgccgaggcttgacctgcattagtgtcacacccataggaaggagagcatcgcaatgatcttctcgttgcgtgtatggacgtgcccatctcatgtggcctgatgtgtagctctccgcgatctgcgctgctgtaagagggggtcgcaacaagtgcagcacgctcctgccatgccgagggtgtcgtcgtgcattccccgggactacgcacgccttcctgtagcgcgtccagaacgaagcgccatagagcccacctcgccctcgaggcggacggaggcttgcaagcgcctgtcgcttgtggaaagccgtccacgtactggtctgtgtaggatgtgaacagcgcagttgctcctcgcctgaggaaggccctatccgcgaggtaagacgcaaatggcccgccaagatgtgcctgccgaaaagagttccctcacgaaacggccgtctgtatcccccccgtcttaacatgcgcggacagcagcgtgcatgccggtgcgcacgtcggatatacatgaggcatgtctgacttgtgctccacctagctttagagcctgtatcccttctacggttaagcgagttggcgacaggagcgggagcgagcctatcacgtggcgtctgtggccacctcgccccgagcatgagtcgacgaggtcctgctcccgacgacctagcccgaagagcgtcatgtatcccatcttcagtcccgggcatcctgaagttgagagcacgctcatcttgtagagggtcctcgcaggcccccatgcgcgctggatgcctcgcgaagtgtgtgaggggcgcaggcgttatattcatgtcggccatcggcgcgtgtaaaatctccctgagcagggtaagggtcccctgtaagcagggcaagcgcgattgcatactggccgactcgacgcaggcaagctcgctgtttgcgaaccttagttcccgacattgctgacgaaaagccctcgcatcggtatcctgcgatcgacggcagcggcccatcttgtcctgcgccttttttgccgctctcgtaccgctgcggtactcgtagacgtagtatagtggcccgatatcgccttgaccatcgtgcctttcggcttgcaatcgcgcggacctttgccggcacggataccttcccatggagccttacagcatctctaacaccatacctataccacagcggcggaaaggcgaaaccagacagagggagatgccttatagattggggcattctcctccctcgatgcaaacgcatgtgtatatgcctgttacctaagaagccgaattgttgtgactagtaaaaacgggtgacctcacaccgatgcgagaccacccattttcctatctactatataaagtcggctttatcagccgcccaagtacgcgctcttcacagcattattgttgagcagctctttgccggtgccttccaggacgatgttgccaacttcaagcacatagcctcggtctgcaatcgagagggccatctgtgcgttctgctcaaccagcaggattgtagtgccctgcttgttgaggttctggatgatctcgaaaatctcgtcgaccagaatcggggccagacccatagagggctcatcgagcatcagcagcgaagggtgtgacatcagtgctctgcccatagccagcatctgctgctcgccgccggaaagcgtgcctgccacctggctgcggcgctccttcagacgtgggaagtccttgaagacccgctcgatggtctcgtcgttctcagcgttgctcctgagatagccgcccatctccaggttctcttcgaccgtcaggtgagtaaagacacggcggccctccgggcagagtgccaagcctttgacgacgatcttgtgcgctggaacgccggtgatatcctcacccttgtacttgatggtgccggacttcggcttgatcaatcctgcgatcgtgttcatcgtcgtggacttgcccgcgccgttggcgccgatcagcgaaacgatctccgcttcgttgacctcaaacgaaatacccttcaccgcatggatcgcaccgtagtagacctgaaggttcgaaacactcagcatgctcatttcttcagcgcctcctttgcggcacgcgcgccctgcttgcccaggtacgcctcgataacacgcggatcctgctggacctcctccggagtgcccttgcagatgatcttgccatagtcgagaacgcccacaatctcgcagatgcgcataaccagtgacatatcgtgctcaatcagcagaatcgcgatatggaactcatcgcggatcttctggatgttttccatcagctcatcggtctcgttcggattcatgcctgctgccggctcatcgagcaacagcagcttcggatgggtgcccagggcacgcaggatctcaagccttctctgtccgccgtagggcaggttgctagccttctcctcggcaaagcgctccatattgaagaacttcaggaggtccatcgcctggtcatgaaaccctttctcctgcttccagtgcttgggcagacggagcatatctgtggccagtgaagtgctcatgtgattcgtcatgcccaccaagatattgtcgatcacggacatctggtcgaacagacggatgttctgaaaagtacgggcgatacccaaacgggcgacctgcatcgtgttcatgccggcggtgtcaatcccgttgagcatgatcgtgccgcgcgttggctcatagacctttgtgagcaggttgaagaccgtggtcttgcctgcgccgttcgggccgatgataccggcgatctcagtggggcccattgcgatattgaagtcatcgactgccttaaggccgccgaagtcaatgcctaagtgctgcacttccaggacaaggggcttgccgaagtcacgctcggtcaccaagttgggtgagggcaccggcaacagcacttcacgcttgcgcttacggttgatgtcagccgctgtctcattcttctttggcatcgctcgctccttcctgctcactcgttgctgctgctaccgaagtacccgcagcggtggtatcctgtgcatcctcttcctcaagctccacatcggtgtgcttcatgaacggaggacggtggttcatgatgttctcgatcgtatcacccatcgagaagtcgtaggtaccgagtagtccttgcggacggaagatcataacgacgatcaggacgaccgcgtagacgaccatacggtagtctgcgaaggcacgcagcacctcaggcaggatcgtgaggacggttgcagagatcacggagccgagcatggagcccatgccgccgaggacgaccatgaccagaatctcgatcgaacgcatgaagccaaagcgtgccggcatcataacgccgatgcagcctgcgtagaggccgccgccgacgccggcaaagaaagcggacaccacgaaggcgagcgtcttgtaataggtcacgttgatgcccacggactcgctcgcgatctcattgtcacgaatggagaggatgcagcgtccgtgacggctcttcatcatcgtatggatcaagaagagcgagatcgcgacgacgataaaggtattgaggaagttcgtataggccggaatgcctgtcaggcccttcgcgccaccggtgagctcaaagcccaggacgccgtcgatgttctgcataatgacgcggatgatctcagcgaagcccaaggtcacgattgcgaggtagtcgcctttgaggcgcagggctgggataccgatgataaggccagcgaggcctgcacagaggccgccgaagatcaagcccagcacgaacaggagcgctgccgccggagaccctgtcacaaagtcacgggcgccgacacccatgacagagctcatgcgcatgataaagattgcacacgcatagccgcctacggacatgaagcctgcatggcctaagggcagctgccccaggtagccggtcgcgatgttcagggacacggccataatgatgtagatgccgacctgttcgaggacggtcgtctggtagcgggagatgaccccgccggaaatcatcgcttcgccgatcgccagaaacgccacaaccaggattgagttgatgatgtagcgctgcttggtggagagcttgcgataggtgctacttattgcgtcagccatatgtttgagccctccttacactttctcaatcaccggacgaccaaggatacccgtcggccgcacgaccagcacgataatcatcaacaagaacacgattgcgtcacgccacacggagagaccgattgcggagacaaagacctctgcaaagccgaccaaaaagccgccgagcacggcgcccggaagcgatccaataccgcctaagaccgcggcgacgaaggccttggtgcccaacatgatgcccatggtcggggtagcctgtgagtacgccatcgagtacagcaccgcgccgatgccggccaaaccggagcccagagcgaaggtgaaggaaatggtgtggttcacgttgatgcccatgaggcgcgctgcgcccatgtcctcagacaccgcacgcatagccttgcccagcttggtcttgttgaccaaaagcgtcgtaccgatcgtcgcgatgagcgtcacgccgatcgtaagcagtgccaccgaggagatctgcgctgcaccgatattgatctgcgttgcatcaataaagggggggacgacctttgcatccgcgccgaagaccagctgcgcgccgttctcgaggaagtaagatacgccgattgcggtgatcagcagcgacatacgcggtgcgtcacgcaacggctggtaagctaccttatcgatcaggacacccagaagggtgcagcctgcgatcgacagaatcactgccgcaaacggtggccacccgagttgcgccatcacaatccaggagatgtagcagccgaccataatgatgtcaccgtgtgcgaagttgagcagtagaatgatgccgtacaccatcgtgtaacccagggcgacgagggcataaatactgcccaactgcaagccgttgacgacttgcgtgagaaacgtcattcccatcaactcctttaaaccaaatgtgcaaaagcaccggcatacgccgcatgggcgtatgccgaaataacagcttgttacgcctcgatcgtgtcgaagacttcctgtgcaccattgtggaaggtgatgaccagagtcggcttcaccgggtcaccggtgcctgcgtagctgatcgagccggtcacaccgtcgacctggccggaagcgatcgcgtcgatgattgcctggctgtagtccggggttccagcctgtgcctgaccatccttctcgacagtgtcgattgcgtgggcgagcaccattgcggcatcgtagcccagggcgcagaagttagacggtgaatcgttgaacttgttttggtaatcggtgatgaactgctggaccttcggatcggtattctcagtcacgaaggagcagtcgtagtagcagccttccagatcctccatggaggcgtactcctcgtcgccacccacgatgttggaccaaccgtcagcacccaggaaaacgcccgtgtagccctgctgacgggcctgggtgacgatcttgccgtcgtcttggtagtagtttggacagaagatcgcgtcagggttggtggcgatgatcgtggtcaactggctgttgaagtcgacgtcgccgtcggcatagccctgctgtgtggtgatcgtgaggccacggttgccggcctcctcgacgaaagcgtcgttgacgcccttctcgtaatcgccgccagagttgaagatggtgccgatgttgctgtagccctgatctgccgcgaagtccgccatcagcttgccctgatacgggtcagtgatgcaagcacggaaggcgttcttgccgtaatcgataaagttggagaccgttgcggacgcggaaacaagcggcatgttgtcgttgacggaagcttgcgccacagccactgacggggttgacgtgacgtcgccgaggattgcgacatccccattctccaccatcttgttgtaggcgttgacggcctcagtggcgtcgcccttctcgtccatctcgtctaagtggacatccttaccgttgatctgaggattctgatcgaagtagagctcgacgccgttacggaccgctaagccgtactgcgcgacgttgccggaatacggccctaagacgccgaggctgatggtgctcgagtcacccgagccgccaccattgccgcaggctgccagtgcagaggccatcccgaccgcgagggcagagacgcctgatgctttaataaatgaacgacgtgtaacgctagtcatacctatctcctttgttcctagctatgtaacagagcgtctgccctgctgcacattcaataaattgctcaactaattgtactgggaaaaacacaaaagactatgaatcggcagtaatgccgaaccgaaaaagggccgctttggcctaaataattcgtagtactacaacgtcgagggccggatctgtgcatgcatgtacgtagttcatgttcgtcccctctcagacgttgtgtggggcctgatcggtctcagcttttttattttgtatattcgattactttagtacacaaaattctatacaacatcagatgggcgatatattttcaactctgaaacacgcgcaggttaaacgcccatatttttcttacactccgttagaccacgattgacctgagaagggcccaaaagtgtccggacccccgtctacaatgcatgtcgccaaacaagggcatcgaaaagcggaagggtcggactcaatgatactgcagcgcgtagaagagatagcatcgcaaagaagcgcagctctcagaaagctcaaggcgtcatagtaaggagaggggcgggtctgtgcttcggggacgcccaagagtgttgcataagatacgaatagtcgcgggactcttgctgcaaggacacgtttgattatggcctccaagatagaattgaggtccgtgcgttgcgaagaccttctcggtcaagacagaatactgccatatctcggcgtctaagctcttcgccaccacaggggtacgtattcaaaaggcccccttgaaggcatgacttttaaggagcttgctcgtctgcaggtgtagccttaaggacctcgtaggtcccatgcacatcggctcggattcgagggatgaagcgcactgcttcagaccccaggagcgccctgccgtctgctgccaggcagatgttcctctccctcatcgattcgcttttgctggctaccggaaaggtcgccggcaattccctaaagggtgcacaggccacggcctaaccgtgcactcgcgcacgatatcgagcgagaatgtctggccagcgtgtgccgcagaatgacctagagacgaattacaagacgcttcgcagggaaggggaaggccccaccgagagctacaggatgccctttcaggcatcaacaaacacaaccgacagcttctgggtcgccgccgcacctgcaggattggtgcgcatcctttcctcactgcgggtccacgaaagccaacactgccacacacttaccaagggtccaggacggcgagaggcatcctttcccaatgccagtgcagcgaaggttcaggcaattctgcttccctattccatatggtgtcgacaaagtggggctgcaacactttgtccctcgcctgcttctgtggatagagcatgcgagacattctgcgcgggaacaaggcaaggaatcctgttccggccagcttgcgaaggcagctatgtacagacaccgaggctcgcttgtcgacaagtcccagcccctcttggactgatgggaagcaagggaggacctagggaacgtattaatgcccatatataacgtgccggataggcactcgagccaccggtcctttctagccggtatgcggaaaggcaagggaaggaatctcagaccacacgtgcaggagcctctatccttacatctgtcctgccgcatgaccgcaataagctccaagacgatcaagcgacgctgagagccgggagtgtgcagcctgccgggcaaaagattgcacatggcagaaggttggcaaggtcgagaaatcgccttgaagtgtgcagcagcttcctctatcccctagtagcgcttccttaagggggccgaagcgccgcttcacgatcaggaaggtgctgtctacctttaagcggccggatgccttcctggacgcgatcccttctcgatagagtgcacggcaggccttctattgtcgaaggcttccttggcaactctttagcgcatagatgagaggtgtgggtcttatgcgtccgtaagggcgcttcgtgcgctataacctatatacctaacgtctgcgcagcagaacctggtcatcttccctacgagtgtgtgtgccaacaggatatgtccgatcattctaggcgatcgtctccacaccatgcacaaggcacctgcggcatccacgccaatcattcctccttgtatcaatacccaggtctttccctttcttgactgtgcgcttttagggtgcgtgcttggttccttgttcttctttacgcttagggctcgataaaggtcgcatatccacaatgtagccacccgcgccgttatccctgccttcttaagttctaagtttcaggcgcaagcaacaagcctttgccgagccctctcgctttaagggctatgggcaacatcttcgcaaagtgtcgttgtatctggcaccctgcgcctgcattaaggtctacgtcacagaagcgctgccagaagtggcagccagatagcatccttaggttccctcgtcttagagacaacattaccaaagcaggatatatcctaaagcatcgtctttggcacgcgcacatcctgaaccggacctgtccagtggtagctggtatctaccatgcaaatccagctgtgccacacaacatttggttatccagccgctccagtgtgtcctctgcctggtctttttcctcataccttaggatttaaggtcctaaaaactcagtggctgtccatatctgtctttttggatattgcaggaattgatgtagcataccaatccagaagcagataggcatctatgtgggtatgggcactgggtggttcgagacattttagccgagccatacagcgtgtggccccactggcctcatcgaggcaattaatcatcgtttcctctagctgtcagacgcgcactttcatttgaaatttcattttctgatggtatggtaaatgtgggataattacaaaattatcaaggagtattattgatgcgtttggaaatccttttctgctaatgtggaaagaaaaatgacaaaagaagactggtacaagcaatcctgcagatctttctggagaactggaggcctttacggctacgatgcacacgtgcaggccacagacgaccctgtagcgaaggcagtcctgtctgatattcgatgaggaaagggctcacatgggtggcttttgactctgttgtaaatatctggatcctctgaggagtacaactataaagaaggtaagcaggaagttatggatgagctgaaagagaggcattacgccggtgaactttttttgattctcaacaataatgaatgcagatagttgaggcttggaactattgtggtaacacacctcgcctctgactacaacaacaattgcaaagccaccctggcctgtaagtatcagcgtcaaactgcaacaacgaagacaaggtggcctctctgataccttcatgtaagaaactgctcaacatcaaaaatactgctgtagagctcacgacatctacaatgaccagatggggcaacccactcccaggatgagtgttcgtagtgcgacaggcactgatctggctatgatagcgcatcggtaaatcccaagtcgtgcgtgctcggactggggcgcatcctggcagagtttgaatgtcctacccacaggcttttctgtccgaaacacagtgtggtaactgctggcgtgtcctctgggcttacccagaacgatgctctaccaaagaagttgaccttaaccgccagccctgcttgcagaatagactgcccagaagtggcgtggcaacatccatagcgtcatcggctggcagatgtttaaactgcatatcaaagcccgaacgaccttgtttgcaatggcatcgataagaccaactgcgcaaaggccacaaaatacataacggttgtcgcaaaccgcgacaccactatcgttgtatggtggctgacggccacgacaatctgtcctggagcagttctacaaagtctcagtaaggagcagcttgccagcatccggtttgtcagcgagcctgcgcacgctggatcacagagtgtgcaaacgagcctgcgcactctgcaagccgctgctcgatccattccatgtcgttgagtgagccacagatgtgctggatgaagtccgcaaagactgctggcgtgctgccttatgaaaaggtaaaacggctagccaaagagaacccacagaagcgcttggcccaaggcagatgatcaggctttctccagggtacaggcagctcgcaagaaagccacagcgatcaagcgatcagtctatttttctggcaaagtgccaaatcccctgacgcagaacaaaaagatccgccttgatatgatttaggcaaacgactcacagctgtattgaaccgcttcccatttcctggacataggaaatgggaagcggttcactctccccctgcatccttttttcatatcgatatgatcaactaggttggcaggctcatatactccaggctgcctttgagacgtctcaggtaccctacgctaccgaatcatcgtctgcggaatcttcaccctcaacagcctcaggagccagacactcaacgagcttcggcactgcatcatcgacgacctttgcgatacgacgcataacccgcatgtacatatcccctgccccactatcggggagcaagagatcgtagtgcccgacaatcgcgccagtctcatcgagatcgaacttgacccaacgctgctgggtattgatctcgttgcagacgttgattgcgcgttgtcgcatatcctggtttactgaaacgagcggagatgtctggaaatgagcttcctctccgttcgcgtcaaaaactgtatagacggacatttgcggcagttcctcggtaccaacatgcataaacgcattgaagcgtcccggacgtgcacggtgatcaaacgaaacagccacaaccggcgatgtcccttgccgcacgacatcgtaacgataatcgttattttcaagtgctctgataaatgctctgaatagtttctgtgcagttgacatagtggttccctccttcggctgatcgttgaaaatcgagaacctctttctttttctcttctcctcctcgtttgatggttattattcccgaacaggagggttttcgcatatttctctgtaaacgtgtggtcttttgtcgtaagtggttctaaccactttattttttgattttatcctctgccacctgcacaaacacgaaacatgctcttaataaacaagcggcaggcatactgctcttggtacctgccgcctgagaaaatctgagtggtatgccttacatatcgtctttagagaacccgtttttcatccccatcgaagcctcatagagcacctttgaaagtaaggaatcagtctcacgcttgaggtaatccgctaccttctgattcccggcttccaagagtggcttcacatcagccacctgctggtcggccgccgcatcggtctcgtggatgatttggtgaccgatgccgcccattttttcctgatagcgctcgatacccgcctggcactcgtggaagtgcgcatccgccagccctgcaatgatgcgatttgcccaatagaagctttcagtggtcacctgtgcggtcgtattggagaggtactccggcgtcgtggtcacattcgcgtaaaagggtacgagcgcgttgaagacgttgctgccgaaggccagccactggatcgcggcgtagcgatcgtctacatccgggcggatctccaccacggaaagctgtgagttgcggttgataccgatcgggcggtacatgccgcgtgtcgccgccccatcacggccgtagggatcatacctggtgccctggtagtgcagtgacagggcgtacttgacgtcctcgatcgtgaccttgcgctccggaaccctgccccaggggatatcatcagacgcaggggtgagcagcgcgtcagacgcgtcccactggatcgcatgcgggttcaagaaacgctgcatcgcccaggcgcgcggggtgttgtagacgtggtcagaatcggaatgggagccgaaggcctcacgcgggttgaaggcgtggccctcaagcgtcagatccaggtgattatctgccacaaactgcttcatgtccacggagcacatatagtttttccgctcaccaaaggcatcctcgaagtcaaaggaatcgatgccgagctgattgggcatcgtcacgtacatgttgtccggcacgcgcttggcgatccaatggtggccgcccacggtctcgagccaccagatctcgttgacgtcgctgaaggcgattccgttcatctcgtaggtgccatactgctccaagagcttgcctaaacgaaggacaccctcacgggcagagtggatgtagggcagcacgatcgtgaccatatcctcctcgccgatgccgccgatcagctccggctcgtacccatcgtcgccgggttttcctttctccggctcataggtgacaaacgggtcggcacccaagacgcgctcgttagtggtcagggtctcagttgcgctcatcgagatgttctcctcattgacgccggcctcagcccagatgccttcattggtgaccgcattcgggaccgcggtataacgtagtgggttgtccggcagatcaatcgtgaggtgggccagaacgctcttgtaggtgtgtggctgatcctcaggattcacgacgacaaaccgtttgggattgaaggtcccgttcccggaatcctcgttgcgtgcgataatggtcgacccatcgaagctcgcgtctttaccgaccaataatgttgtgcacggcatgcttcaacacttccttatctctaacagttcgatacggacccaaactgcgctttcaggcagttcttatcctagcgcgaacataagagtacactaagaggcgacgtgaagattacagatagagggggctgaaacaccgtatgtaccgccttgttgcttcagacatggatgagacctttctcgatcaggaacacaagatcccccaggtaaacatcgacgcaatcgctgagatgcgctccaagggcgtcctttttgtccccgcctctggacgtgcttaccattcggtgctgcagagctgcgcggcgatcccgaaagagctcctcgaaggctcctatgtgatctcctacaacggcggctgcatcaataagatcagcgacgataccccgattacctcgcatcagctgcccttcgatctcgtcaaagcgatctatgactgggccatgcagttcgatgtgggcttccacatctatgagaccacaggcaaagtgtggggaagccacctgcagcagtccgagatcgactacctgcgcggccacatgccgtacaccgatttcactgacgactcgctttctttcctgaaggatgtgccactggccaagatgctcgtcgtgaagcctgacggtatgccctacctgcgccacatgtgcgacataatgccgaaagacctcaaagaccaggtcacctataccttcagctcaaaccgctactttgagttcaatccgctcggggttgacaaaggcaccggtttgaagcagctgcttgagctcctccatatcgacccgcaggacagcatcgcctgcggcgacgcccaaaacgatatgccgatgatggaagtagccggcgtcggtgtctgcgtcagcaatgcagacgacgatgtcaaagcagatgcggactacgtcgcaaaggcaagctgcaacgacggtgtgctcaaagaggtcgtcgagcagttcattaactagctggccctcagctgtcaaagtgaataccgaacgagagcagccggttcaggcagaactggacgaatccgaccataaccaaagacagaaatttggcccaaagtagcggcagcgccagcgatgtgagccagaaaaggacgagctctgagagtatgagccccgtaaacccgaccgcgaagaacagaactgcacggatggcgggatggtcaaacacccggaagttgtagcgccggttcaagaagaagctgaccgtgatgccacaggtcaccgatacgatattcacgaacagccagggaaatccgaggacggtactgccaagagtgaagattgtgaaatcgagccctgaggagattatgccgatcagtgcgtacataatgaggttgtgaagccaagaattcttatcacgaagctgctcgatcagtttcacgccgaatcaacctcaccaacctgccctatacagtccaatacgttctcaccatagaacaacagaaggccgaaagggatattcctttcggccttctcacattactgtctgccagctgtatgtctaacgtcctggagcttagagacgatctgccatatcgtggatcagcctgttcgtcttgtcccagccgaggcaagggtcggtgatggacctaccgaagacgccaccaccgatcggttggttaccgtcctcgaggtaggactcaatcatgaagccacggaacagctttgcgatgtccttgttgcgcgcaacggaatcgagtacctcgctgcagatacggatctgctcgagcggacgcttgccggagttgtcgtggtttgtgtcaatgatcacagcggggttctggtagttcttattgtcctcgtaggctgctgccagacgctccaggtactcgtagtggtagttcgggtaattgatatcgtcgagacccttgtaaccacgcaggatgcagtgagcgagcggattgccggtggtctccacttcccagttacggtaaatgaaggtctgcggatgctgtgccgcatagacggagttgagcattacggacatactgccgccggtcgggttcttcatgcctaccggtacttcaatgccggaggcgacgaggcggtgctgctggtcctctaccgagcgtgcaccgaccgccacataggcgagcatatcgttcaggaagcgatcattctccggatagagcatctcatcggcggtgaagaggccggtctcctcaaccacgcgcaggtgcatgtgacggattgccttgaggcctgcaagcaggtcaggtgccccttccggatccggctggtggagcagacccttgtaaccggtacccttggtgcgtggcttgttggtgtagacgcgcatgacgatctggattttgtcctttacctcgtcctgcgcctttgcgaggcggctcgcgtactcaagtactgcatcctcattgtccgcagagcacggaccgatgatcaggagcttcttggggctctcacctttgataatggcggcaacctcttcgtcgattgcctttttacgctccgcagaggctacagagagcggcatctcggctttgatctcttttggaatcggcaaccgccgtttaaacgttgcagacatatgtctcccctcaacgtttagatgtgtcatatatggttcaatcctaaagtaaagggggagacaagaaacaacatattaaaatttgtaaacaatttgaaactaagtgcgcccctcagaggccgcaggaccaccgttcgttctcctcctcattgaggtgcgtccctctctggccttccagcggatcagcgtgttccacgctctcgccgtcgataagggagaatttcgggttctgccaacagcgacggtccttaacgatgtgggccggaatacccgccacggtcacattggccggcacatcgtgcaataccactgcattggcgccgatcctcactccgtcaccgatatggatgttgcccagcacggtggcgcgggctccgaccataacgttgttaccgagggttgggtgacgtttaccgccgtggtgtccggtcataccgagcgtgacgccctggtagagcatgcagtcatccccgatcactgcggtttcgccgacgacgatgccgataccgtgatcgatgacaaagcggcggccgatctgggcagccggatggatgtctatcgcatacttcttgcgggtgtggctctgcgaccacatcgcgagcccatgcatcccgtgggtccacagccagtgctggcggcggtaggcccacacagctctgagtcccgccgcaaagaataccacttcatgcacagatgagacagaaggatcgcggttcacgacggcttctgcatcttcacgcatcacttggaaaagaccgacacgttgcgagggctgcttcacctcgcatgcccgctgtaccgtctgtgtttgacccataactgcctctccctttttagcacatcccatactacacagtgtatgccatacaggccctaaaagaatccgtgttcatcaaattcataccgatgaataggtatttagaaatggaatgtctctgcattccagaagcacataccggtcccggtatgcagtaaggcggcccttacagaaaggaaccgcctcagcattaaataaacaggctctctggcttagaggtcaagggacaggtagcgttcgccggtatccggaaggactgcgacgataaccttgcctgcatactcaggacgcttggcaagctcaacggctgccgcgaccgccgcaccggaggagataccgaccagaaggccgtagctatcggagagctttttcttcgtgtcgatagcatcctgtgaggtgattgcgacaacctcgtcgacaacagaagcgtcataggtcttcggaatgaagcctgtgccgatgcccggaatcttgtgtggaccagcgggctcgccctcaaggacgcgggactcatacggctcaacagcgatgcccctgacggaaggcttctcctctttcaggaatttggcggtgccggagatggtgccgccggtgccgacgcctgcgacaaccgcgtcgacggtaccctcagtgtctttccagatctcaggaccggtggtctgatagtgagccttcgggttggcaggattcgtaaactggcctgcgatgatcgcacccggggtccgtgccttcagctcgtctgccttcgcgattgcacccttcataccaccctcgccggacgtcagaacaatctctgcgccataggcggcagcaagcttgcggcgctcgatggacatagtctcaggcataaccagaatcacatggtagccgcgcgccgctccaaccattgcgagaccgacgccggtgttgccggaggtcggctcgatgatcgtaccacccggcttcagagatccatctgcctcagcggcatcgaccatagcctgagcgatacggtcctttatggatccgccagggttggttgcttcgtacttaccgtaaattgtcgctttgttgtctgcgagggctgagagatccaccagcggggtagtaccgataagtccctcaatctgttgcgcaaatttcatcagtaagacctttctcattcgttgactggaaacgagggtgtcaccacaaccgatacagtgcatgcttctgtaccggtgagcgtgtggcaaatgcaagctcgttgtcaactactatgtcacttatattcccaccatgcaagtaggaatttagattaaaacagaatgcccttcgtcttcatgatccgaccatagagctgagctactcagacttcttgaccaacaagggttccttgggaggggcaaacccgattcctaagacaaagcccatgaccagcataatgaggggatggcgggctgcgagaaagagcccggcgcccagcaccagctgtcccattgacggaatcagcggcgcgatccacgcggaaccaaccacgagaccaacggcgacccatccgaataccagacagatcagcttgatcacgttgggggtgtacaggtgtagcgtgcggtcgaggacgatgcctcccgcgaaccccatggcccacaaaagcatcggcaggctcacgatgtaggcgtagagtcgcgggcttgaggcggtcagcaccgcctcattggaagcgcccacactctgtgacacaaaatacatgacaatgcttgccgcgcttacgatccctgccgcaagcaggcttcccatcagtttctttttgcccataggtcaacaaacctctgtctgtattgctcaggttaaatatccatatccgtcatctcaaggaggtccgtcacgtcgttgagtgaaggatagatcccatacgcaaggtggcgcatctcgtcggttaccggagaaaggtcggggatcatgattgtcttgaagttaccggcagctccggcttcgacacccgcataggaatcctccaacacgagagtgttctgaggatcgattcccagctgtatggcagcagcgaggaagatatcaggagcgggtttactgttcttgatactggggtctctcccactcaccaagacattgaatgccttcgtcaaatgcaggtgatccaaattattgcgtatgatgtccatgccggaggaagaggcgagcgcacgaggcacctgtcttccacccaagaaattgaggagctcaaccgccccatctttcgcaggtaccccatgctcaaagctatagtcatcgacgattttctgtagcgtgctcagcacggcatagccgtcggtacccggatagtcactgtagatctcctcaacgataggccctccttcttcgttggtaaccccacgggttctatcggcgacttcctcacgaaagggcaggccgaatcgtttcaatgcctccggcaaaaaatgcagatagagacgttctgagtcgacgagcagcccatccatatcaaagataacggctccaatcatcgtttaaacctcctggcggaagaaccacccatacagtttcagctcttgatcagttttaattgaggagtcaaacaccacctgtcccggcccggacgaaaaggacagaaggccgtgctgggcgagcttccgcttgaattcccgggcagtaccctttcccccatcaaagaacggcacatcccccacaacctcacggattgtccccttgataaagggatagtgcgtgcacccaagcactacggaatcgacagtacccgcataggaccccacgagtttctcgacgagcgctttcaggtccggcgcgtcgaggttacccttctcgatcctgcctgcaagccccggacagggcagagagattacgtgggagcgggagccccaccgctgcgctagcttgtgatacttcacaagcctcagcgtcaccggtgtcgccatcaccaaaatccgatcgtgcttcggcgccaaggtcgccggtttgagtgcgggctccaccgctatgatcggcacatcagggaatcggtggcgcaggggcgccgctgcgaccgcgctggcggtgttgcaggcgataatgatagctttgcagccacgctccagaaagttctccacgatgcgggaggagagctgatagacttcctcatccgtcttctccccatagggggcattcgcagagtccccaaagaaatagaagttctcatgcgggagctcagccaccagtgctttcagcaccgatatcccgccgacgcccgaatcaaagacgccgatccaacctttgagagaacgctgagtcatgctatcgctttctaccccggtggtattgtcactgcaacgtatcgtacccaaacctgaccgggtacgtacgcactttatccattgtaggcggccacacacctgagcaccggagatccttacaaaaccctgcgctcaatcggctatctgccccattgacgtgtggcgcggcactaacggaagagtgttggagtaaggtgagagatgaaggaataccaggaagggagcctcacatgcttgccgtcattcacgcctcagttgtggatcaacccgtcgatgcgatcgtcaatgccgctaacgcggcgctcgccgggggcggaggtgtagatgccgcaatccacgatgctgcaggccccgaactcgatctcgcctgtcgggcgatcggccactgcaacaccagcgaggctgtgatcaccccttccttcaacctgcagcgtaccaccggcgcccgccacattatccacactgtaggcccgatatatgcacgctatagccgcaagcgcaatgcggaactgctggaggcctgctaccgcaattcctgtgagatggcgctcgaatcaaacgatacaagcctcgccttctgttccatctccaccggagtctacggatatccggcggaggatgcactccccatcgcgatcagcaccttatttgagtatgcggactccttcgatccgctgctcttctgcctctacacggcaagcgaataccgtcgcggcgtttccattatcaactgcgtcgcaaccacccaccaagagggagaccgccttattatcgatgcagtgaagtgagctgctcctccagaaacgtggtaaagacttctgccatgcgcgacaggtgtggccgaaccaacaggtagatttcacggtactgcggttttaccaggtgtttcgctataaggtggtagggattgcgctgcagaatcagggacggtaagagtgagaccccgagccctgtttccaccattgccatgatcgcatagtcatcccaggtgacgaatttgacgttgggcttgagccctgctgcagcaaagatgccagagacctcactgtccccgctctgctgcagaagcataaaggggtcctgacataggtccttaagtgaaacgcgatctgcctgtgcaagcggatggttttggggcactaccgcgagcatctcatcagaggccaagcggcgcgagcgcacagagtgcttcggtttgtcagcgatgagcccgagatcgaccctgccctcctgggtccagcgctcaatctcctcaaagtcccccatcatcagctcatagtcgacgctcggatagtgcaccctgaattgcgcgatgatgcggggcatccagtgcgtcgccacgctcgagaagcacccaatccggatggtccccaccttgagtccgcatacctcatggactttcgcctgcagcgtccggtccttttccaccacgtcccgcaccaaaggtacgatccgctcgccctcggcggtgagcttgacgccgcggcggctccgctcaacgagccgcacgccccacccctgctccaaatcggcaatcatgcgtgagatacccgactgggagtactgacacacctccgccgctcttgaaaaactcccttggtcaacgacctcgagcaaggcccgatatttctgaatcgtaggatccatcggcaagtcctttatctatgatgaatgttcatactacacatgcattatatacgcttttcaagtagcgctacggcgtgcacaatagggtcgctcaagcgaggggaagggggcaatcaggatgcggaagcctctgattcggtacgtattggcgctgctgttattcggttcgaacggtattgtcgcaactcacattttcctgccttccgcacagatcgtcctgtgccgcaccttcctcggcagttctcttctcgcgttgattctgcttctacaggcacaccgcaacgacactgagttcgcctcccccgcccacctcaaagaagccctcttcctgctgcttggcggagcaggcctgggtggcggttggatcttcctctttcaggcctataccttagtcggcgtcgggatcgcctcactggtctactacataggaccggtgctggtcatgtcagtcagcccgctgctcttccattcccacctcggcgccaagaaactgttagggtttgccgcagtggtcgccggcaccctcttggtgatgggccaaaacgcctcaggctccctcaattccttcggtctcgcaaggagcttcatgagcgccatcatgtatgcgacgatggtgatcgccgacaagaaggtcacccacatcaaaggattggagaacgccgcaatccagctcttcggggccttcttcaccgccctgctctacgctctggcaaccggccaagcggctcctcagcttgagctgaacgatatcgccccgatcctgatcctcggcctcgtgaacactggcctcggatgctacctctacttttccgcaatgaatgcactgagcatccagacggtttcggtctgcggctacctcgaaccgctttccgctgtcgtcctctccgtgatcgccctacacgagccgatgtcgctcttgcaggccttcggcgctgtgctgatcctttccggagccgccttcccagagctctccgaccacctgtcaggccacaaaatccatcacaaaagattttctgcgcgggcccagaccgtgctcaaagccggtaatacgcaggtgttaccaagagctcacattgctcagtaactgttcggtatagccctgccgtgccagctcatgggctgcggaaagtaccacctctgggatctccacaggatcctgccatccccggctcgggtagatgaggttacgttgggtgtctcctaccaatatcgagataaactcatgctttgaaatcggtgctcgtccgctttcataccagtgggcatactcctcgtaggtaagaggcaaagacgagataataaagtcaagcttcggccactggcaggtgagggtgacgcgggtacgcaatgcacgataggggcgctcgattaccagcagtttcttctcctcgaggccctcctgctttaaaagtttctgggtatttcggatgttctctgcggtattgcgggacttgttttccctgagtattgccgaagccggtacctgctcttgctctgcaattcgggcaaaccgatccgcttccgactcataccagaggcgcttggtgatgcgtcccaagcctccggtgaagacgatcttcgatgaccagccctgccggtagagctttgcagcatagtgtgcgacccactcatcgtggctgccgaacaccagtattgcggcgcagtgttcaagtttgttagaggagatctgatactcaaagagcagccgcgccaacctattgacctcagcgctatccatcgcgcatatcctttccgcaccgataagattcatgcaaacaaggctactgcgtgccggtatcgcaacggtaaaaaattattgaatcctcatggcctttaagcttcacttccacgacaaggggataatggaggctcaccgaatgaaaggattatccatgagcgtctggcgcctgtgccttatagccatcttgagttgtgcccttgccctcttcggactgactgcctgcgggcaggaggacgataccgaagattcctcgctcgaaacactgacgctcaacattcaatgcaacgaatctctgattgtgactctcgactcttcctcgggccttaacctcctgcagcaaggtgtcaactttatcgtcactcgcggcgacgacaccgtggcacgaggtaccctgcaatcggaagccacctttgaggagttcaagactaacttccaggatagtgagacatatgaagaacagaccattaacgactaccaggtgtgtgtggtgcacgaggacgacatctacgaagcgctgatcagcgtgcctgacgcatcaacgcatatccgtctggtcggctacaacggatcagacaccatgcaggaagtgctcaaagcactgcagattaccaaggcttcctaagcgggcaggttattcaaggcgtctttaattgaagcgatcgcggtatccaccgagccccgcgcccgttcaatcttggcctggaccaagatatctgcgactgcaccatccaggaagaaatctgcaaacgtgaggaacccgtccacattcaggtggattgaatctacgcccgggagattgcccagcctctccgagagaacctgcacatccaacttggcctgcgcaatctgtttcttcgcatcgttgatgcgggcatacttcattgctccagagataatgttgccgccgaagagatcgaccattccccagccgctcgcctttgcaaggctctcgcgcgccacctgaaggcttgcaagcgcctggtttcccgcctcacgggcttctgctatctgtacctcatcagggtagctgtagataccgtcgtcctcggcgtagctatcgtcgttttggtagttcttatcgtcatccatggttcagtctctcaatcgtttgcagctttcagttgtaacgataccactcatacccatgtgcagctctatcctctacaggcactggtaggggtagcgaagttcaatgtgcacagtctcccctggcttgaggctgtgtaaccgttccgaaggcacctcatccatccgccgtatctatttcaatcagcgtggcatggcggaaagcgggagtaaccggcgtcgccaccagcgtaccctcttcatttgccagacgggccagcacaatcacaaaggaatcgtcggaagtgacctgcttctgatctgcagtgtgtgcctggctggcaggctcaccactgcacaggtgtgcaaaagaatgcggcggttgcgtgtacagcgcctggtcatgcgccagcgcgcatgtgagacgatagcgtaaggcttaagtttgtgtgtcgcgcggcaaacacttcgcaaagagtcctggcggccacgatggggcaggctcctcgagacagtgcttaagccaagcacgcagcgcccaaaggtctgtgtgcggggctctttaaacctgcaggctgcgttgtctcggcgtggcgaccgggcccgtgtgagcgacggcaaggccagatgcaagctggctggcccaatcgtcggtcggtgcagtgcctgagaccttcggcaataggtcaaagctcctgtcacttgcggcttaagcacttcatggatcgcatccggcaaggtcttgcccgtatcttagcactacccaaaagtggttgtacacaaggagcagttcgaagatcggacggcgatcagcgcgagcgatctataggcacgagtgagacgcgtctaccacaccacccagagagactcgtagtccataagtccgaatgcttcccgacagtactgggagacatggccgattgatgacctcataccaacagtgggcctaatagagtcaaacgtttgcgagcaggacagcacacagagtgcagtccatcatggcgaccgtctcgcgccaggaaattcaattcattgcgtttcctagtgctgttaggatagaaaaagagagaaaagcacttgctgaaaccttgcctctcctcttactcatctctattagtgacgtgggaactcccctagaccttacctaatactttggactactcctcctttagttcttccaccttctcgtgaagtgtgaagtaccaaactggaacaaaaccctttgcacgttagcgtccaacggactcaactcatttctgaaccacgcgaatccgttgcaaatacagccgctcagatatcagataaattgctcgacccacattacctctcagaactccaattgaaagctttggaaccgtcttcgggtcaccgatgctctatctcaaacacttcacggatttttacttatgagagataccggagcttacccggcttaagaatctaacagtctgctcgatcgttaccagactttaactgtccggacaatcaacttgtggtggcaacaaccgagcccacccaaataaatcagtgatcctcgggcagacgtaccgtaaaagaatcatctagtgcccatcggacccacccttgtttctgtcgtggttctgttgcgacgtttttgttttctgataggtacccaagtcctacccgtattattcaacacctcaggtcagcggtcgtctttttttggtcccacggtttaaagtactaggtaggggcctggttcattacttgttcgagggttacgagttaggtgattgattctcaccatttgcgcaggtatatgcattcgacaggccagatggcagacgacccttttctccacaggctactgcctcgtcggtggacccggtgcaggcagacaaaccagtccagatatgcctgcaggttccggacttcatgcaggcgaagtgctcgacattcacggagatccatgagcacaggggttcacgagggcccctgctcagggtagacgggtcggtggtgacgacttgtagtcgctcgtcacgagtctggatctcgtgcgagcgcactgtggaccttctcgcagtagtggacgatggcgagccctcctgatatccattgagtgcctcgttatgccgcttggtggaaggcttcccgttctcactgacgtagtgcaggcctgcttggttatgagtcgatcgcgacaatgatgcagacctgtaccttgggagaggccctttttcctgggctttccgtcctcgtgctcgacccgtatgttctcgaagtacatctcgtcgatccacacgcaccccgacagcatgacacagtcctgccacccgctgagtgtggagaagaccttgtggcacatgatctcgacgatcttcatgatcctgtccagcggcagcttcgcgttcgcgaatatggtcctagaaagcaggctgaacctggcgccgcaggacgggcagcgataccttgtgggccccatttggccagcaggctctctatcgtgtctgcgtcgtacttcttgcggcacagccacgaggcgagcgcctccctcagctcgtcgagcccatcggcatccaagccgtcaacgagaaagcgcaggtcgagggaaccgcgctccatgcgctcctccgacatcttggattcccacctgggcggtcacctcccaagatgtcgccaaacaaagaagaaggtggcctctcagacggctctgtttggcacagatatcgtagcatgagacggatagtttgacattttatcacctaactcgtagaccctcgtaattgcttgttattaaactgaaccgcttaagggcgcgtgatgtgcccagtcgctctccttatcgcacaaccttacggtatgtccttatcgcctagcacctatcagcacctgcagtccctacatcgtgcaatcagcgcttatgccataaacctgtcagttcctgattagacggcttcctttcacttaaataattgctacgaaaagcgctacgcagacggctcacgaccacataaagactactttccgtggtattctgtgctcaagatcagtacgcgtttcaagctacaggagatcgtatgctttcgtccgaacatgcaagtgaggctaccgccgatcaggcgaccggagaggaaacacctgcagaacctatctcacagccaaccgctgccgctcaacctgcacccaacccgttgaaggatgcggatcttaaccataaacaggaccttattaataaactaaagcaagcagtcgacgcaaaggattggcgcggtggctcctccctcttgcacccgaccatgaacgaatggaagtcaatccatacctggcacataccggaagaggatcagctctggagcgctttccaggagcttagacatacaatctatgtcgagtgcggaaaagagtgcaaggctgctgaggctgccaaggagaagatctgccaggaagcgcgaaccctcgctaactcccagaactggaaagagaccagcaagcggttccaccagctgatggatgagtggaaagcggttggcacggttggacgtgaggcaaatgaacgcctctgggcagacttcaacggctcccgtcagaagttctttgccgcacgcagcgcccactttgagaagatcaaccaggagcacgagcgggccaaagagaaaaaagaagagcttatcaagaagatccagaatctgcctgtgcccaacgacagctggaagacgcagcagtggagagagcagtctaacaagattcatgacctgatgacacagtggagggctgccgggcaggcgaatcgtaaagataacgataagctgtgggaggcattcaatgcttcccgccaggccttttttgaggctcagcacgcccactttgagaaactcgatcaggtctacgagaacaatgcgaaggcaaagcgtaagctgatcgaaaccgccaagacgatctccgccacgatggatttcagcccacagaatacgcagaccatgcgtgacctcgatatccaatggaagcagatcggcttcgcaggtgcccataccgacaacgagctgtgggaagccttccgcgatgcaaaggaaaaattctggattgagaagaaggcatacttcgaagagcgcaacaagatccgcaaggagaggtccgaagccgcgattgatcggcgtaaagaccagatcgcccacttgcagcaacagatcgatcatctcaatgcgcagatgaacgacgacacgatcagcgaggattacctcgtcaacatgcgaacctggatccaggagaaacaggaccgcatcaatgagctcaatgatcagattgccgacatcaccaagaagctctcataggtcacaattacacgactaccaatattgttaaggaacacccatgcatcttgctcttgcacagatgaatatatccccctcactcaacgacaacatggagaccaccgaagcctatatccgccaggcaaaagccgcagacgcggacatgatcatgttccccgaggttcagctcacgccgttttttccgacctatcgcagagaggattccccctatcgagacggccttgaccaatggtgcctcgagtttcagtcacctcaggtggctcaacttttggggatatgccactctcaagatatcgctgcttcctttaacctatggatgcgctggcccgatggtaacgcctacgacacctcaatcactgtcgatcacaccggtaccctcgcgggagagcccgcgcgtatggtgcacgtggcgcagaataaaggttttttcgagggagactactatgccccttccccctccggctttatcacctatgatctgccgtggggaaaaatcgcagttgtaatctgctatgaccgccacttcccggaaagtatccgcagcgtcgcactccaaggagcccagttagtgctcataccagcggtcaaccggaccgatgagccactcgggatcttcgaagcggagctacgtgctgccgcctaccagaatggctgctatatcgcgctgtgcaaccgttgcggcaaagaggtcccgcaggaaagcaccgaggggccgacctttgcaggccaatctctcgttattaaccccgacggtgaaatcatcggcaaagcggaggatgcagagagcctctttgtggccacgatcaatcttgcgcagtcagatgctgcccgcgccaagcggccctatttgcagcaacggcgacccgatcactacgaacagtgagacgcagggagttcagctcacatatgagttgaactccctgttttcgaaccaggtgttttaaagttagtcagttagatgggataccagatactcgatgatctgtgcgcagtgctcagcggccttgttctcaaaggtcttgtagtccatcgaagaggaaccgtcagccttatcggagattgcacggacgatcacaaatggaaccttgttgaggaaggcaacctgcgcgatcggagcaccttccatttcggtgcagtccgcatggaaggtatcgatgatgcgctgcttcttctcatcggatctcacgaagaactctcctgaggcaactctgccggagaagccctcgatgtcaggggccacgttcttgaccgcctcgagcgccaactcctgcaggtgcttatcagccgggaacacaacagagccgatgcccgggacctcacccggcttatagcctaagttggtgacgtccatatcgtgatggacagcgtccttcgctacgacgatatcaccgatgttgattgcgttgttgagggagcccgcgacaccggtgttgatcagatgcgtgaccctatagcgctcgcagagcgtctgcgccaccatagcggcatttaccttaccgacgccgcactcgacaactacgacgtccgtgcttccaagcttgccctcatagaaatcgcgctgtgagatcgtggtggttttcgcatccttgagctgccctttgaggtagttgacctcaatgcccatagccccgatgatgccgacttttgcctgtgccatatgcgtgtgtcttccttctccttacgccgcaggataggtgaggtgtttgctgtcaatggtatcaagcgtcttctcaagatagcgctttgaccaccatttggcctcattgaggtcagagtcatgccagttaccgcagtccttcggcgtcgctcctgggatgtccccttcaaagtttacgataaactcgaaaagccgtttcactaagtccaccatatccttggactcatagtccccaaagacgacgaggtagaagccggtccggcatcccatcggcccgaagtagatgatgcgggagccccactcattgtcgtttctcagaaatgtcgcacctaagtgctcgatcgcgtgaacgcctgcggtattcatgaccggctcacggttcggggcagtcatccttaagtcaaaggttgagacaatgcagccggtgtccgggtccttgtctctgcgtgacaggtagacaccaggctccagcaacaggtgattgatcgtaaagctttgaacggtttccataggacctcgcatccttagattttagatggtgcggctgcaccggtatcctcaacagagagattcataagccagggagccccgatcagggagcgcaggacgcgatcccgtgcctgatcgacgctcttattttgtttgatatggaatattgcctgcgcttctatgcccagggctgaggaacctttgagcagcactgagggcttatcatcttcggcttcccagctccctaaggctctctgtccccgcttcacaatctcctgggtgatgtgatcgatatccccggtcgccgtaagggacagcggtaccgtacactggctcaccgcagagtcggagagaatcgtcactgccgtcttattcaagacagagttagggatgagttgtactgaccctgagacgtcacacacctgcgtatgcctccacgtcacatcgagcacgaccccgaccaggtcccctacttggatgtggtcacccggcttgataacctggccgagcatgaggccaagaccgctgatgatgttagagatcgtatcctgcaggccgaaggagatcaccacagaggtgacgcctagggcggcgacaaaggcggtaggttcaacgccgaagaccggctgtaggactgccagcaacgcaaagatccaaatcaggcctttgataatgttgataaagatcgaggctgccggaatacgcgtcgaatcaaataccttgttcagggctttgacgacaatcgtctggatcaggtaagcgatcgcaaccgcacaagccaaatagaaacatcgtcccccgatgctccccggggcaaagaattgaccaatatcactaaaattcatctcagccctcaatcttcactaagggggcaaaccctttcatcaacttcttggtcttgccggtccgttcaaagtgcacgctcaccgtatcctggtcagccgcgaggaccaccccgggcccaaagatcttgtgggtgaccttgtctccctttttgagctctgaggctacccgcttacgcttagtctggtcagccagacgctgggattcaaggtactggccttgcgtctgtgcattgccggcattggtggaacgcgtataggagccaaagacatgcccgccgtagacctcggagccccgtccgctaccgtaggtgccacgccggtctccccgtttctcccaaccaacgccaccgaagccttgtgatccgacgccgacattctccacatcctcacgcgggatctcatcgataaagcggctcttcggatttgcggtcatcgtgccatactggcgtctcgtcaccgcataggtaaggtaaagccgcttctgtgcacgggtgatcgcgacataggcaagtctgcgctcctcttccaatccagccggatcctgctcatggccggagtgcgggaagatgccttcctccatacccacgacaaagacgaccgggaactccagaccttttgccgagtgtatggtcatgagcgtcaccgcgcttgtggagccggagagcgcatccagatcgcttctaagtgccagccactccataaaggcaggaagctgttcggatgccggcggctgcgctgcgggattcgtcgacgaaggctgcgctgcaggttcccgctgatcaggggtacctgcctccgctgcgtcgatcgctccagcttcttccaattgcttcaggctctcaagcgtagcctctgcgtcatcgtgcgtctcgtcgaagtcactcgctacgctgaaaaactctttgatgttttcgatacgactgtccgcctcgtcggtatgctctgcctccaaagattggatcagtccggtcttatcgatgatcatctgtacgacctggaccagttcgcctgaataggtgcgtgcttcgtggatgatattgacgaatcccgcaagggaattgcgggcacgggcgcctaagaccccaacatcacccgcacaggcctcacaggcactgaagaaggagatgccctgcttggtggcgtacccctgaatcttggcaatcgaggtggagccgataccgcggcgcggagtattgatcacacggccgcagctgacatcgtcgttgggattgacaaccagcttcaggtatgccatcacatctctaatttccgcacggtcaaagaagcgggtgcctccgacgatcttatagggaacgccggcgcgcagcagcatatcctcgtgtacacgggactgtgcattggtgcggtagaagaccgccacatcgttgtagctcgtccccttgtcatggagcttctcgatctctgcgccgacccaacgcccttcgtcacgctcatcggcagcctggtaaactctgaccttctcgccatctccccggtcggtaaacagcttctttgcggtgcggtgtgaattgtgggccaccaccgcattcgcagcatgcaggatatgcccagtagaacggtagttctgttccagcttgacgatcttggcatccggatagtccttcttgaaggagaggatgtttctgatatcggcgcctctccaggagtagatgctctggtcatcgtcacccacgaccatcaggttgcggtgcgccgaggcaagcagattggtcagggcatactgcaccgcgttggtgtcctgatactcatccacactgatctggatgaagcggcgctgatagcgctgtaagacatccggattgttccgcaacagcttcaaagcgttgagcagcagatcgtcgaagtccatcgcattggagcgggaaagctcctgatccagggcgcggtagacacgacccgctttctgatcgagcggattgtcgcttgcagagagctcatcagggcttctcagtgcattcttcgcattggagatcctggaacggatcgcattgaccggatagcgcttcttatcgatatccatccggtccatgatcgtcgtaatcaagcgctttgaatcgctgtcatcgtagatagagaactgactcgtatagccaagccgatccccgtcctcacgcagcatccggacgcacattgcatggaaggtgcaaacccacatgccacggataccaccgggaaccaatgcctgcagacgttcccgcatctcattggcagccttgttggtgaaggtgatggccaggatctgccaggggcggacgccctcatcagcaatcacgtgtgcaatgcgagtcgtcagcacccgcgtcttacctgagcctgccccggcaagaaccagcagcggccccttggtgcacagcaccgcttcacgctgctgtgggttcaggctcgaaaggtcgatggctggtttgttctgtccaccttcggattcattcacatcgtcgcttgaataataattatgcgctgtcagtagcatgtcctctaactcctgaaaaacaagtcatattcccgaaggttaagtgtagcgggcagaatcgacgaaaaaaaggaaaacggccaggcttcaagcaaaaggcgcacatccaagcatcactcatgcaggacccctgccgaccatccaagcataaatacccatcgcccaggtgaaagcaagaaagttgcatcaatactgtagccgctacactccactctatactacctgcatcgtctcaatgggcgaactgtaccaataagaatggagagagccatgaagagtcaaacagatgatcaaaccggacaggaatctatcgtcaaggccgacgccaagcgctcaaaattacagtcattcaaactgagagccatagtcattgcgatcatcggtatcattgtcgcaatcatcgcactctgcatgctggtatatgggggcattgagtcagtcaccccatcagcacaggcaacctactcttcttcagtgcaaaatcttacggccccgatagcacaggcacagttcgctgcgacggtttcgctcttcttcgcgatcgtctcttcgtcgattgcctcaatttccgtcgtattctggatactttcaagcctgctggttgactatagggaatcatagctttcacgtcaccgtgccctatagatggtgcattccatgcggtgtgaaaagactctgtctcgatcaggacggcatagtcaaacgaagccatcctcgcggtagctttgttgttaacaacgcaaatcaaagtagtaccttgagcgtcctactcaacatcctgcgccagcatgtccagtgtctcaagtgacagctcactggtgaaacggtaccgggcagaggtagcatgaactgccacacacggtacccacccctgtgttttctcgtcccactgctcaagatcagtgagcgagatggctctgattggatgatgaggagaaagcaccaccaacggctctgtcatatccgccttgttgcgcgatacaaactctgtccaccgatttcccccatcgtctgcatacgtcttggtgatcgatccaataaagagacggtcgcggatgtagtcttcccctctttcaaacgctcccacctgtttgggttgcccgaagtagaagccggtgctgtagggtcgatggctcaccttgtccaattcagaacgccacagttcaggatcttccccgtcaagaacatggcgataggcattcgtgacgcagcccacgtagtaggcgcccttgttgcgtccctcgatcttgaaggaatcgataccagcatcctgcagctctttgagatgatcgagcatgcacagatcgctggcggacaagacataggacctaccaccttcctcctcaaccggcagaacccgctggggatcgtcgccctcggcaatcctccagttccaacggcagggttgcgtgcaggcgcctctgtttgcagagcgttcaggcccgaccaatgctgcggacagcagacatcttcccgagtacgccatacacatcgagccgtgcacaaaggtctccaaggtgagtgtcgggggcaaggcggccttcatgcgtttgattgccttgatgctcaactcgcgtgccacgacaattcgcgaagctccgagcgcggcataggctcgtgcggcctctgcattcattacggaatcctgcgttgagacgtgcagctcaacctgcggggcatatttcttccacaggcgcattacgccgaggtcggcgacgatgatcgcatccactccgatcgactggatccagcgcagatatccaggcagttctgcgatgtcctcgtcgctcatcagggtattgagtgtgagatgtatctgcacgttatgtgcatgcgcataggagaccgcccgctccaactcctctgggaagaagttgtccgctgcggcacgcatgccccagcgctttcctgctaagtaaactgcatccgcaccaaaatggatagcctcgcgcaattgctcgggaccacccgctggtgctagtaattcaggttttgcagtgttggttctctcggtcatgaacgtgttaagccgtcagggcgaagtaagcgataacaacgataccgaggatgatgcggtaccaaccgaacggcttgaagtcgtgcttcttcacaaaattcatcaagaagcggatcgcaatcagcgagaccaggaaagctacgatgcagccaacacccagaatcgcggcttcctcgcttgtagagacattgcccttggagaagaagcggaatagtttcagccctgaagcgccgatcatcaccggcactgccagatagaaggtgaactcagccgcgacgctgcgggagcagttgagcagcagcccaccgataatggtggagccggagcgtgaagtgcccgggacgagggacaggacctggaagcagccgataccgaacgcggttttccaaggcatatcctgcacccgctggaccgcggcttcgctgtctgcgagctcggaaaggtcgtttgtatcttccacctcaggcgctgccatgtgctgggggcgtgcgcctcttccttcgaggatcttcttcactttgctctcgcggacgttttcgataatgatgaatagaacaccgtagacgataagcgctgccgcaatcacaaagggactggacaggtggtcggtcatccagtcattgaagggaacaccgataatcgctgccggcaggcaggcgacaatgatctgcccccacatacgccaggtgcgtctgcgtcccgccttccctttgctgggcgaaaacggattcagctgatagaagaagagtacgacgacggcgaggattgccccgagttggataacgacgaggaacatatcccagaaatccgccgaaaccggaagcggcaggaactcgttcaacaggagcatatggcccgttgatgagatcggcagccattcggtgataccttcgacaacaccatagatcgcggaaatgatgagctctactagattcacgatgcctcccacattcgcattgatcttttgaaactctctcaaataacctaacgttctatgatattcaccgaccgctcttggaaaagccggacctgcaggcttcctcgtaaagtgcacgtttgctaggatatacaggtagaaagtgcccacaattcatgtgaggacacggacagatcagggaggcacgtatggcagataacaatcttctcgactatgacaaagtattcgtctcgctcgatggaaccgaacagcaggataaagtactgaaacgtgccataagcatcgcggcaaccaactatgcaaggctctatatcggtcacgtaatcgactccaccgcgctggaaaccgccggtaactatcctttggagctgatcccgacactggaagcgcagttcagggattccattgcagccctgctgaaacaggctgaaggcaacaaagatatccaagaggttaaggtcatcatccgggccggacgcatccgtgagaccttaaaggaagagatgctcgacaagatcgagccggatatcgtgatctgcggcgcccgcggcctgtcctccattaagtacgcgcttctgggatccatctcaagctacctggtacgcgcatccaaatgcgacgtcttggtcgtgaagtaacggccactctacagaagtgtgaggaaaagcctttgtgttgatgcaaaggctttcttcttagccctgataccatgaagtgaggttccattcccgatatgcttcccttatggatccccacatatttgggaatataagcagaggcttaacaaatttgtttttgcacccgtagagaaaagagagtttagagttcatgtcttcaaccaaaagctatcttgagcccgatccaaccttaagcgtcggcagcacccatgccggcttcaccgtgcagagcatagagccaatccaggagctctccgggacggcatatatcttcaagcacgatgcaaccggggctcgactcatgtggttggccactgctgacaccaacaagtccttcgcaatcggtttcaaaaccccgcccaaggactcaaccggcgtcttccacatcttggagcactctgtcctcgatgggtccgacaagtatccggtcaaagagcctttcgtcaatctgctcaagacctctatgcagaccttcctgaatgccctaactttcccggacaagaccgtttacccggtctcctccaccaatgagaaggacctcgagaacctgatggacgtctacctggacgccgtgctgcatccggctatctaccatcgcccgaggatcttcgagcaggagggctggcactatgagatggcggataaggacgcaccgcttacctacaacggcgtggtcttcaatgagatgaagggtgcgctctccgacccggatgaggtgctctatcagaaactgcagtcgacgcttttcccggacaacggctacgcctacgtctccggaggcgatccgaaggtcatcccgaccctcacctaccagcagttcctgaacacccatgcccgtcactatcagctctccaactcctacacgatcctctacggcgccatcgatatcgagcgtgagctcgccttcatcggcaagcgcttcgacgaggcaaccgaccgcaaggccggcgaccccaacccgctcaagctgcagaaacccttggttgtgaaggagccggttaaggtagagatggcgaccgcacagaagaatgcctccgcagctctcagctatgtgatcggcagctcccgcgaccgtgagaaggtcctcgccgtcgacgtactgctcgacacccttgcgggctccaatgaagcaccgctcaagcgtgcagtgatggacgcggatttggctgatgacttccaggcacagctccttgacggtatccagcagccgctcgccttctttgagctcaaaggcttgcaggagggcgccgcagcgaagttccgtccgttcctggaggagcagtgcacaaagctcgttgagcaaggcctggatcacgacaaactgaaggcctccctcgcacaggcagagttcaacctgcgcgaaggtgattggagtatctccgacggcgtagccctctccatccaagcactgtccggctggctttacaacgaggatgacgcaacgctctatctgcactatgccgacgccctgaagcatatgcgtgaaggcctcgacaacggttactttgaggatctactccgggagctgatcctggattccaaacacaccgccgccgtcgagctgattccgactgaggccagtacgcagtccgaggagaccaaagtactcgcagagcgtaaagcccagctgagcgacgaggagatcaacaaggtgatccaggaggcgcaggcgcttcaccaggagcaagcaacccccgattccccggaagacctcgcaaaactgccgcagctccatgtctccgatatcaccgatgctccggcagagccgaccaccacggatctttcaaccccgatcccctgctggttccatgagatggatacccacgggatcggctacgtctattactatttcgatctgaagcgtatcggcttcgaggagatgccgtacgtctcgctcttgaccgatctgttgggcaacctcagaacccagcaccacaccgcctctgaactcgacaccctgaccgagaccaagctcggcagcttcgacgtgttctacgacaactacggccaggacaacgatctcacggtcgtcaatccgaagcttgtggtcgccgcctcagctttgagcgacaacgtcgagtccttagcttcaatccccgaggagatctggggagagaccctcttcgacgcaaacctcgatagaatctatgagatcctgcagcagcgccgcatctcgctggagcggggcttcgtgaactccggacacacggctgcgatgaacgcagccgcggcgcaactcaccccaggcgcccgtctcaacgccaaactgagcggcgtagagttctacgaattcctgaagaagctcctcgaccgctggcggtaccgcaagcagccgaccaccgaagtcctctacaacctcgcgtcccgcatctttacgaaggaaggcacgatcgtgagcttcaccggctccaaagaggactgcagccgcttctggagggccgccggcgacctcaacctgaaagagaaaggcaccgactacatctctgccacacgccttaagatccctgaggtcacccccaaggatcaggctttcattatcccctccaaggtcaactacgtcgccgaggtttctcttcctgctccccatgattcaactgtgccgggaacctggcaagtagccacccgtccacttacctatagttacctgtggaatgaagtgcgtgtgaagggtggagcctacggcgtagacatcaggcaccaggcaaacggcatgacggaaaatacctccttccgcgacccctccatcgatgccacgatgcggcgctatgaacaagaggggacttggcttgcaaactggaaggcgagacccaatgagttggatggctatattgtctccaccgtcgccggtctcgatgccccgaagaaaccgaaagccaaagcccgtctccaggatgcgttgcgtttccagggacgccccgcagactatatccaaaagctgcgccgccaagtgctcaataccaccgaggaagacatccgcgctctggcgccttttctggactacgcaaataagcaccatgtaacctgcgtattcggctctgctgaggctatcaaagcctcgaagcatgacttcgagatccacgaacttatggaagagaagaaatagacttgagtcctgacgacattgttgcttggtacggacgcgtggcaggaaccaatctcgtcgcgcatccgcgctttacccataactggttgatgatgggctatgagctcatggcaaaaaagacccagatcaacgccgacaaacgctacctcccctccggcaatgaaggctatgccctctttatggaccaaatcgtaaagggacaggcccatcctaaccgttcggtcatcacctctatctttacgcccaacgagatcttccacagcatgggtgttcttccgctcactgctgaagcggttgccgccttcgtgagcggcgcccaggcggagcattggacaatcaacgccgcagagggcatgggcattccggagacctactgtagctatcacaagacactgttgggcctaagcctctcaggcgtagccgacccgccccgcatgcttgcggcaacctcagtagcctgcgatgcaaacaatctgaccttcaagaccttggccgacaagtggcgaatccccttctactatgttgaggtcccctttgaagtctcacgggactcaattgaatacgtggccgacgagctgcgcggcatgagggatatggcagaggatgccttccacgccaaactgtatgagcaaaagctcaaagagtcctgtgccctctccaaacagacgcaagagacgctcctcaaagccctgaggcacagagcagggcacaacctgcacaatgaaatgaccgtagaccagatggagatgctcaactttcacttgctgctcggcaccaaaggtgccctccacctcgctcagacgatggaccgtgattttgcccaggcagagccgtaccatggcctcaatttagtctgggtccatgtacagcctttcttcctgtcggtcttaggtgagcagatcaacttctctcagcgcgcacagatcatcgcctcagacatgatgtatgattgcctgcctccgacgggcgccgaagcgaagcttcccggagccgatgagaacggctggctcttcgatccgggcaaaccctatgagttcatggcggaaagggtcgtgcgtaactgcttcaacggctcctctgagcgccgcgccgacaccgtcgtgagactggccaaggcaacccacgccgacggcgtcgtagtcttcacccactggggctgccggcagactgaaggcgcctcagggatcatccaggcacgggcagaggaagcgggattccccaccctgatcctggccggtgacggctgtgaccgcgcaaactgcatggcgggtcagatgaaaacaagattcgatgctttcctggagcaattggaggcaaaacgtgtcaatcactgacaatacagtcttctacgcgtgcaagtacacacccctcgagctcttggcaggctacggggtaaaccctaagctgtgtgaggtccatccctcaaacaacgctgaggcaaccaacctgcttgcctctaagaatatctgcggcttcggtaaggggctgctggagcggctcctcaaaccggatgtccatgccgcagtcctcaccacctgctgcgatacagtgagaagagtgttcgatatcgtgcaggaccgcgcagaccctgacatgtttctgttcttattggatattccgcataagacgggaccaaaggaagttgagttcttcaagaagcagctgaaggatctcgcgcaggcatatgccgcctattccagcgccaccttcgatatcacccgtgcgatcggcgcgctttccccttcagttccgaccacagctgaccatgtctccctgatcggagcccatggttatcctgaactgctcgaggaagtgcaggcgagcctcccacttccggtggccaatgagacctgcaccgcccgccacatcgatacaccggtccccgatgatctggcacgcctcggagcgccctacgactgcgtaggatgtgatcaggcagatactggtgggcaggatccgctcgataccttcctcgattggtatgcaccggcactccttaaacagatgccctgcatgcgtatggaggatgtctcaaggcgcaaggaactcttcgcagatccccaccaaaaaggcgtagtctatcacacgatgaagttctgcgactactacggcttcgagtatgcgcgcatcgccgctcaccagagcttcccgctcgtgaaaattgagacagaccccacgacgcagagcaccggacagctgcgcacccgcctcgaagccttcggagagaccctagatgttcaaactgtgaagactgaaccgagaacagaacctaaagttcagaccccgtcacagccaggctcccctggaaagcgctacgtgatcggcatcgactgtgggtccacctcgaccgatgctgtggtgatgggctcagacaagcacctcgtctcctcggtgattatcccgaccggcgcgaaagccggaacggcatcagccaaggctatccagagtgtactggagcaagccaaactcactcctggccagatcagctgcaccgtcgctaccggctatggcagagatatggtcgagggcgcagacagcacgatcaccgagatcacctgccacgccaaaggcgcgcactacctcttcccgaaggcccataccattatcgatatcggaggacaggactccaaagtcatccatatcggggacaacggtgaggtcttatccttcgttatgaatgacaaatgcgccgccggaaccggcagattcctggagatgatggcgcgcaccttggagatgcccttgtctgacttctgcaaggctgggcttgagtggaaacaccccgtccgtatcagctccatgtgtacggtctttgcagagtctgaagttgtctctcttgtggccaaggacactccgatccctgacattatccacgggctcaataattcagtcgcccggaaaaccgtgatgctcgcccgccgcgtccatgcagagccaccctatgtgatgaccggaggagtggcacacaatatcggtgccgtccacgcgctctccgacgctctgaaatccgaggtcaccacccataaggattcgcagctgtgcggagcgatcggcgccgccctgctcggacttgaatcatagataatggctaaggacttgcggcacaggttaggctacataaactgtaagctgcttagacaactttggctgcaccgtggatgatcaattttccagtgtattcattgattaaacggggaatgatgtatcggtattcgcgcctccatgaatccgaaaacttgtgcttcttgagcccttcatgtccatttctccaaattttttagccatcagctgaaattaaactgtttcctgaaccccagggtgccaggcacctgggggtggatatgatttctggttgtcggaaaacgtttattttccagataatacttttgttttgtttccgatgctcttttttgcatactcgattgcgcccgactgggacagccgccgatgcaggcattacactgatgtttgcagtcttgccccagaccggtttgtaccattaaaccagcttaatgttttccgagggacagttctagtgatcctgactcccgatttccggcggcggacctacccagatctcttcggcctctttgcgagaaggcagaagtgcggccgacaagccagccaaaaacgtgtctttcatcaatgggcacttactaagcagccaactatatggcataggattatatcatttttctctgacaggatttgagaagacagtcctccgctgcggtactatatctgttagtagcattttcacaagaatgatatgagtaaaaaagtggtcacagatgaatcgatacatgatttgtcttcctgaggatttgattgaactgtttttagaaatgatctgcttctactgacattttggggaaggaatgactctgtcctggggaactgatctcgcgaattctctctctccctgatacctgccggaaccaccaggaaatgatttaagaatcactaggaacagtcccttttcgctgaaaataagaagaattggatgtctccgtcggccccccctgtgcggaactttgtcaagccatgcactctgaatagccatacccgatccgctcacatccggatattttttttttttaaagaacctgtcgtagtaccccttaccgtatccaatgcgtggttcttatcttgtcaaggatcaggcccggtttgtaaatgaggaaggcatttccaccggtgtactcttctgttctgtcggtcggctccatggacatgaaaagttccctatttaaggaatttaagtcagttaccttgttaaaatttaatattatctccctctgtcacaggaaaatagagggctttttttcttcctcaggataaaccctgccagagacaggaagaatccacctcgctgtcccgagggatagccgacatggaaataattttatcgctaggcgcgctgaagaggaaagttttcttcccacatttattaaaattgccattatactactctctttcgagtattttctgcctctcttcggctggaaatatgtccgcggactttttgttattgtatcttgtctttctgaaaacgatcgtctgaacgcacatagaaccccctccttataggcagatggccatctgtcgtatcttttctgattctccgtttcccatcactgcaagccatgttttctgagttgcaactgtaacaggcgccgtatccgttgtagtacctactgtacgactgttctaatgccgtcacgccacagatgtgaatctcgtaaggagtgccgaaagcccgtcggaaatctggttgttttcgcaccgtatgttcctactgacgtcctggaacagtcccctataaccaggatgttagaaaatggccctccgattaccccgctcgcgaggcgccctcaaattgccggaaaacacagatgacgcagttcttggcagctctctatagcatctgtctttcgataagactgccatgtggattcgctacgtacttgtttccgtttcccgaaatcgcacacgccccatcacctctcgaacattgcactttccaaaccgtaaccgccgcttggtgtccggcctctcctctgcgaccccagatccgattagttcggcagtactgcggttttgcagaaggcggatatattgcctccttttctggaagggtctgcacttttggtttttgggcacttaagaatcctgctgatctggatcgtattttcaccgttgaattcttttccatctgcgacacgctggtcattttttcttgtataaatactcttccgatctcattttatctgatgcttattcggcgtctcccggtcttccgaaccgcctctctccatctttgcgtcaacactaattttttatagatctggatactgattttttccccgacccatattcgtcatttttttccctgacaggaaacaacttc

SEQ ID NO: 364 - DNA, 16552 bp, Unknown
  Metagenome-assembled genome
ggcgcaaagcgatgcggggcggcaggccacggtaagccacattttgtagaaaataactgagtacctccagcataaccgcaggagttcctgtcgcctccaaaccgtacaatgaggatgcaaggttgatgcatccgagagggcggaaaaagagatggtaaaggggcatgcaggcgctctgagcaggcgcgaatgcgagagcaaagagacattgatgggccttctggagaggttctcagacgaggagtcgtgcgaggggaggctgctcgatgagaaggtctccggcggctttgtctgcccggtgtgcgccaatacgtcctgctcgaaggtctgaggccgcgcgcacaagtggcagtgcacgaagtgctcgcaccaggtgagcgtgagcgcagggactattgatggaggggacccacctcgagctcaggaagtggttcgtaggcgatatggctcatgtccgcccaaaaggccgggatcagcgcctgcgccctgcagaaggcagataggctgcagcttaaagacggcagggcgggtccttttaaggatatactcgcctgggtcagatcgcagtgcgttcagtgtccttgcagctgacacgcttaaggtggacgacttctatatcggcgccaaggcggcaggcaaaagcgggcgcggcacaaagcagcagccgatgcttaacagcggcaggcagggctcctgccccctgcgctgcgcaaaggggtgctcgaaagattgctggcgccaggtggggcatgaccagctctgccatacatcgaagataagggcggatggctggagcggcaaagcttgccggcctctcttcgttgtgcgggctcgtctaaagagagtacgacagagcggacggggatgcatcccttcccatggtccacagggtgatatccaacttcaaggcctacgttgagggcaccttccatggccttcccaaggcccacatgcactccttatgcggactcgttcagctaaagatacagccacagggatgtaaggggatggctgcatggagctgctgcacgagatgtgcctcatccatgtcttgctctccggcatcgcagccaccgcgacggtccagccgaagatgccttcgatcttgcctaagccgcttacagttcagggagcctaacaatgttggaggtactcagccatttcctcgaattctgtcagccatacggttcctccttccagacacagactatttcatttaatgattgcttttagattgctttaagcaatcatttgtaatatactgacttcagaaatatggaggaggtgcttttcatggcaagaacgatatccaaaacagcgaacgtgtacacgcgtgttgatcctgcgacaaaggagcaggctgagataatccttggccagctgggaatcccgatgtctaatgcaattggtatgttcttaaagcaggttgtcattcagcggggcatgccgtttgaaatgagactgcctgccgcaaagccagtctccatcggtaaactgacgaaggaacagttcgatgcggaaatgcagctggggatggatgatattgcagcaggccgcgtcatttccgcagacgatgtggaaaccgagatgaggagactgtacagcgaatgaagattgtctatacgtttcgggcgcgacaggatctgagggatatctatgagtacatcgcatttactttgctcgtccctgagacagcaagcaaaataacggataagatcatggaaatgatccggacacttgattccatgccagagagaaatcctttgtataaagaggaaccctggcacagcagaggtgtccgttttctacccgtcaataactatctgattttctatatcatggatcactctgctgatatggtttccattgcacgcatcatgtacggcggcagagacatccagcatcagctgaacgaaaccaacgagtggtaacctgaaagcccctgtctgcaaaggcaggggcttatgcgttcagaaccggtccatcatttcctgtgtagcgatttccgggtaatcatagtcgtcattgctcatctcggcatacatgtcggtgaccgtgccgatcgtcagaaggttaagctcgctgatcgaaagaccgatctgtacgcaccgcaaaagaaagagcggggtgatcatttcctgctctgtcgtctgctgtttttttagaagccacctgctgctctatattgatgccccacagatcaatgatctgcgggaggatctcatagatggagaaggtggaaaactcatccagccattcctccgggctgcccggcaccgccttgtccgcgtgttttgccatgagccacgcgatgttctcaaagagttccagagaaaagatatcaagtctggagctttccgcattgttctcatcgatccctttctgcagatcgtttgagtcccggtaaatgtcctggtgaaactggttacggtagagtctcggtatggcggcggaggcacggaacgtgacctccctgccgtcaatcgcaacagtttttgttactgccatctgctgtatcctcctttactctccctcgccagtcccactgctggaactgccggggcgctcggggtatagactgcgttataccaagcgttatagacggactcacttgtattcgtcccggtcttgaccttgacaaggccgtctagtatcggggatacggtaagggacagggtctccgtctgtacctcgatcgaatcctccttggtgctgcccgatacggaaggacgggtcgcactgcagtaatacatgcagtggcggatcttccgctggtcgccggaaaactcaaagagcagggcgaaatgctccggctccacatccttgttctcggtaatgacgccgttggcggcctcctctgcatgcgagctgcgcaaagccatggcgggctacccacacaaactaccgaagagccaaatattctcgtgttactactgcgattttcgagcgtcccataaacgtcagaaatcgggttttgggaacagtgcaaagaatattttcggtgcgccgacgacacttgaaatcgttccgaaaaccctcccttcctggttttgggaagaaaaaatattcttcatttctacctgcggaaacgcgaaagcgacctctcgaaaacaggagtgactacacggtgactacatggtcgccgggaaatcggctgtccggctaaaaaacgcgatagaaacgtcccaaaacatttggcacgtttttggaacgattggcatgttttggcgtctcgtatcatctattaccgtcatgaacggccagtggagagtatttgcccaggttaacaagcgaaaagagcgccccgaaatccggcgattccggggcactcccaacgaaaatattcagcaaaagtccgggtggctttgtcctattcctaccactagatgctaaccactgccaatacatgggcggcttactactagatggaaaaggcgcccaggctattcccactcaatcgtcgcattgcccgttttcatgtagtcagcagggcaggtgagctgggacttcctctactctcctatctcgaaaaccgtgtagtcaccatgtagtcggcactgactacatgccatgtagtcacttgggaagagtattttcacccgaccgaagagtgacatgtatgacctgcggaaacgcagttcgattgcgcgcaactgactacatgagctgaaacggcgcgaatggggtggggcgctccccgacccaagagtgacaaattgcgagtgaagagtgacagcgctgaactggggaaacgcacatactcacatcttgggtgactacattgaccgcatatccacaaagcggcgtcttgggcctatgcttcttcactcttcaagcgcttgataaacgcctggatctcattttcccgctgctctgtcgtgagtgttttagccatttcagttagcttgtcctgtcttctgcccgcgtactctacaagaaattctgcatatctggatgctttcgcacgatgttcctctggaatgtcgtcatcaaccttgaacgcatcggcatctatggtcgaatttttaccaggtgcctcattctcatctggcgctgcatcctcgtcaggtgttgcaccttcgtcgggtattgcgttctccacaggcgaagtcacccaaagcagaaagtctgcatactgatttgaattcgaaaggtcatatgcggcattgttaattctgatgactatattgccagcttcattacacgtaatcatctctcgtcacctacctgaaaattatatttatttagacgcatctttagataccgttcgccgccatcgaggacatcggcgatcttctgctttatcgctacatcgttcatcgcgccgtgagcgtagctgaaattatcatcgtcgttttcgcagacgatgacgttacgcgcgtcgccgttgacgatgactggcgccgaatggcttactacgaaaagttgaatatcgaactttagcttcttcaacctgtcgattaagaaatcttttatggtcgctacgtcgagattgtcttccggttggtctagaacgatgtacatcgatttcccctcgatgacctcgtcgttcaggaacagcttcagcagcgcctgagcttttgtcccaggggacatgtcgtccacctgtttaccgttaaccgttatgcccgttttcagcctatcggactcggcaaccgcattgttaagctgagcgaagaacctttcgtaatgctctttgaggctctgcttagacatgcccctgaacttggttccgttgaatcttgcgtgcatctcatcgctgtcgtattcatgcaggaaagcctcaacaagcgtctgggaatctcggctggattggctgtttagaagctcgccgaacttatcgtcgaatgtcgtctcttcgctataagccagggtgatgacgatggagtctttgtcatccttaagttcaactggttttatggggctatgcatcttctcgtaggcgcttcgagcctcactgttaagccattccagagaaaacctgagctcggtgaggtcatcaaaaaatgcggctacttcacgcgttttctcgcggtactgcgtaagtgctgttgagtcgctttcgctgttgtattcgcgagctgtggaaaagaactccgttattagctgctcgcgattctcgaaccagtcagaatcgatatcttccagaagggtaaataggcgagtggtctttctcttcagttttgacagctccccctcgatggaacgcgcttcagtctccagggaagcgaaaagttctttatcctcgggataggtgtttttaaacgatatggaagctgatgtttttgatgcagcctccagagattccagcatctcgcccaaatccgtcttggcttgattgattttgagaatctctttgtctgggcgcgaaggcattgcgatcgagatacccgaagggacttcactgtcgaggtggtccatatggatggagcctgaactatattttgtgttgaaggcgagtagcagcttcttctcaagctcgatgacgtcattaatacgttttttcgccttcttcgactcgctttccgcagactgcttcagtggcgagattctctcgttcaaaaatggaatttcctcgtatttgccgtccctaaaaatacattcgagctcaccttgaccaaggtaccggcactgcggatggtccgtcgacggcgtacctccataggtcgtgaacttgacgctgtctgcatccacaaacttggaatatgtgtccaatccctttccggctaacaagctggcaagcagagtcttgccacttcctcgtgagccaacaattccgttgtaccccggtacgaagggcagtgtggatgtgtgacggctgccatcgttgtgaatcacatcaaaggacactgattttaagaatcccgcggtgtttgtctggggcagcgctggaaattggtccgaagttctaattcgactttctgggtcgcttattgcaagcaggagtgattcaaggtcgccatcgaagtctatccaagtgaactttgatccgatttcgtcaagtgcttttgcatcactaaacagaagcgcagcaaccgtggtgttgagttcgtgcgccagaccttttgagatgtgctttctgctcttctctccgccttcgactgccatggcatggctgtagtagaagagcctatccttgtaatccaggtttgcttgtgagctattcggtaggtactgggacaggcttctgtctttattctcgtggggaatgaagaagtgctggagcgcagatgctttctcctgaaagtcttcgaggtaaattgcgattccttcagtctgcttggagaatgccttgcttggcagtagggagaggctttctgcagtcagtccgtctggggagctagggtcgctcaatatcgcatctataaataggtttttgattatgcctgccatttcagcagccttgcccatatcaaaccagacgatggcgtggaagtagtcacctttcctcccattgccgagggtgagatgatacatggctattgtcgatggttttagcttgatattgatttcgacaccgccgataagcgtctttccatttgcgttcgtatcggaacgcagccgtcccaacaattcgacatcaatgttgttgtgatccgtcactgccaacacatcgagatcgctattaagcacctgcgacaggaaagactcttcatcgtaacttctactgtagcacgagcttgaatgcacgtgcatatcgcattttttgaacgttccctttgagagcctcgccacagttgtcatagctacaacctttcgtagcattcctagcatttatgcgtctattttctcactgcaaaacgaatagcggaggcgcgcgctgggatagtggtgactgtgtgttgcattcgtcgataacgctttgcgtaaatccttccccaaaccatgacctagcgtggcttagcgtggtctaacaccccgcgtggctttgcacatacaactctcaacaggtatctctctgcttgctacgtcgaatagacgagattctttggacttcgttgcgactcaagctcaccagatgcaaggcgagaggatggaaggccgtcccgataaagaagacatcctccagatgcaatgcgacgcgttcccggcacgcaccggaatatcggataatgatgccgaaaaccgcgagaatgccggggcggagatacgggaacctgctgccgtcccgtcattcgaagcggatgacctgcccgaaggcctcatgaacgtgccgcaagccgcggaccacctgcgcatatctaagacgtccgcccgcaagctcgtcgagcggcaggcaatccccgccgtaaggacctggagacttcggcgtgtcagggatgacgagccaggcgaaacgctccgcgccatgggcaacaacacctgatcgggagtcccatggccgcgcatcccttgtgacaggaactcgctgcatcgctgcaaccgaagggagactgatgctggggcccagtcgaatcaagactcggctgcctttgtccctataaaaaactagagcggagcccggtgggtcccgcccttacaaaacctgtaggttttccatgcacaccgttctaaccgaacgcaagcgcgccgtcaagccggccatccgggcgcacggcgcctactcccactcgcgcgcttccggattccagtgcctgccgcccgcctctccccggatcgcggggtcgaggagcctgccggcgagctcggatgcggcttccatattcctcaacgcctccggaaggcccgtcctctggcagagcttcgcgtactggcgcgcctggggagcgccccaggccttcggcaatccgaaggagtcgcccagaaagatgcgccgcgcggaggcttcgcggcgcagtcgggactggaaccccgaaccgtccaccgtggccgtagtggcatagacggcgatgtctacgaggtcctttaccctggatgacgctctccctccgtgaacttcgactatgccgcagagcttgtccgcgagggcggcctcaacgggatagacgaggtagtcgcaggtctcaagcccttccacctctatcctgtccgccggggagatgcgctcggctccctcgagcggcacctcgtcgacgacgaggtcgacggagacgggctgcatgcgcttcgcgccgagcatggggacgaacccgacagacagcccgctcctgtactcgtcctcggcctttatcgggcgcgaccccgcgaactcgaacgtcacgaagtcgcccaggtcggtcccggcgagccggacgagctcctcgagcgcatcctccaggctcccttccgtggagagcaggtcgatgtcgcgcgtcgcgcgggcgtcgacggtgcgggcgagcatcgcccgaccgcccttgagcacgaacgagccgttgccgccggcgaacacgcggcacagcagtcggtggaagtagaatgccgacacggcgcgcccggtatccatcggcgacgccgacgccgcggatttgaccgccatctcgagtgcggccgcgctcttgtacctcattcccgcgtccccctcccgagaagcccggcatcatccatcaggctccggaaaatctcacatccccgcttctcgccgtaacggccctcgagcagtccccgaagcttcccgtagtcgaaatcctggtacttcctcgaggcgtccgccaggacatccgccacaagcgagaagtcctcgtcgtccgcgacgaggtcgaagacggtgcgctcggagcgcgtcacggggagccccgactcgaacgtaacttcgtcgcgacccaccgcgcgcctggcgaagctcgccgacgggttcctcgtgttgattctccttggggcatagagccggtagggcgagagctgcaggtctccgatcccgaggagggcggaggcggtggaccctccgacggcgatgccgtcccaatcggaaacccgcatcctctcgtgggagaacgtcgccggggcggtgagcttccatatcgccgccagctcgtccgtgaaggaagagccggaccccaccatgcggtaggcacctcgcacgacgcgcacgaggcgaccggactcgaccgcgtcgtgtagggcgtcgcgcgggatgcccatgcgggccgcctgtgcagtggtgaaaacgccctcagactcggagagctctgcgatcttatctatgtggttcgaatgcttcatgtagcaattgtaggctatttccctacaattgcaacacattatcccaaactcaagtactactgatgctgcgaaagcatacggaacggcattcgatgccagcaactgccagccaatgccaaatgagttttattcccactcaatcgttgcatggcccgtttctgtgtagtcagcgggttgggtgagctgggattccctccactctcctatcatgaaaaccgtgtagtcaccaagtagtcatcggtgactacatgctctgtagtcacctggggagagtattttcgctcgaccgaagagcgatatgctttatctgcggaaacatatttcgattgcacgcaactgactacatgggctgaaacggttccggaggggtggggtactccccgactcaagagtgacgattcccgagtgaagaatgacagcgctgagctgggaatacttgctttcctgcgtgcaaggtgactacatggctgcatacccacagtacggcagccaaccgccaacaaaatcgggtggcactcggattcaagaggcacaacggagcgaagacaggtggttactggcttatcgatttctgagtctacgctgcacgtttgtcaaggtggtctcgccgtcgaagcccagtgtcagcatcaggtggtattcgagtagcgccattagctcggcgttgactatgggcagctcttcttttccgaaagccttgtccttcttatccgggctgaaatgggtgtagtagttcctcgtgtctaccagtttctggggaaaatcgacaaagctcatgtgctttggcgagacggggcgtcttcccccagcgtacaggaggtcgcttatcctgcttttgagatacaggctctttgaaccttgctggccactgtcgcataagaagtcacggacgtcagagtcggcaccggatgtgttttcaactaggcagtcaacacgcttcttgtaggttttgacactgtcgcacacaaatcgggcgtgataggtctccagagcctgcatgaggttaaggaagagagccatagcggaaggaaccctatccgtataggcaagcgtgtagaggtcaacgaccggctcaagctcgtcgcgtttctcaaaccatgcacgtagggccccgcgctcgtatgcctctgagaggttgaataggaatgtccagcggcgagaattctcatcggccacatccctctgttcagtgccgagcaggacgtcagcgggctcgtagcgatcctgcccctcagccccgtattcctctggcagaagatgcgaaggatgtaggtatcgtacccctctgatgccgacctcgcggcccttgccgagctcaatcagccgcctgagccagtccgcatcgtgcatgatttcctgccagcgtctaggctcgtcgtagaagagacgtgcctcaatgcgttggtgaaaagtcacatcgttgtggtagtccacgaagctcattgacccctgttctggagagaaccgcaggtggaggccgccggtaacgtcgagcttgatttcgttctcgtgcgaccacctaattatctcgccgagctgtcctttcttggtatccaggtcgtagtagcagagtccggcccattcgaggacggctccatagtcgatggtgcaacctcgaaacaagggagattcgcagtaaggctcctcaagaccccagagggcatagtcaacatagacggtctctgtggtatgactgcctacgtgcgtgtgggtgttggtcctgaggcatccgagaagtgcgacgtgagagcccgagaatagtttgccgcagataacggggactcgaaacgatgcgaggatatgcgagtcgaacgtctgggcgtcggacggttgtatcagcaagaggacgagcacccttgtttcttcgttgtaatggagggtaccctcgaagacctcttctgtatctggaatcttccagtggccagcgtattggatttcagcgctcataatgccaattctcttggttgcttgcttatgcatgggcatggacgtcgtcatcggactttccgataaggacatcctcaagccagattcatctacagagtccagtatatcgtgtagcggatacggcgactaagggatacaatcagcgtgactgggcgctgggagtaggacgtcactgcgggtatgtcgtcttttctcaccatgcttatggtcatcggtttccgtgcacgtgacaggacacgttttttgaagcgttatcacagcatagtttcagcaaaaccgtgcggttgaatgcatctgtaacctagcgtggcttagcgtagcctaacgccccgtgtggctttgcgcacgcgcctcctatcagctgtctctccgcttgtcccgtctagaagacgagactccttgggcctcgttgcgacccgagggcaccagatgcaagacgagaggacggtaggccaccccatgaaagacgacatcctccagatgccacgagacgcgttcccgacgcccatcggaatatcggataatgatgccgaaagccgcgagaatgccggggcggagatacggggatctgctgcctcctcgacatccgaaacgtacgacctgcccgacggcctcatggacgtgctgcaggtcgcggaatacctgcgcgtatcgaagacgtcggcctgcaagcccatcgaccggcagaagatatccgccataaggaccgggaggcttctgcctgtcaggaaaggcgagccaggcgagacgctccgcgccatgggcaacgacatctgatcggtgatcccatgacttccgacatatcttcatcgcataaaactagagcgaggcccaatgggtcccgcccttacaaaacccgaaggttttccatgtgcgcatattaatactcgtcggggagtcaggcgtcaaccagcacgccgagctcagtcacctcgtcctagggaaaggagcaaaggggcgtcaccgcttttgacggcgctcttagctacagcagaccttccacgaagggtttgagcttgtcgagcatcgcgtcgcttctgatgactgtacctaaatcgaggtgctcactcttctccttcgtaatcgtctgagtgattacgcccatgaacagcagcctggagccgagggcaattccgtcggtcgtgggatagctgccctggttgaggatgaaggcgggactgccgctggagcccccgaatacagatgcgtcaacgaggaactcgcgcttgcccttgtagtcgttccaagcgggcgtggaagtccagccttgcctgatgaggggggtcttgttgtagtcgtcatagagcccgctggggtatccgatgaaggtgatttgctcgagcgccgccaaattgtccagcacactcttcttcgggatgagtccagagtcgatggagcggtagaagggcctcttcccgttttgttcgagcatgctgagaacaggggccaccggcatcgcaaccaagtcgagctctccgagcttcttcccctcgatgaatgacttgtcgaagttcacgctgatggtctcgcgtgacggggcgtcaccttcggctagattgatgacgaagcgaccctgaatcacatccttgaggacatggtgattggtaatgagcaggggcacgttgcgcccgtcctcaaggtcataggaaaagaagaatcctgtacccgagacgcccgtgccttcggcagttatgcccacgatggggaccgtggtaaagagcagctgtgtgctcgtatcattaatgttcatcggtcttggtctccttgtcatcgggatccgccaggtgttctagaacgcgctcagccagatcagatttgccccggttctcttcttttcggataaagataaaagcgacaaagagtcctactgcgccacacggtgctacgcagagcatcaagataccgggcaaagatgcgagattgacagatgacgacaaacctccgagaaaccagcccaggaacgttgttgcgagacctaaaaggatgtcaggtttgtaggaagggcgctcctgcttggcctgaaggagcatctcccttgcttttctcaggtcgctgtcgcgctgtccgacgtatgattcctgcaggtattcatcgggaatgcgaacctcgtggtcctggcgcacggcgacgtgctcccggtcatttatgaggtggatgccattacttgcctctccgacgctagtattgtcgcccatgtgctcgaatacgctgtcgaggtcagcccacctgactctatgggcaagcgcctggtcttgtggtgggttctcttgacctttctccaccagatctccttagaacaaggtcctggcgtcttgcggaggtttatggtcacagcagagacaccatggttcaaccaatatatcgatggatagattataccgtgcagctgatatggcgaccaagggatgcgggcggcacggctgtggggtgctagcgacttgcagattgctggtgacaggctactactagcggcgtggctttgctgttggctcactccgccgcccgccccacggcgccggggatttctcggctcagtggggcggcatcggttgttctagcggagtcggcaccgtcggcaacggaacgtatactgcgctcgtcgcgctcatggccgaagcaactgtggctggggagaaaggctggagataatgaacgagctcccttgcagaaacgagtggtggtggaggctcgcgcgcacggtggcgcagggtgtgcttggcgtgaccatcgccaacctcgacctgctggtcggcacctagtcgttcatgtccaagtggcgcgccatgcctcgtggacgtgccgcaggtcgcggattacctgcgcgtatcgaaggcgtcggcctgcaagcccatcgaccggcagaagatatccgccataaggaccgggaggcttctgcctgtcaggaaaggcgagccaggcgagacgctccgcgccatgggcaatgacatctgatcgggaatcctatggccgcgccctttgcataaaaaatagagcgaggcccagtgggtcccgcccttacaaaacccgaaggttttccatgcgcgcatattaatactcgtcggggagtcaggcgtcaaccagattccacacaaagtcaaagtacgcggacaaaatgggccacttcggcaatctaggaatgagtccgcgccttccaaatgcgaggtcatgccttcctgaactgacgcttcctcgtcgagccttctccgattaatttgcccgattctatgagtgcagatacgtgagcgctggcgctgcgtttcgagactccggcggcctcagctgcctccgcaagcgtgaagctgcgtcgcgatgtcgcgagctccagtatggcctggtcaatgtcccccagtcgctcgacaactgtcgcttcggtgaacaaagctccatctacgtctggaactgtcgcgcggaaaacattcccgtccacaagagtcgggtccccgcccatgaagcttcgcgcatacttgaagaggttgcgcgtgccgctccctaactcctccgcaagccctatctgagtgaagacattggcaatcgaggggttctttggcatcggattaaagtcattgagtgtgatattcccctcaaagaacgttctgctggcgttttgggtgtgcaatccctcgcggtcaatctccagttttgcaggatagggactcgtgaactcccggtgaatgagcatgttcgagatgagctcacggcatacaatgccccgcacacttatccttatatctccctcaataacaaaggggtcaggaaggttacgctcgcagaatcccataagggcatcgtacgcatcgatgagattggtcttcaccgttagacggtcgtcgtagcggtcctggtcacgcagcctgacaacagcatcggttttgtaagtaggagagagcgagccaatcgtctcatcactaccgaagagtagtcctgctgcaagggtaagaccttcctgtcccgttgagtaatctttaaccagaagctgggcactgcgcaagagctgctcatcatccaaccccgcccagggatgcccaggccgccgtgccgtggccatcttccttgcacggtctatgagatctgcacgtaaatcgtttagcgtcaaatatggaaagattcgccgttcagtttcgagattgctcttgcgaatatacatggccgaaatctgactgccagcgctaacctttatatcggcgtcagcaatgcggtcgtacacgacgcctttatagcggtgaacatcagggctcatgggaacccagatgcggacgacggtcttaccgtttacggaaatggcctcggtttcgagcatcacggcgggatcgaacaacttgggattgcgagcaacgtttgcaatattgcgctgtatgtctgttactgcaccttccataatgccgctaacagtcccgttatcctccacaccaaggtagacgctgccgcccatgtggttggcgaacgcgcagatggtctcaaaggtgtcctgctcgggttgtgctccgcacctcttaaactcgactgacgcagattcaccctggactaccgtctctaacaacagttcggcttccatgcgggtactcgtttcaacttgagattcctttttcgttgaaattttagcattattcaggaagcattcgctcattcaggaagctattcgcgaattgcttcctgaatggcttctcgaattgcattaaacaacagccctaggacttcaaatggcgagacacattccccctgaacgccatgcttgacatccgcagaaattaaacatggatgtacaaccgcaattgaatgttgcaacgattgcagaggaatcgtcactctcgcattactattgccggttttcggggccgaaaataggcccaaaatcgcctattgcacacagtgtcgagagtgacaaacgacctctcagagggcccaaaaacggcctggaaatggcctggaatcgccggaaatcgcggattttcgcgatttgtcactcttcactcctacctgcggttttgcgaaacgaggggccgaaagggcggggtgactacaaagtgactacatgcttggccacgaaacacgctcgcggctaaaaaacgtgatgaaaatactcttctcgctttggcatgttctggcatctagtcgcatctcttggcaacaagtcgcaaccagtcaccatcgcacggctgagcgaagagtatttccgcaggttaacacccataaaatgagccccgaaatccgaagatcacggggcaaattctcgattgtcactccccaaaagtcccggtggctttatccaatacaggctattagttgctagccgccgcgactagacgcgcaggaagagactagatgaaatgggcaatttcgttattcccactcaatcgttacatggcccgtttctgcgtagtcggaactatcgccgacctgcgataaccgtcactcttcaatcgccaactcagcgtagtcaccatgtagtcagtggtgactacacgct

SEQ ID NO: 365 - DNA, 6843 bp, Unknown
  Metagenome-assembled genome
acacagtatccggttttcaaggttcagcgcactttgaagaccagtgccccgaagcgcgagcattaaccctacacgcccaccgaccccgaacatgtgggatttgtcatgttcacagaatggacacaactcaactggggttttgctgaaagaattctgtaaacggtaaatcaccgctggtatcttttgaagagatcccaccacagacactgtagcgatgtgccttatcatcctattcatccctatgcgtcatcccttagtcatcctattcatccctatgcgtcatcccttagtatcctggatcctaccagggataaccatgaggtactctctttatgccaaaccagatatggcattcatatggttcaagacggtactcctaaaaacctcgacaatgccctctaggatagagaaacacgcaatcgtttcttgggggggaaggacacacaatggggctcattgagcaaatgcagacacgcgttcacctttatgacgatcatatcttcacgctgccagaaggccccaacaaacagttgaccacaatgattgacaggcgtccgttagcgcgacgcccgagacggtttactgcgacagtcactatttcagattgcatcatccgtgacaatgtgcacaaaatcgatgttcaaagccgggattgtactggctcatgcgtgctggtcggtatcagaccatgcggcctgttgaactgcaaaaagcttattcctctcctcaaacggtatcggacaatccggatcacttgtatcaaagaatatgggagggttgtcaccgcgcttccgagcgactcctggtttgaagccgcacgggctcacctgtacgatcttccaccgaatgtttctgttatccgtgcctatctcacgaaacgggattggggatacagaagtgaccgccttcatgtactggagcccctcgacgtaaccgtagtccgtgatacatcctgcgggccggagggtttccgcatgaacttctattcagccgaccacatcgtcgcctcggtccctaacaagttctatgcgtttcagcggctgatacgagaatacccagaccatatccttgcggcgactgcagaaacgttgagacggcagacaagcggcgtctaccaccgcctcaacgtatttgtcaactgaaggcgggaagttcgatatcctcctagaaggatcctcccccgccgcctccgccgaagccgccaccgcctccaccggagaagcctccaccaaatccgtctccggaactgaaggttgaagaagcaagagtggatgtgtcaactgcatgcataccggacggcaaactgttggtgaaatagacaaagggcgatttgtcatatcctcccacggcataccagaagaatggtgagtgtgtatcacttatcagctcgttatagagctccggctcagcgaccttcagtgcggcaataactttctgagagataccaaaggtgactgccatcaccagcaaccggttccacagtatgacgtcgtggggcactgcctcatcgagattcgtgaagtcctcaagccagtgcctgagtgccctcagctttactgctatctcgcgtccctcaggtgtataggtatccatcagaccagcacagataccactgacaacgctcgcaacgatggagaggataagaaacgcccccatcagagcagggtttgaaagcacgaagagcccccacagagagactgcggctgcgacaacaccgaagaagacaccgaggtgcgggacccccttgctcttgttgtggccgacgaaatagccggcgttgagcgtggcttccataacggcagaagtccagttctcataggcatcattgtaggcccgtgcatgattatctgcggctttcttgatcccatagaagtagacacgcggatgttcgctgttggcctcttcatcccctttctgtttgatcagcggagccatatcctggaacaggaaccccatagtcttctgatcaagtccctgcggatcattctccttctcaggccatttaacaaactcgacataccaatccttctccggcttatggaagagtctctttttaacaggctggtcatgatcgagcctgatataacccatatcgctcaatctcagcactgaggcagaaaacgcgttaccgtccgcttcagcattgttgagcaccgcattgagtaccgccgggtgatccttgctcggtacgtcgcggaagtattcatcgtcgaagaggactttgctcttctttttccaatcccgatacgcaagaatagagaaaacgatagcgaaaacagacagtccaatggggaccacaaccgcaaccacttgctcaatctgtgcccgcctacgctgagcatttgcctgatctgcccaagtctgttcctctgagagcaccgtttgagtaatgctggactgctgaatcgcatcgggactcgccgcagagagccattctgccggaaagagaatcctcgcctcagcgaactcatttcccccgacgccgggagccgtatacacgacactgttgccattaaaattgagtgacccatcgaggggcccgtggccccatgcccgcacattcttccctggctgcaccgactctccggaaggcaccggcaggttgatcgtgcaggtcacgttctttgattcggtgtcccagccatctgagacgaatttccaatagagctcagaggcatcttggtagcggagtgcgagattgggattacggtagacaatccggaaggttacggattcatcatcgtgagccgaatagattgtcagcgtctgcaccgttccgttatccctgatactgtaggtcccatcactgtatgagctgctttcggtaagtggcacttcctggccactctcctcgaggtagaccccctcgatctgcggcacgaccgagacgctgccgtttgacccttctggaattctccagtacaccccgtgaaaggtacccgtaaaggtgcgggcttcactcacatcgacggatccatcggcttcaacggtcgcgttgatatccaccttgtcaatcgaggcttctgccgaagcagtcttcgggcttataacaagaacgaatatcagagccatcaggactgagatcacagtttttacggagcagcgtattctcccgtgcaccatagataaatcccctttagtatcgaaaaaactagatcaagtttaccaaagacatgctgacaataattcctagggacacacatcacaaaaaaatggggttaatttcttttttcaaattaagcgctaacaatagacatgttcataccacacaaatcaataagttaggttatctaactttatttccgtatttttacatacgatgttaggttgttaagattcgaccgttatactcaattgaatataaccatccaacatgccgatgccgcataccagtactctgattatttatgtagacctacatgcgtctctcactttgacgttcgaaaaggaagtttgcgatgcggaaccaaacccatacggaagggaccgtcacagaggacaatagtgcccattcccactcatttgaggtacagcatcacaaaaacatggtgcatggcacaatctgtatcctgatcgtcattgccctctttgtggtctgtctggggatcggacgcgtgaacattatcccccaggatgtggtcggcatcctcgccacccacttcttcggcgctgcggggaactggacacaggctgcgaccaatatcgtctgtaagatcaggcttccccgtcttatcgctgcggtgctcgtcggctcagctttggcaatctcaggtgcttcctatcagggactcttccgcaatcctatggtttccccggacattttaggagccagtgccggcgcctcctttggtgccgcgctcaccctgctttggaacttcagctcccgcgggatacagattatggccttcgtgatgggcttcatcgctgtcacgatcacctacgtctctgcccgcagcatcggccgtggcagcaaccagattctgctcttggtgttgtgtggcctcatcgtcggtacgctcttccaggcccttgtctccattatcaaatacaccgccgatccagagtccaagttaccggagatcacctattggcttatggggtcaatcgctaaggtgacctgggaggatctcagagtctttatggtcccctacctgatcggcatcatccctctgatcctactgcgttggaggctcaattccctctccttcggtgaccctgaagcagcttcgctgggagtcaatgtgactctcctgcgaggcatctttatcctctgttcaaccctgcttacctctgcagttgtcgcgatcgcgggcgtcatcggctgggtcggcctcattatcccccaccttgtccgcttcatcttcggaccgaacaaccaggtggtccttccgatgtcgctctttgtcggggcaggcttcatgatcctggtcgatacggtctgccgcagcatctcagcttcagagattcccctcggcattctcacggctattatcggtgccccatttttcttcttcatcctcttcagaacccagagagatctgaaaggagaggaatagtatggctaacgtgcaagcaaaagtgaagactgcccatggtgagttcagcgatgaacagatacaggagcacagaggcacccactacctggaagcgcgcgatattacctgcgggtatgacaaaccggtgctgaagcatgtctccttaaaagtcgcttccggcgacgtgatctgccttctgggccccaacggtatcggtaagaccacgcttttcaagaccctgctcggttttctgaaacccatgtcaggcaccgtgattgtcgacggcgtaaaccgtgagacgctgacgagaaaacagttagcacagaaagttgcctacgtcccgcagctccacaccacacccttcgatttcaccttgttggatgtagtcctcacaggagcagcagcccacctcgccgcctttgaggcgcccaaagagcaggactatgcacgagcggatcgcatccttgaagatcttgggatctcgcacctcgcgcagcgcagcttcacccacctctccggcggggagcagcagatgggcctcattgcccgctccctcatgcagaactccaacatcctggtgatggacgagccgactgccgcgctcgacctcgggaaccaagtgcgtgtgctctccacgattgaagggatggcacaagacggccatgcgatcgtgatgacctcacacaaccctgatcaggcttttctctgcagcacgaaggccctcctgatcgtcgacaaaaaccacatagtcgcaggctcagtcgataaggtcgttaccgaagagaacctctcgaaagtttatggagtaccaatccgcgtcacacagacgacgaatctgcacggagatcccatcaagacctgtatccccctgctttgttaaccggcaacaggctttatttcctgtcacatgaaaggatgggcagactatggcagaaaagaaccaacattcactctcacgccgcaacttcctcaagctctccggtagccttggcgcggcactcggagccgcaggtgtcctgagtgcttgctcaagcaatacgatacagacaaccaataacaatgctggcccttccagcaactctagcaacgatacccataccatcaccgatatgggcgacaccgacgtcgaagttccaaaccacgtcgacgcctatgctgacggttggttcgcccacaacgagatctccatcatgctcaacggtgccaagggtatggtcgccacccattgcgcacccgacgctttcaagtggatgtacaaggtctgtccggagatgaataatgcgaccgctacgtttggcaaggacttcaacttcgagaacttagcctccctcaatccacaggtgatctttgactcttcagacaccctccgtgacaagtgcaccgaagccggcatccctctggtgaattgtcgattcaatacctatgaccagatgaagcgatctatcaatttaactgcctcaatcttcggcggggatgcttccgacatcgcaaatacctacaacgcagagctcgactcaaccctgaacgatatcaagggtaagacggacaacttgagcgacgatgagaagccctccgtcatgcatggcaacagcgtctacaccttaaacctcgacggcaccggtaccatgatcagcacctggattgaggcttgcggcggcaagaatgcggtaaccgagaaaaccaacgatgcgacccagacgttctcgatggagcaaattacggcttggaaccccgattacatcatcaccggcaaaccggatgaggttgaccagatcctccaggaccccaactggcaatccataaccgctatacagaacaagaatgtctacgtcaaccccaaaggcgtcttcggttgggaccgttacggtgtcgagtcccttctgcagttgagctgggcttctcacctgctgcatccggatatgttcgacgatacggatatcaaccagaaggtgaaggacttctaccacaactatctcaactacgatctgtcagaccatgaggtggagctcattatgaacgcccaagatccgaacgaataacaaaacggtaggatttcccatcaccctcccacaccgccgtgtaccgttcagtacacggcggttttctctgccatgctctatgattcgatacatgagaaattaagaaataaacatgttggccgttactttgaacaccttctcgctgtggccaacctgcaatcgtcaatttgctcttcccggtactactcttactatcttgagcgtaccttgttcaattgagctttagtttgttctgatgcttctcgtctcaggcagggcgctgccactgt

SEQ ID NO: 366 - DNA, 7177 bp, Unknown
  Metagenome-assembled genome
tcagcagcgagacgtggctgtggcgcaggtcgtgtatgcggatgcgcttgacgtgggacttagcgcacccgcggtcgagctcgtggtgtagcttcgccttcgtgaacgtgaagatcctcgagtcgggacctatgccgagcgattcgacccacggcctgagcccctctgccaggaactccggcatgaccacgtcgcggaccgacttgggggtcttggggggcgtgacgacgtcgcggccggagagccgctggtaggacttggtcaccttgacctctgcgcgcgcccagtcgaagtcggcgggcgtgagcgccagtagctccccgacgcacagcccgcaccagtacaggatctcgaaggagtagtagctctccggcttgtccgccacggcgtcggagaacctcaggtactcgtctcgcgtccagaagagcatctcgccgcccttcgacgagcccatcctcgtggtgcgtgcgcacgggttggaggcgaggccgtagaagcgcacggcgtggttgaagatggcggacagctggttgtttatggtcctgaggtaggtctgggagtagggctcgcccttctcgttgcggtgcgccatgagcccgttctgccagcggacgacgtcgaggggctctatctcgtccacgcgcatgttcccgaagtacggcagtatctttccctcgatcatgtacttcttggtgtaccaggtgtgctctctcagtcgaggctccatgtcggcagcgtagacctcgtagaaggccgcgaaggtcgagtccaccgcgccgtctgcgccgctggcgaactccgcctcccacgccgcggcgtcgtcttcggaggcaaagcctcgcttcgtcttgtggcgcctcgcgccgctatagtcgcggtaccagacctgcgcggtccaagtgccgttcgcctcgatccttaccgacatcccatgcgcctcgcaatcattccggaggagtgagcagcacggtaacgtgctctctactccggaagaataacagcacgctatcgtgctgtcaaacgtttgcgcacggttgcgtgctgtaatatgctttccccatccgaggagctaggaggacccgtgagcattggcgagcgcatacgaaggtaccgcaacgacgtcgacatgacccagagggagctcgccgaggaggtgggtctcaccgagtccgccatccgcaactacgagcgcgacatcaggacgccgggcgacgagcagatcgagaggatagccgaggcgctcgacgtgtcgcccgacgccatccgcgacatcggcgtggagggcgccaggggcgccctcgaggtgctgttccgctgcgagcgggagctggggctttcgcctgtggtcaccgaggacggcgtcgccgtcgcccccgacccgtcgaggcctggctcccagaaggccgcccaggccctgaaggcctggaagcgcatgcgcgaccggctttccgccggggagatctccgaggaggactacggggcctggaaggcgcgcttcaggggctgagggcgcgcagataaagctgtgtcgggggcgcgcgggcggccccccttctctttccgccgggattgtcactcttcggcaactactgcgattcgaaagcgtcccataaacgttcggagcagggttctgggacgcgtggcgagagtgactccagggtcttcggatgccgtcagaacccgccggaaacgcgtccgaacccggtcttcgggcggtttgtcactcttcgctcctacctgcgcaaacgtgaaatcggagcgccgagaggcggggtgactacacggtgactacacgcagggccccaagatggcgccgcgaccgaaaaacgcgatggaatcattccgttggtattggcacctttttggaacgagtcccaactggtaccaactaatctcatcctgtgtgggcgttgaacaggtgtgaagagtatttccgcaggtcataccacataaaacaagccccgaaatcgcttgatttcggggctgctcggcgaattccactcatcgaaagttccggcggctttgtcctattcccaccactagatgctaaccaccgccactagacgggaggcttgcaactagacggaatgagggcaaagttcactcccactcgatggtcgcaggcggtttcggcgtcacgtcgtagaccacacggttgataccatccacctcatccacgatacggctggagatacggccgacaatgtcaaagggtaacttcgcccagtctgcagtcatagcgtcagaggactcgaccgcacgcacgatgatcgggcgctggtaggtccgctcatcacccatcacgccgacgctcttgatgtctggcagcactgcaaagtattgccaacagctgtgctcggagttgcgctcaccggtctcttcaaagagcttctcgttataggcatcaagctcctcgcgcacgattgcgtcggcttccttcaaaattgccagcttctcctgcgtgacttcgccgatgatacggatcgccagtcccggtcctgggaacggctgcctccacaccatgcccgccggaaggcctaaggcgatgccgagctgccgcacttcgtccttgaagaagtgatccaagggctccactagatcgaagtgggtccccttggggaatgggatcaggttgtggtggctcttgatggttgaggccttgccgccagtcttacgggctccagattcgataatgtctgggtagatggtaccctgtgccaggtactcaaccccatcgagcttctgcgcgaccgcaaagaactctttccagaactgagtgccaatcagacggcgcttctgctccggatcggttacgcctttcaatagctccgcatagcgctcctctgcatgcacgtggataagcggcatcttgaactgcttgcggaagacctcctccaccatctcaggctcacccttgcgcagcatcccgtggttgataaagacacaggtgagctggtcccctactgcacggtgtactaacgcggcagtgacggcggagtcaacgccgccggagagagctagaatgactttggaattcccgacctgtgacttgatctcctggaccttttcgtcgatcaggtttgtcatcgtccaggaagcttgcaggtggcagatatcgaagaggaagtgcttgagcatcaccatgccatattgggtatggcggacctctggatgaaactgggtcgcatagaagccccgctcgcggttctccattgaggctaccgggcagctcactgtcgtcgaggtgatcgtaaagccctccgggacttcctctaccacatcgcggtggctcatccacacggtctgctcacctggggtatccgccagaagacggctgttcccgtcagtccggtgcagcgttgccggcccatattcacctttgtcagtatagccgaccctgccgcccagcttcttagccatgatctgctgcccatagcagaaacccaggatcggaaggccgaggttaaagatatccgcatccatatcaggtgcatcctccgcacaggtcgaggcaggtccaccggagaggataatggccgaagggtacatcgcacgcaactcttcagcgctgatgtcacaaggcacaatctccgaatagacatgtaagtcgcgcacgcgccgggcgatcagctgcccgtactgtgcaccgaaatcaagcactgcgactaactgatggggtcttgtgctttgcatacgttcctcctgaatatatcgtactacctgcagcgacaactatagccgctacaagtgtaaagagtatatacataatagacgaatatctatacaggcgttcactcattgggaacaccgcaggatacctatatgtacctgcactgattctagcacctcacatttccgctgttcggggtatttaatggacttcggctataatttagataggtaaatagcaatacgtttattatggataggtaaatttatatctattcgatcgtaaccgctctttcgaggagttcacttttgctgcatagaaacagagggcgccaagaaccggcgacaaatgccctttcccgggataacgggctttcgcactaccagggaaagcgtgagcgccgtaaaaaatcccacataatctggactgttgttatcgtgatccttgcggtgatcgcagtgggagcgatcgcgtttgcggctttctatttcgatatcgaccaccgactcacctcacggatctcccctgatctggcagctgagctctccaatacctcagagccctctggccccttctacatgctgttgctcggcgtcgacaaagacgaagcgcgcgcagaggattggggcgacgataacagtaacttcaggactgatacgatcatcctggcgcgtgttgaccccaagaacctgaaggtcaccctcgtctcaatcacccgcgacaccctcgtcgacctgggtgagtatggacaggataagatcaatgccgcctattcctacggtggccctgcgctcacggtcaaaaccgtcgagaactacgccggtgtcgatatcaaccactatgcggaagtggactttgaaaccttaacaaagatcgtcgacacaattggcggcatcgacgtcaatgtcccggtcgacgtggaagacccctactccaatgcggatatcaaagccggagaacagacactcaacggagagcaggcgttggcactctgccgttcgcggcacgcctatgatgcctacggcgccggtgacttctatcgcgcagccaaccagcgtatggttatcgccgcaatcgtcaagaaagtcctggcatccaacccgttgacgatcacctccaccattgagaacttggcggacggcgtcaccaccgatatggatgtgggacagatcatatctcttgcgatgcagatgaaggacctcgacgtcgataacgatgtgtattccggtatgaaccccacgatcggcgaagacatcaacggtgtctcctatcagatcaccgaccaacaggcctggagagctatgatgcacagagtcgatagcggagagactccctacgagcgtgcagacgatgacccgacctacggtgttgccggctcaaccggaaacgcaggttacgacgagaatggcatcagcaccacgaacggggatgcaagctcctcagatgaggattactccggcaccgtggaggtcctcaatgccacgggtataccgggggctgcaaccgatgccgcgaaccagctgaacgatgcagggttcaacgccaccgccgacaccgcgcaggacatctccaagggcatcacgatcgtctaccatggggctgacaatcgggcaaaagccaatgcggcaagtaaggtgctttcctcactgggcaagtcaatcacgtgcttcgatgacagcaacggtgtctatgcctacacgagcgacatcctcgttattctcggtacctaattcaccaatgactctttcatcggcgaatccgtacgtagggaagcgtgtggataaagatggaaccgctagctgcggaaatgtgcgtcagtcgcaaatggcgaagcaccctcgcagctttggaccacctctttgcgtcctgacagacacagaacagcgacacaaacctattcaggcaagactagaggctagatttcttcgtgtctgggaacctgaataggtagagcagcacagcttgtttgcaagccccatggccttgtgcaggtgtgtcaggtcagcgatgtctgccctataggcctcgtcagtgcatttggttgccttcacgagtgagagatgagacctatcccatggtgtgcataactattgaaccttctgctctatacgaaagcagtgcgtcttcgattcgcttggaagaaggctttccatgccctaagatcacgccgacgctcttgagtgcgtcgaggcctgccacagtgcagatcttgttcttggaaggcccgctcttctgcacgatgtcggagtcggtgaggtagggcttgtctgtccagatgtggccgcacaacacgagccggttctagtagccgtcggcggtggcaaagatgctgtggtgccacacgaaggcactcgtgtgggtgaggtcgcacatctcaaagatgaggtcgaaggatgtggtgtagcacatacaggtgatggggcactcccagctcaaaagttccttcttagcgtatttcagcgctaagagctaggctgtgtacctttgacgccccggtggtgtctgcttgtctttccagcttttggcaaacctacaaatgtggcaaacaggatggaaccatcacagctcggtcgcctctctgagcgtttctgcgcctatctgtcttgcgacatctgcgttctacaaccgcagcgccaagggacgacaccgtgtccttgtaggggtttgatagcaaccatggcggatttcctatccacgcaggtggccatccgctcaggaatgtcgccaaacatagggccagatagccacttgagcaaatctatgcttggcaacgccaatggtagcaccacagggttacaggtgagggatcctattcacacgcttccctactctcggagtttttgaaagcaaccgctccgcttcttcgaatccaaccgcgttgtcaaccataggaatacctctcagcgtttgcttgttttctcttgagactactgcctggtcagccccccataacacgcagttggagcaatcaacctctgttggctgtttgtttgattatgcctctgccctgatcaatataattcagaaagagaaataatgtctagaaatgaagcccgatactcgagagaatccccagtgcctggtctgtttctatacctgctctgtccgtctttcagttacacgttgaagcggaagtgcattacgtcgccgtcctgcacgacgtagtctttgccttccatgcgcagccgtcctgcctcacgggcaccagcttcacctttgcacttgatgtagtcgtcgtagctgatggtctcggccttgatgaagcccttctcgaagtcggagtggatgacgccagcggcctccggagccttcgcacctatacggaccgtccaggccttgacttccattccacatcgtgcgcagaggtaggagcagagtctctgcaggtcgatcagcgaggccatgagcgtatctgcggagtcctgggcctcagaagagcggcttggagacccttgacaggaggcttaccatatcttgggcctgcagagcgtctttaccgcaggtgag

SEQ ID NO: 367 - DNA, 3815 bp, Unknown
  Metagenome-assembled genome
cgggtcctgaagaatcgtggtgctaaacgctaaagacgggcctaaaattatggagcaacccagaaagagtccatttttcttatggtgccgatcgccgatgattgaacgtttttcctaaacaaatatttgagataagcgtataaacaatagaggagcctgtggagtgaggggatgggatgggatccgtgtgccaagccgtcatatactgaggccttttgtgacactgcatgtgaacatggtggtgtcttcaagctctaaatgtggcaaaagggctaatttgacccggcattcgggagttttagtaaagatattgttgtatccttattaccagtagatatccagctgatatccaacacatatctgttgcggaagagaaaggatctgtcatgagccggttaattactgccaagaacgtcttcttgcatgtgaaggcacagaacgtggacgaggtgttggcttttctttcccagaaggccaaggagctcggttatgcttcagacgatcaggaagtgctgaggtccttcaaggagcgtgaggcgctcgactcaactggtatggcagatggttttgctctaccgcacgctaagactgatgcaatctctgaggaggctgtactcgttgcaaagctcgacaacgatgttgactggaagactagagacaaggtacccatcagagttgctatcgctattctgaccccgggtaaattcatcggcaccaagcatctggttgttctctccaagatcgcaagcatgctgatgggcaagtctacccgtgaccagatcatcaattctggggaccctgatgagatcgctaagattatctcggatgtgattgatgagaactaacgtttattaacgctttaggtggacggtctttgcaaggcttaacccaagctgttatttcttctcggtgaaaggagccgcgttgatctacacagttacgctgaacccagcgattgactatgtcatgcatccattatctttggatatgggctataccaaccgctcgtcttcggaagagctccatgtcggtggcaacggcctgaacatctgccagctgctgaacgagctcgatacgcccaacgttgcgttgggaatcgtcgctggcttcactggcgactacattattaagcggcttcaggagaagggagtgagctctaacttcgttcgcctagatcatggcaatacgcgtatcaatgttaaactcaagggtattgttatgaccatggtcaacggtatgggcccgagaattccacagtccaaagtagacgagctcctggaccgtatcgactatctgggaagtggcgacacgatcgtgctgaccggttcgattcctaagtcactgccgagagatatatattcgatcattatggagcggctctctggccgtggcatccgcttcgtcgtcgatgctccgggtgagcttctggtcaatgcgctgaagtcaaagccgttcctgattaagccgaacaaccatgagatcggccgcatcttcaacatgaagccattaccggagatgccagaagatgtgctgccgcttgcgcataagacgcgtgaaatgggcgcccagaatgttctggtttcctgtggtgcacgcggtgcggcgctggttgatcagaacgatcaggagcacattgtcccgagcgcaaagatcaagctgatcaatgcgaccggtgctggtgactcgatggttgcaggattcttggctacctatgacaagactcacgactttgatcgctctttggttgtcgcttctgcctgtggtaccgctaccgctgcaagccgtggcatcgctaagcgtgccacgatcgaaaagacggttgccaacctcgagcagatcatcgcaaagcaaaataataaataggtaatcaaagagacaagggacggagactctatacacgttgacttgtctcttttttgtacagtgcacaaggctttcgagccttgaataaagtaggaacggaggagcacatgtacaagggagtcaatgcatcagagggcattggtattggtgttgctcgcgtagcggtggaaccggatctttcctttgtaccgcacagcccggaggacaccgatgctgagaagcagcgctatgtcaacgcgcgtgagaagttcgtgaaacagacccaggcgcagattgagcgtatgaagaagacggtgggcgaaggcaccgccgccatcatgcaggcacacatcgactttgctcaggatgacggcattatcgatatggtcaacaactctatcaccgacggtatgtgcgctgagcaggcagtccagaacgcctatgatatgtattacaacatgtttgcaaatatggatgacgagttgttccgtgagcgttctgccgacgtcgcagacgtgaggaacggccttctggctgacctcctaggcgtcgagctcatcaacctctcagccctccctgagaactctgttgtggttgtgcacgagctaaccccgtctatgacggcagatattgacaagtcagatattgtcggcatcatcaccgagaccggtggcagaacctcacactccgcaatcatcgcgcgtcagcttgagattccggcagtcctctctgtcgagaacgctacccaaaacatcaagaacggcgatatgtgcgtcgtcgatggtgacaagggcgaagtccatgtcaacccggatgacaagtcactggagaagtaccgtgacaaggctaagaaactggctgaggagaaggcggcacttgaggcctatcgtggcaagcctacgatgaccgctgacggcattaagattcagcttgtcgctaacatcggcaacacaaacgatgcagccaatgcagtcgagcacgacgcagagggcatcggcctgttccgctctgagttcctgttcatggactccgacgagcttccgagcgaggacgagcagttcgcagcctatcagaaggtagcgctggcgatgaagggtaagcctgtcatcatccgcacgctcgacgtcggcggcgacaaggacatcccgtacctcaatatgcagaaagaggacaacccgttcatgggcttccgtgctgtccgttattgtctgaacaatccggatcagtacaaggtacagctgcgcgcactgttgcgtgcttccgccttcggtgatgttaagatcatgctgccgttggttacggctctcgacgaggtgcgtcaggccaaagaactgatcgagacctgtaagcatgagctggacgaagagggtgtcgactacaacaaggatgtccaggtcggcacgatgatcgagaccccgtctgcctccctgatcgctgatcttttggctaaggagtgcgacttcttctccatcggcacgaacgacctgattggctacacgatgtgcgctgaccgtggcaacgagcgtgttgcatacctctacaatgtctaccagccgtcagtcctgcgttcgctcaagcgtatcatctctgagggcaataaggccggcattatggtcggtatgtgcggtgaggttgcagctgacccgctgatggtaccggtgctgatctccttcggcctcaatgaattctctgtctccgcgggctcaatcctgagaacgcgtaagaccatctctcagtggactaagaaagaggctgacgcactgactgagaaggttatgcagcttgagacttccaacgaagtccgtgcaatgctccagtcggcagtgaagtaaacaatcgcttgccacaaagcggatgaataggagagcacctcgcattaacagcggggcgctctctttgtattaagtagagggagacaatagtcgaagagaatcctgtatgcctatacaataattgtgaagaggggtgacctg

SEQ ID NO: 368 - DNA, 9755 bp, Unknown
  Metagenome-assembled genome
tcttcgccttttctttcttcttctgcctcgccgttgcgtgacctcggtctgcgccattcggcatcccctcccctcgcttggctggggcatcctcgtggccgtgcaatgccgccgtcccatggcaatgcttggcatcctgccgcaggctgtgctttgccgatatcgcagaggcctgatgcctagcggtctggagagaacgcgagggcttttttctagcccgcacgccacgttcagctgaccttggggcaacgcttggcgatggttccagtcacgtcgctctcgacggctgcagggggaaatgggtaaccgctccacggcactcgtcgcgaccctcttctgctttcttggcagggctttgtgtcgtcacgcgctaaatcacgaagccaagggctcagacgattggcggccacggagtcggcttctgtagaggaaggcagataggatggctttttgctcgcacatagcctgaaggcgccttccggaagctttcctggcggacaaagcggcccggaaggaatgaacgcatccgtccctcgtgccgggagtgcctaagctttcccttaatgcggagctcgaggatacggagaatggctgctccgctgtggattgagcctcttgagcctctggatgtggccttccgtcgaggcgaactatcgagccagaatatggaaaaggccacggcgctcttcctcaatgggctacaaactccgttgaccgacatcctgcgagcgtcccgctcgatgcttcggattgcctggctcctttcccatacgcaccgaatgcggcatccgccattgggtgctcgatgcctcgggtgaccttaccgcttctgcccccacgaatccccaaagtggacatcagcactgcgaagctctgattatcgtgcgctacgagagaggacgctcctcttcgagtaatgcctgcaccgatcttggctcacgacgatccgcagaagatcctccgatgcaagaagttcaggaatcgtgagaagggcccagccgtctcatacgagctcggcgagcgcatctgcgtctttgcgctcctgccttcctggagggaacagcaaaatgaggcattgctcgctcttgtgacatgcataggggaaagcgcaggccagctgagcccgccgtcggacttcactagctggtacagtcactcggcactactgggatatcgatgaggaaaagctgtgcagacctcgccggtgtcaaggcgcgcttccagggcaggtgcccgaaggcatccttccgggtctttcagatcgaacagagcggacgacacgaagtagggactggacgcatcccagcagcagagcgcttccctctggtgggctccattggcagagaaattgcgtgcagtggggccttcttccggggctctggatctgcaccctcgtctgcgaagcaggactccgtctctccatgagcacaggatggctctgcgcattgaggcaggaaaccccgtatgagacggctctccactgtaggcggctatgcggctcgataccttgaaccctgagtcgctcctgatgtgcatgaggtgctggagccttggctgcagatcacctggggatttccggcttctcaatctcgacctttctctatggcggcgcgctcctcctgccgcatgcggtgaaaaccggggcgagctcatggcagacgcgctctgaccttctgagggattccgttcctgaaggcacctcttcgatctctgcggcgtgcccatcatgtctgctatcggccgcacgagtactgccgcgatcggctgcgacgtggggcttactgggatggccgccgtacatgatgatatcctgccgtgagcgcgtgagcacgaagaatgctctcgtcaatatccggggacgtgtcgcatatggatggcgtgggcgttcctcaacgaccccgatgtcttcttcctgagagacgatgtgaagctctctgaagcacagaagaagacgctccttgaggcagatgcctcgttggggagcgtccttttcacgtcggatgatatggcactggagcgaagagcagaagcggacatttgacgaggctctgcacgcattgcttcgaggagccggctagatctagacttgcgtgcggcatccacgaagctcccagacgcacggtctgaggcgagtgcggccacgtgtatcagggtgccactgcacgccgaggacgaacgtgcctcaggaagctcgatgcactcaggcacgccgtctgttgcctcgcccgaaaggatgagcccctctcccagcttcccgacgcagcagtggtgggcgagttcacctggatctctgctttcccacaatatgggcaagaagcgtatctggcttcacctcgacagggtggacggatcggtcaggaccttggcatggcgccagagctgcatccttcccgtggcttgaggcttggcacatccagcagagcgtgccgccgagtgccacgttcaggagctgcgtgccgcggcaggttgtgaagagcggcttgtctgcagcgagatctctgcacgagcggaagctcgaaggcatcgcgtcggggcagaggaggccggtcgtatggctcggtgctgccgagcgggcagggtccacatcggggccgccctgcagggcaaagccgtcgcagagctctacaagctggttgattgcatctgcgtcatctgtcagcggaagcaggataggcgtgcctcctgcatcgatgattgcatcgggaaagcagctgccatcccctcgtcggggcaagctggtcgggacctgtgcggtcggcaccttcctctcccagcggggagcgatgccgatagaggacgcctcgaagatacgacatggaaaggacctttcatgaggacaccccgcatcgtttgcggctgatcgggggctcagatgtgcagtgcgggatatcctggctagtggcccatgatggagttcgaggaagtcgcgggcacgctggctcttcggatgcctgaaactcgtcaggtgtgccttcctcgacatctggccgtctgccatgaagacgacgcggtcagcaacgcggcggggcaaagcccatctcgtgcgtcacgacgatcatcgtcattccctgctttgcaagctcgaccataacttccaacctcgttgatcatctcggggtcgagggcagatgtcggctcgtcgaaagcatggccttcggatgcatcgcaaggagcgggcatcgcgacacgctgctgctggccaccggagagctgggcggggacctttcctgcctgctcggccacgccgacgcggtgccagaggtccatggccctccttcttggcctgctccttcggctcatgcaggacatctatggggccgagcggtcacgttgtccagtatcgtcatgtgcgcgaagaggttgaactgaggtgcttggaacaccatgccaaggtcggcaacgcatcgcacgagcttccttgccttcctgggaagaggcttgcccttcaatcaatctctccgtccacaaggcgtatttcgtcgtcgttcatcggcccttccgggtcgggcaagtcgaacgctcctggtgccgcacgatcaaaaccgcctcgcgaccatcgattcaggcgagatcgttgattgaaggcaaagcctcttccccaggaatcaaggagctcgctgcgatgcgtgccgacctggccgtgttccagcagttcaacctgcttcgcgcacaatgatatacgtggaccacggccgctactcggcccctagatgtcctgcatgagccgacgtagcagagcgccaagaaggaggccatggtacccctcctggcaacgcgtcgcgggccgagcaaggcaggaaagggtcccccgcccagctctcctgtggccagcagaagcagcagcgtgtcgctattgcccgctccctggctatgcacccgaaggccatgctcttcgacgagccgacaagcgccctcgaccctgagatgatcaacgaggtcctcgatgtcatggtcgagcttgcgaagcagggcatgaccatgattgtcgtgacgcacgagatgggctttgcccgccgcgtcgccaaccgcgtcgtcttcatggcagatggccagattgtcgaggaaggcacgcccagtgcgttcttcgagcatccccagagccagcgtgcccgcgacttcctcgactccataatggggcactagcagggtacccgatacgtttcagcacttcagaggccccgcatcgcgcatctgatgcggggcctcatcatctggaaggaactctcatgtcccacacgtccaagcgtccgctcataggcatcgctccccgctgggaggagaagcagcccacagcacaggtccccgacagctggccccgacagaggggatggcaagctgctttcccgacgcaatcatcgatgctggaggcacgccgatcctgctgccgcttacagacaacgaggaggcaatggatgagctcgtggagctctgcgacgactttgccctgcagggtggccccgatgtagatccggcacgcttcggcgacaccacaccttacgacaaggcgccgctctgccccgagcgcgatgcgttcgagcttccgctcgtgcagaagatccttgccaccgacaagccgctctttacgacctgccgcggcacccagcttctgaacgtggcgcttggcggcacgctctgcatggatgtgcccagcaggacaccgcgtcctggcatgcagctctggcgccacactgagcacccgtgctgcctcctccatgccctgacggccagagatgtcctgccccaagagcttctctgcctcaggcacgtttggcgtcatgaccgcagccaggcggaagagcgagaagagtgcatcctgtgcgccctcctcgagaagtagcgcccccgtcgtcgaggcaagcaccggatcgacgacgatattctgcgcatggagctcatccaggctcttggccacagcagcagcaatcttgcccgttccgagcatgccgatcttcacggcagagggcaccaggtcttcgaatgccgcacagatctgctgctgcacaagctcgggcacaagcggcgtgacagcatgtaccactgcaagcgactgcgccgtcacggccatggccgccaccttgggatgaagacctatcccagagatggtagccacatcctgggcaagccctgcgccgcccgagctgtcaagccctgctatagccaggaccgccttcatgcggagacgacctttgcgagctctgccttgagctcctcagtagctttccggcagtcatccgctgcaaagatggcagagacgaccgctcctccggtaacgcctgtgccggcaagctcatgagccgtcttcgcatcgacgccgccgataccgatgacagggatggggaccgcggcgcagatgcgcgtgagctcctcgtaggtcacatcgactgcatcgggttttgtcggcgtcggatggagcgcaccgactccgagatagtcggcgcctgccttccaggcagccacggcttcatccacggtctgtgccgagacaccgatgatcgcatcctcgcccagaatcttgcgtgcctggctgcaggcaaggtcttcctggccgacatgcacgccgtcggcacctagcttctttgcaagctcgacagcgtcgtcgagcacgaagggaacgtgtgcacgagcgcagatcgccttgagctccaaggcaagcttctctgtctccgcctccgttgccttcttctcgcgaagctggatgaacgtggccccgccttgaattgcctcctcgacacaggaggcaagcgtcctgccgcggagccaagccctatccgtcacggcgtagcagagcatgctctgcctgatagcgtcagcagaccagggaccgcgctggcagggtccgagctttgcatctgccgccatcagagatcggccacctttgcagatgccacgagctctttgccttggatattcgagagcgcatcgatcaggtaggtgcggaaagatccggtgccgtcctcccctgccatacgtgcacgtgccttctcgccgcagatgcccatcatcgagatgccggctacgcttgccacatacacatcatcgtttgctgccaagaaggccggaagcatcgccgaaagcatgcagcccgtgcccgtgatgcgtcccatcagggagacgccgttcctgatagctgaggtccttttgccgtcgctcacgatatcgatggcaccggtgacggcgaccgtgcacttccatgccttggcaaggccagccacgaatgctgctgcctcggagaggttctcctcagtcgctgcatcggcagcagacacatcgacgccacgggtcgaagcagaggcgccgccgagagcacggatctcgctcatgttgccgcggaccagctggggatggtacgtgtcgaggagatgcttcgccgtctcggtgcggagcttcgaagcaccggcaccgacagggtcgagcacgattgcatgtccgagagatgctgcctttgctgcagcatggtccatgccatcgatgcttctatggttcagggtgccgatgttgaggtcgagccctgcgcagatcgacgtgatgtcttccacatcgtccggctcgtcgctcatgatcggggatgcgccgattgcgaggaccgcattcgcgcagtcgttcaccgtgacgtagttcgtgatgcagtgcacaaggggcgatgccttgcgcacattgtcgagacaggtaccgagcccttccgtattcataactatgctcctccatgcagcaagaggcagatgctgccatctgctccaggctgctttctatgcttctcttctcttcgcttctagccgagatcgaccgtcagccctgccatgatcctgttcacggtacgggcagcgcacatcttgccgcacatcgtgcaggtgccatcctcctcaggcggcgcctttgcgatgatctcctttgcacggtcggcgtcgatagcgcactcgaacatgccatcccagtccacacggcggcgggcatcgctcatcttgttgtcgatgtcgcgtgctccagggatgcccttcgcgatatctgctgcatgcgctgcgatgcgcgtgacgatgaggccctcgcgtacttccttggcattcgggagcttcagatgctctgccggcgtcacatagcagagccagtcagcaccggtggatgccgccacggcgccgccgatggcagccgtaatgtggtcgtagcccggtgcgatatcggtcacgaggggtccgagcacatagaacggcgcaccatggcagagacgcttctggagcttcatgtttgcctggatctcgtccagagccatgtgtcccggcccttcgacgacgacctggacgcccttctcccaggcacgcgtcgtgagcttgccgagctcgacaagctccgacacctcgcaggcatccgttgcatcgtaggtggagccgccacgcatcgcatcgcccagactgattgtcacgtcgtggtcatgcaggatctcgagcacctcatcgaagtgctcgtagaagggattctcctcccctgttgtcatcatccagccgaagaggagcgatcctccgcgggagacgacattcgtgaggcgcttcgtctcgagcaacgtattcaggacagaacggttgaagcctgcgtgtatggtcatgaagtcgacgccgtcttcggcatgtgcttccacgacgtccaggaagtcctgggccgtaagttcgacgagcggcttgtccttgtaaccgatcacatcgtagatgggcaccgtgccgaccatcagcggcgtcttggctataagttctctgcggaacggacgggtcttgccgaagttcgagaggtccatgatcgcatcgccgccaaactgctcggcaatccttaccttctcccactcctccggtgcattctggatgtctccggagatgccgagattcacgttgaccttcgtgcgcaggcctgctcctaccccgcagggacgaagcttcttgtgtgccgggttgacaggaatcgcgatcgttccctttgcgacactgtctctgatgaattcgtcggatctgtgttctgccactgctaccgcgtgcatctcgtcggtcactgtaccggcacgcgcagcatccatctgcgtcatggcgctcccttcgttggcattatccacatcaggttcaaagggtcgggaccatctgtcccctctcagccggctatgcaccagctcccctctatgtctgcatgctccagaaattcgtctgcagctgcaagccggattgtagcacctgaaagccagatagcaaaacggcagaggcggctgatatactcgatgagagatccgacggaaggacgcaggagccatggaatccaagcgctatcaggacatcaacgccgagacgattaaccgctgggtcagcgagggctgggaatggggcaagcccatcgaccatgaaacctataaggccgccacagaaggcagatggcagatcgtgctcacgccgacaaaaccggtgccgagaagctggttcccgcctcttcaagggacacgagtcctcggccttgctgcaggaggaggccagcagatgccggttcttgctgctgcaggagccagatgcaccgtgctcgaccagtcggaggcacagcttgcaagcgagcgtctcgtcgccgagcgtgaaggatacgatatcgagatcgtgaagacagacatgacggaagggctgccgtttcaggacgcaagcttcgatatggtcctgaatcctgtgagcctctgctacgtgcgtgaatgcgcacccatcttccaagaagtcgcacgcgtactcgtaccgggtggcgcctttctcgcaggcttcgattttggtggcttcaactacgtcgtcgatgaagcagaagagcgcatcatccacagcctgccgttcgaccccgtcgcagatccttcccttgcagacgaactcgcggcacaggatgccggcatgcagttctcccattctcccgaagagatcctgggcggcatgctccatgccggcctcgtgatcgacgatgtgtctgatgacacgaacggcgagggcaggcttcatgagttcaatatcccgaccatgctcgctgtgaaggcgcacaaggcatagagaatagcgggagacttctctccatccgctgtgtcccgaatccttgccgtcaacgagagatgaatgcgcactgctggggttcaatgccgtacctgccatcctgcgccctaccacaggcaagctggcttgtatcgcattccagataccattcagaaacaaaatggatgccactcgccgctgacgttgggattcttatgccggctatcgtgccttggatgatagattgctctctacacgagcttgttactccccgggaggcattactcgtacatctcatgccagatgtatgcagctatgccactggggagttttttatgccgatagcgtctgaccatccaggcgaaagatatcggaagaatggaatacaggggagaaaggaaacagagatgggcaagagaacgatgtcacggaggagcttcgtcggagcaggcagcctttcggcagcagcactggggatgctgcttgctggctgcggaaccacacagcagcagagcggctagcggctcatccaatcagacagatgccgcgaagagcgatagcttggtcgcaaagactgcatacggtcccgtcaagagcacgaacgaggacggcgtgaacatctggtacggcgtgccttacggcaagtctccagagggagagctccgctggcaggcgccagaagagcccgaatcctggacggaagagcgtgactgcacccagccagcacagccagcg

SEQ ID NO: 369 - DNA, 42711 bp, Unknown
  Metagenome-assembled genome
ttgtcgccagttcacggatcttgaggtcttgccgtcgacctcatctcgccgtcctgccacgattctgagaaccgtcacgttggtgccgtggcaccggtgttgattacaccattctcctcaacggcagtgccgagtgcttacggacccgcgagtacgggcgatggagtcgtgtggcccacgtccgccgattgctaggatgtaaccatgtttcgtctccgttgcggtcgaccgtgtcgatagggttcttgatgtagtcgacgaccatctggccttcaagctcgccacttgctgcgcatcgaagccgacgtaataggtgtccttgttgaatgtgagcgttgtcatatcgatctcgccggtagaaccattggacggttggcgattaaagaagacgaccggcttttcagtattcgggaccacgctcgaggcggattccccgccgcagcccgcaagatttgttcctacgactcctgcagcacacagcccgcagagctgcagaaactgacgacgtgacactgccataagatcggcccctttcctcccattgtgcatagtctgaaattcttcgtcgtatgcgatcgcaaagccttacctcatgccaagtgagccatcagagggtacggtggatctcaactttggttctttatggttacgttaacatatagaccatagagtgaaatatgctgttattctctttctagcaaatggttatattttgacgctgaacggtagacaacagcgggaaaggacacgtcccttaggtgaggaaatgcctcaatgaacaatgcaacgtactcatttaaatgtcaacgctagcagctatgaacagtcttacgttcgcagatgtgccagagctactgaacgtcgcttgatcagcttgccaggaatgcggatcgcaagcggatgcccagtgggaccgttcaccacattctcaaacacaacccggccgcgctccaccaggtcaaagcggaccgtggtgagcccgacattgggaaccgtcttctccagtgcgtcatcgactccgaccacgctgatgtcttcggggaccctcaaacctgcatcgcgcagcgccgctatgacgcccatagccatctggtcattcgccacatagatagcggtcatctgcttatcctgcgctaacttagctccgatctcgtagcccccatttgcggtccaatctccgtggataggctcatgcagctccaggttgtggtcacgcataaagtccctccacccccgctctctgaactggctgtcgatggagtgcacaggccccgctacaaagcgaatttggcgatgtccatacccatagaggtgattcataaccaggtaagagcagccgtattgatctgaatccacggtggtgcagcgtgggtgggaatacatcgtgacgatcacggtattcatcccaggctgcggcacaaactcattgaagtccgttgccatccggctcataccgatgaccataccgtctaccggcagcgccgccatccgctgtgaaacctcagagagcgaaaaggcggaaccctccggccgctcgagcattgtgaccgcgtaccccggttcccgggtagcctccaggatgcctttcagcatattgaaattgccgatctcggtgatgtcatacacgtagaggccgactgcatggtagcttccctgacgcagcgatctgcccgcatagttgggacgaaaccccagtgtatgcatcgctttcaggacccgcttacgggtatcagggctcacattggtctttccattggctaccctggagaccgtctgctgtgagacgccggcggcttgcgccacatcagacatcgagacagtccgtttgggattttgtacaacgttcatatgtctcgctgtctgagaatcggactcgtccgccatagctctcctctttaagcaattaccgttagcggaataaatcataccagttgtaccgtataggacaggttgatatactttatgagtacgttaacatatactatatatgtaacgaatcaccacgctttcgtgtaccttatcgtgctcactcacgacagaaagggtgcctatggttacccagttcccgatcggaacctcccccacccacgaacagattgatgcctacgagctcaaatgcaacgactacgccgtccgcgtaatgaacttcggtgccactattttaaagatcattgcccccgatgcccacggcatccctgctgacatcgtcttaggtttcgaccgtaccgaagattacttcgacaacccggcctgcttcggcgcaacgatcggcccaagtgccaacagatccaataaagctgaggtcgtggtggatgggaagacctaccagcttcctaaaaacgagggacccaacaaccggaacaacttgcacaccgacctcaattcagggctgcacaagcgggtctggggcaccgcgctcgacgaggagaacaactccgttatcttctcgctcgaccttgctgacggcgtcttcgggctgccgggaaaccgacacttcaccgtgcgctataccctcacagagatcgaggatggtgcagagctgaagtgcacccacacggtcaccaccgatacccccactttcgtcaatatgtccaaccacgcctactttaacctgcgcggcgcaacgcagcctggaggtggcgaggctaccgtacagctcaaggcacacttgtatatccctctgcgggaagactcagtctcccgcggcgatattgccccggttgccggcactcccttcgacttcacgcagcccaaatcattgctgaaagatatcaatgctgatgacccgcagctcaagatcgcccacggctatgaccactgctttgtaatcgacggttggaaggcaggagccgcaccgcgcccggcgctgcacgcaaaggacacccgaagcgggcgcaccctcgatatgctccttaccgcacccggtgcccacctctacacaggcaactggttgggagataaggacgcaaagggcggcgtcgactaccatccacagtccggctttgcctttgaagcggaatactacccggactgctcacaccaccctgactggccacaacctatctgtaagccaggctgcccctactcagagcagatcatctggcgactcggccatacaacacaagcctaactagtgtccaagaaaggattcaaaccatggcacacacgctccctccggaaggcgctaaagcgctcgacctctttaaacagacattcggcgaggtctctgataaagattccttagtctatgtgtacgctcccggacgcagtgagatcgcaggcaaccacaccgatcacgagggcggccacattatcgccggctccctcgatgtgtcgatcgacgcaatcgcgcacctcaacaacaccaacacggtccgcatcaaggatgccgccttccccctcttcgaagtgagcctcaatgacctctcggttcaggaagacgaaaaggaaacctcacaggcgcttgtgcgtggcacggcacgcgagatggttaagaccggacgcgaagccaagggctttgacctcgcgagtgtctgcagcatcccctccggcggcggactctccagctctgcggcagtggaagccgcctacggccgcgcgatggaggccctgtggcccggcgaggcgatcgaaccgatcgcgctcgcgcagatgagccagcgcaccgagaacaattacttcggcaagccctgcggactgatggatcaggcggccgtgtgcttgggaagcctctcctttatggacttccatgacaaagggcacgtgcacttccagaaactcaactatgactttgaagccaacggctacagcctctgcctcgttaaggtcggcagcagccacgcggacctcaccgctgactatgcggcactgcccgcagagatacaagcagtggcccatgagttcggcaagacccgcctctgtgaggtcccgcaggctgacttcgaagcgcaggtgccagccttgagaaaaaaactcggcgaccgcgccgtactgagagcaatccactactacatggagaacgcctcggtcgacaagcgttgggaagccctgcaagctaacgatatcgatcgcttcctcgaactcacccgcgcctccggcgcctcctccgccatgttcctgcagaatgtctctccgtcaaataccgatgtaaagaaccagcctgcaatggtggccttaggcctggcagagctcactctcaacggtaagggcgccacacgcatccacggcggcggtttcggcggcacgatccagtgcttcgtcccgaccgaggagactgaccggttctgcgcacagatggacgcctggctcggagctggctccagcaaacgctacacaatcacccagagaggggcatacgcacaatggctgtaagcgacgagaagacagcagataccgacctgatccagcgctccctgcagcgcctggtggactatggggtaaagcatcggctgatcgaggtcaccgaccggcgctgggcttacaaccagctcctgtcctacctacacctgaccgaacccggctgcagcgccgtctgggaaaatgcggacccgaagcccgaagaggacctgcaggacagcctcacacccctgatcgacaccgcagtcgcaaacaactgcgtcgaggacagcaccgcaggacgcgcccgcgcacaggcagggttgatgggaatcctgacccctcgcccctctgagatgaaccgccacttcaacgagttcgtcacagaaggtggccccaaggccgcaaccgactggttctacaagctctcctgtgacaacgcctatgtgcagcgcaccgcaatcgccaaaaacatcgcctggtcgactgacactgactggggcacgatcgagataacgatcaacctctccaagcctgagaaagatccccgtgacatcaccgcggctgtaaagccccacacacaggagagctatcctgcctgccagttgtgcatgacgaacgaggggtatgccggcagaagcgctcaggaccccgcagggccccatccggagcgtcagaacctccgtatcatccgcatcccactcggtggcgagtcctggggtctgcagtacagcccctatgcctacttcaacgagcactgcatcgcgatgagcccaatccacagggtgatgcatgtcgacagggagaacatgggaaggctgctcgacttcgtcgacctcttcccccactactttatcggctctaatgccgacctgccgatcgtcggtggctccatcctctctcacgaccacttccagggcggtgcccatgtgttcgcaatgatgaaagctgaggtcagtaagagcttctcactcgaccaatacaaggatgttcagttcgatatcctgaagtggccgatgacagtcattcggctcacctcaacgaaccgcgcacacctcctggatgcggcaacccacatccacgaggtgtggaaaacctacagcgatccgagtgtctcaattgtggcgcaggatcccgacggcacccgccacaatacggtgacgccggtcgcacggaaacaaggcgacacctacaccctctatctggcgctgcgatgcaacatcacgacgcttgactatccgctcggggtcttccatcctcaccagaagctgcaccacattaagaaagagaacatcgggctcattgaggtcatgggtctcgcaatcctgccgccccgtctcaagaacgagcttgctgcagtccagcagacgatcaatgcctatcacaacgatgcagatgagctgaagcatcagctgcatgacaaccccctgacggtctcccatgcagagtgggccgaaaagatcgcccagaagtacgaccacgttacgaccgatattatccacaaggaagtaagtgaagtcttcgtacaggtcctgttggatgccggcgtcttcaagtgggacgagcaaggacgctctgcgctcggccgctttgtcgacaagctgtaatacacatatatagacctcgtgccttgggggatgagccacgctgtggttcatccctctttttgtgtacgggttcaccatatcgcaacaaaactggtgccaaatgccctcttcaggcgttcagagcggacttatttgtgctcataatgctcaattttcgttaaagattaaagatgagataccgcaggtcagaacagaccgtgcactatagtacactgctggtatcactaattctgatatccaactgacaacaattgagaggatccagtatcttgcgccatcggttttcagcttatagggttaattgtatgaatacttacggtttgacacagatggcgaggatgatggagatgcccaagcccggtcacctgagtgttgcatgtcttgaaacatgcgcttagaaccgggcgccaccgcacgatgatttctggcaggaaatcatcaaccaacgttttttgattcggagtttttgtgattgtattaagccatcttacgaaagactataccgacgatgagcacgcactgaacggcgtgtcgctcacgatccccgatggagatatctttggcatcatcggcatgtccggtgccggcaagtccacgctcgtccgctgtgtgaacctccttgagcatcccacctcaggcaccattgaggtcgacggtcagaacatcgaagaactgagtggacaagctctgcgcgactaccgccaccatatggccatgatctttcagaacttcggcctgctgtcccaacgcaccacgctgcagaatgtctgcttcccctaccttgcggccaacaacaagatcactgacgctgatcgggaagaggcaaaggggttcctcgagcgggtcggacttgccgacaaggtcgactcctatcctgcacagctctccggcggccagaagcagcgtgttgcaatcgcacgtgccttagcctgccaccccaaatacatcctctgcgatgaggcgacgtcagcgctcgacccggcaagcaccgcttcggttctgaagctcttaaatgagatcaaccaggaaaatggaatcacaatcctcgtaatcacccactcgatggaggtcgtcgagaaaatctgtaagcacgtcgccgtcctcgttaagggcaaagtcgtggaagagggaagcgtgaaggacgtcttcgccaatcctcagcatcacgaaacacgccgcctgcttggaaaggagcaatgggttgactaatatttctgagttcttcgcctcgtttggcggtctgattggtcagggcatcatcgacacgctcctgatgctcttcatctctacggcactcgcctacgtgatcggcctcttcctcggcgtcgtcctctacgtcaccgcttcgggaagcctgcgcccccaccgcatcctcaacgcagtcctgggttgggtcatcaatatgggacgttccatcccattcatcattctgctagttgccgtgatgccgacaacgcgtgcacttgtgggaaccactacgggtgtcaggggcgtcatcccaccgttggtcctctcaacagctcccttcgttgcccgcatggtgcagcaatccttggcagaggttccgcatgagtcaatcgaagccgctatctcttgtggcgctacggtcccccgtatcgtgaaatctgcgttgctcccagaggcgctgccttccatcgtccgcggtatctcaatcaccttgatcactgccctgggctacactgcaatcgcaggtgcggtcggcgccggtggcttgggagatatcgcaatccgctacggctactaccgttacgaagactccgtgatgatcgtcactgtaatcctcatgatcatcctggtgcaggttatccagagcgtcgacgacgcactcgccaagcggattgaccaccgcgcgtaatcgctcatcttttttgcacagcttcaatacagcattacaaataattgcgggcatcttcgatacccgtatagagaaaggactatccctatgttgaacagaaaagcatttctctcaggttctgccgctctcttcacctcactcgcccttggtgcctgcagctccaataatggcggccaggcacaggctcagaccttaacggtcgcagcctccccttccccacatgcaaagattctgaatgattttgccgcaccgaggttgaaggaccaaaacattgacctgcaggttaaggaatataccgactacatcattccgaaccaagtaacttcctccggtgaagtcgatgccaactacttccagcacatcaactacctcaacaactacaaccaggagaacggcacagacctcgtcggcgtcgccgcgatccactacgagcccttcggcatttacgctggccagtcctctgacctcaataacatccaggatggcgcccagatcgcagttccgaatgacccgaccaacgagggccgcgctctccttttgctccaacaggagaacctaattcagctgcaggattcgaacaatctgaatgccaccccgaacgatatcgcttccaatccgcacaatattcggttctcagaggtcgaggctgcagccgttccccgtcaacttcaggacgttgacttcgcggttattaacggcaactacgcaatcgaagccggtatgcacgtttccgacgccctcgccgttgaggctgcagacggcaccgccgtccagcagtacgctaactacatcgtcacgacgccggacaagcaggatgacgaccgcatcaaggcccttgtgagtgtcctcacctccgatgacttccgacagtacctgaaggacacctacgaccaggacgtactccccgcattctaatcctgcgcttccccagtacttcaacgcatggctaacctagacaggcagcggtcacttcacgtggctgctgcctattctatagctgctgattatattcagatatgagagtaagccttaagcctcaccggtaaccttttcccagtcccgcgcgaacttctcgaggcccttggtcggtaagcgtcactcgctgttagaccatgattgacctgacgcccctgtccttccaatagctccagaagggctgctctatgtctatgagcgcacgcctgctatggacatacctgcctcctgcaagcttgcctgagagcatatccttctcctcccgctcagaatgccttacctgctctatccacaggaagcaggcaagacaagtgccccagccacttcgtagaagaccccatggaagaaaagcaggaactcgtacagccttcgctgcatcgcattgacgaggctaagctcgccgtgtgcttgaagaccccaagcgaggagagccacgcgcgcatatcctgcatggtcgtcagtggcgacccataagctgtcgacgatacctgaaagggcatctgtcagcttcccgtcctcggtcctgcccctgccgcagaggatggcatattcgtcgcttaagtcatacgctcagcactccacgcagaccttcttgttcgatatgccacagcaatgcacaacatggccgtgcgtgtgcgcctccctcagcatctggatggccgaccttatcctgttgttcgtaagcgactcgtcgatgtagatcccgatcttttggcaggagacggtaggtccatacctgaagacgtcaagcgctgcctgcatcacctcgaagagcctcatgcgcgtggaaccacaatgtccttaaggctcacatggcagctttcggcaagcttcttcaagcgtcatgcctgccaagcgtgccctttgcatacgcggcccatgtggcggccgtgggcttggacatagccaggacagatcttgtctttacaaagaaggtcttgcctcacgagcaacacttccatctctgaaggccacacgcgtcgtggcccttgcaatagaagctgagcgatttgcacctcgggcacctcttgggtgttcccgcaagggcagagcctgccatcttcttggctatgagcgccttcagcctctctaagagctcgcgcttctcggcgatccccatctttttgatctgctgcagtatcattgaatccatccgggtcctttgatcctcgatgtttttgtctgacgacatacattgtaggcaaaggcccggacacttctgggcccttcttaggtcaattatggtctaacagcgagtaagcggatgacgaacgtacttcttgagggctttgaagggcactgtcgcgatgtctgcgcctatcttttagatcgcagacataatccgaatagaatgcggcatagttgatctcgtgcagcagccagtctggatgacttgacctgtatcattttttcggacagtgcagcttgaggaattatgaggctcctcttaactgcaagacaagccgaccgaaaagactacaggtaacaaacaatcttgctaccaaatacagcgatgagtagcgcctgaaaaacagctgagtgtgctatcttcaccggcaagcctaaaagccaccttaccaccgagttagggcttgagtcccaaaacacagatctgctgggtaaaagatcgaagagataggctatcagctgctaagcgcagcgaggctaaagaggaaaagctcaaaagccttatgccaagcgcagcagagagcttgagatggaacatgccttcttaaaggcagctgttaagccttctttacaaaggatctaagcgcaatagattgttacaagcagaagcttaaggagaaggaaaacttcccgatcaagatacaggctttaatccttaaggtattacgctcaagcttttattcatgggtgttccaagggagcaccagaaaacaggtgaggtgagcttaaagaggctatcaggcgcttgcaggtggactctgacagaggttttggggctaggtttacaccactgctatctggctgatgagtttttcccacactaccctctacagggtaggaaaatgcatgcgcgagcttgaagataaagggctcaccccctttacagatcagaagagaaccactgtccctgacagatatgccaaaccaaagcctgatcttatacattgtgacctcataaagccctgactccacctataagcttgttggagatatcacctatctctccacagaaaagggctggctctatctttcttgctgtgtgagacttaaacacccacatggtggtgggcttggtcgctgttggatagaacgggagccgatagtgtgctagatacactgcaagtagctcagtgtcgaggatatgtggcagaaaatgcaatctttcattcagacaaaggtgcccaatacacctcttagacttgtctgctctgtgggcttaagagaaacgatgtgaggctctcctgcagccgcttagggtacctgccacgataatgccttgccactcttaaaggcgagatgtactagcgagaaggctttgcaacaagaaaggatgccatacatgcgcaagttgaattcattgaggctactacaacagaaaacgttcccactcaacgatcaacaacaaaaattccagcgaaggtagtagatgctttctttgaaagaacgaaacctatatcagaagaggaccagatatcaccatccaatgtggcggcagattgtcaagctgagtgcaacatctccctaaagacctcgctggcagtcttgtatttcaggaccttccttgccctgtcgcagatcagctctactacatgctgcacctcctcgtttgtgaccttgctgaagtcgctgcccttaggggaagaactctagcaggagcccattggtgttcttaaccgttagcttctgccatagatggtgggggtcgcagaagtagaactgcacgcctcaaagggcatctgtgagccctgcatgccctgcgaactgcttgcccccacttaggagtgagcgtctcgagcgggcgtccctgtagcagcccgacttcggccttagagacgctcctgctgacgtgctggctctttccacggcaagcagcctcactgccctgtcggcaagcacgagcaggcacacggcccccgctgccacgagcgtgtcgtctacccactctccgaggcaagacctctcatcggcctgcttgggcctctcctttacgctgcgtaagatctcgatcttgcctttggtcttaggcctcttactgcgcaggtggtgccgcaccttgccttccgggccggatcccggcagctcgagggcggcggcctgggtctgcctgtaagaatagtcggcaggctcaacgacgcacctgccgctaccctcgagcctgagatgtcgtctatctcctccagggaccagtgtctgtccatgatgagtaagcgcaccttctgtgcaagcgcagggtctgaaagccgccttttcggtctttatctgccgtgagcgggcttgcgccctcctttgaggccgcacaggcgctaaagcgtttgtgttgcacgtttttctcgaccttgtggcagacgccggagctgtccctgccgatctctgccgcgatataggcaattgaccttcccttgtgccacgcagcttggctatgcagtccctctcctgtaggcttacaatgcttgtagtggcacattcctttttagctttcgacgttgattgagacaaccaacatcgtagccttccggagtgtgccacgcttgcattcagcgggctatcctgttgcactcagaatgctaatctgccacccgaaatattgacacaggtcaggaagctgcttccggccgcttcgagatgtcgtgggtgatgcgcagcttgccccctgcgcttttggccacccttgctgtgcctgcgcttgccgtgacgagtgagcagccttgtggccttcctgcgccctgaaagctcgcagtcgaggggtcccgaccccacgacacgctagatgctgtcgtcgcttgcggcaaggtctgagtactgcatcgcgatgcggcccgctatctcctcagcatgagctgcacgaccagagagcgcctatgcggattgtccatgagatctgggacgcctgcagcacagccgcctcacgtctgcacgcctttgcgcgctcgatgcgcggcagggccgtccggaaagtccctgccatccgttgcgcctgatcttgtgggatatggtcgacttgtcccgtccgagctccctcgtatctggctgaccccctcatggcccttccagcaaaccatgatgtcctcgcgcttcgcgatgctaagatggctgtagccgtccatggtgccttcaatgatgcatgtctttgcaagcaccatcataggttgcgcctggacggctagctcgtatttccctgttgcactcggagtggggatacgccagtaagaagaaacaatttagatgcacgattgatctaagaaaaaacccgcatccttaaggacacaggctcaacaaccatatgtaaaaactcttcctactggatacgggttctgcagtacgggcacaccttccactctgcgttcagaggacggtggcaagtcgggcacacgtttctgacctgcgtattgcagacgggacacacaacgaagtcacggtcgatcggagttccacacttcgggcacacgccgtagtgagagagctgatgctcacgaagggcaatgtctagatcctgctcctcacggtcaaccagataggagctcggacgcagaatcacgtatgcaagcaagccgacgatcgggatgaccgagatgatggcccagagccaccaaggctccgcgccacgccgctgtgcgtcacggataacatagacgattgagaggatgtagaggataacgacgcaggcgaccattaagtacaacaccatgcgtacttcaggggtaatgatctgatcgagaagctcttgcatgttacagtgctccttctttaatgatgtttaaataacctaaaacaagatattactgtaaaggcaatattgcagtcaatcatataacttttgtatggtcatacaccttgacccttcgtttagcagcaacatttactaggcaaattcataaacccgaacaccgatttaagggctcttcgctacttatgatggatagcactcctgcattcctgagcacgtggtgcccggacagcagggttttggcgacggaaggcttcggttctaaggcgcgatatggatgcttaagacaggtatgctggcaaggctctctaagaggttccctggggcttagggacgaatgggaggtctaagcctcatcaatataagggacagcaagattctcatatgtctcaaacccctgtcaagtggcaatgctatcgcggaacaggcacccacaaggcttcctgaactgcagggatgaaggatattcagcaaatgctgctgcggacgcatcctgcaacatgagacatgcgggcatccctgcccattctcatatccttagatagcgtgcatatgcacggccccaacatcgatgttccaacatggcggctaagggacagtctagagaaacgatgattaatgcccatgccggctgcgaaaggccacgtgactgatcctctttggcacattattgggaattaatcatcatttccctaaaatgtcactaaggaagccttcgactagagagggccttgcctgtgcactcttgtccgagaagggtatcgagtccaggaaggcatgcgtttgctcaaaggtagagcatcccttccttatcgtgaagcggcgcttcgaccccttaaggaagcgctacagaaggatagagaagaactcctgtatgctcgagtctctctcgcccttgcaaaccttatccatgtgcatcttttgccggcaggctgcacctcccggctcccagcttcgcttgatccgtcttggagccttcttgcggtgcatggggcaggacggatgtaaggatagcggctcctgcacgtgctggatgggtatccttccctgcctttcccgcatgccggcctagaaaagttgtgtggtcggtcccctctaacacgttatggggcattaatcatcgtttccctagagctgtgcgccaaacgcgcgtgggccatcgccgagatactgtagggtgcctctcctagtcacgagccacaagttgtcctttgcccaagctcctggagaagagacctgctgctgctgcttctttaagggctcggtgtcgcctgctgagctccctgatgcgccttaacgcctcatctggcttcttttgctctttggccctggcttaggtgagctttcctgatcttttgtacttgataacccactcatctaaggtcttgtcatagacctcaagctctttggtgtacgctctgatgcttctctttgagtctgcctggctttgccgcagcactggtagcctttaagtgctactcatctatatactgcctgggaagcttcgactttgcctttgccttcttctgccttatttgcactcactgacatctcatgacttaaatctacaggtggtgttgggtgggcatctgggcaaaggatacttgccaccagttgtctaccagaagattacagctcagtcgagatgaagagggtagccaagaccctcaggaaggaacaggggggaatcctcaactggtagaggaagggctcaaccaattcgtttctcgaagggctcaactccctcgtccagtcagcggaaagcgctgccaggggcttcaggaacacggtctacttcaggacgatgatcttcctcagactgggaaactcaacttcacggcccagagtcagcttgcatgcgctacccattagaaacgttgaagagcccatttagggttcgtaacgctttgggcacacgagccccgccacctcgcctgccgtcgtaattgatccacaggcgacatagctctcgttactcagtgctttcacggcttcaggcaccgaggcaaagacatgcttcggcttcatcccattctcctcgaaaaccttgccaagctcttctgctggcagtgcacgcggtgaggaagtctgggtgacgctcactgaggggaacgcaggggctagacgcctgacgataccctccacatccttatccttcagcactgcgcagagcagctggggccgtctgtccacatcgggctccatcccatccattgcggtcaggaaagtatcgactgactgagggttgtggcaggcatcgacgagcactaccggcgtggacttcacgagatctaaccggcccggtgtggggcagctcacgattgagtcataggctttgtcggggtcgagggcacgatcaagatagttctctgcaaggcagaccgcctcagcaatattcgccgcctgataggcaggtttgagcgcacccaattcctgatagtgtgcccgcggggtatcaacgttgagaatgagggggccgcctaagcggtcaggcctatctacgatgcggtaacttgcatgagggaggtctttgtgggggcgtggagtacccggatgcatctcccctgccgcgtctgagagcttctcaggacgcaacagcagcggcgtcacgtgagcagcacgcgcttgatttaagaagacatcctcaacgctgtcaggggtcgcagtaccgacacctaagacacagcttctcccaggtttgatgattgcggctttctcacccgcaatcttctcgagggtatctcccaggatcgccatgtggtccatcccgatgccggtgattccaactgacttgattgacttagaagcgcttgtagcatcccagcgaccgcccatgccgcattccagcaccgcgacctcgacgccttcatgggcgaaggttgcaagagctccaacagtcagaaggtcaaactcggtgacatcgtaaaggtgttggtgtgcttcgcagcgccgcgcattgacgcgccgcgctgcagtcgtcgctactgagatgccccaggcaaagagatctcgtgagatcggcttcccttggatctccattcgttcaggcatgtgtacaagctcaggtgaagtataaagggcggtcctcttcccttcccccatcagcaaagcagcggtgtagcgagccgtagaggttttcccattggtccctgcaatctgcacgttgtcataggcaagatcaggattcccggcttcaatcagcatatccgagactgactcaagcaaaggttggattccaaagcgcttcgtggcattcagggtttcgattgcccctgcataggaaagatgtggcacctcaaatggtacacggtatggcatagaacaaaccccctagattgcgtgattcttcggaagactgatcagtaacaaggcctgctgccgtaagtccggatccttggcaaggcagcctttgacagcagaggtcacggtcgtcgatccggttgatttgatgccgcgcagtaccatgcagctgtgggtagcccgcagtactacgaggacaccctgtgggttcagctcctccatcactgcatccgcaatctggtgggtcaagcgctcttggacctgcaggcgatgagcgtagccttcgaccaggcgccccatcttggagagtcctacgatcttcccatcgcggggcagatagacaatgctggcagctcccacaaagggcaggatgtgatgctcgcagaaagaggtgaaggggatgtccctcacgacgacaagtccgtcatcctcctcgtcaaactgtctctctaagtgagcctgcggcacctcatacatgccggacatgagttcctgggtagcccgggcaacgcgctctggagtccctttcaatccctcacgctcagggtcttctccgatcgcaaagaggaaatcatggaccgcattctcgacgccctgtttgtcgagcgccgcaaagccctgatcatttagcgggcggccgtaccggtcgcgcttgtccgtctcaggagatggcctcgttgtagaagattcgctcatgtgtctatgcgatccctctctctgctgcctcgaccacatgcttcatcagaatcgccgtggttgttgcaccgaccccaccggggaccggcgtgtaggctttcacaatctgttctgcggcttcctcatcgacatccccgacgaaccgtttggtttgttcgtcccagttcattccgacatcgataaccacctggcccgcagcaagccctgcagtcccaatcatcttcggatgccccgtggccacaatcaaaatatccgcctgacgcgtcaatgcattgaggtcacgtgttctgctgtggcagatggtcaccgttgcgtcacggctcaggagcagattcgccaccggcttgccgatcaccaacgatctgcctacaaccacaacgcgggcaccacagataggaacgtggtaataatcgagcagcgtgatgacaccttctgcggtgcaaggtgaaaagcccacctgctgtcctgtcacgacaccatagagtgaagctggtgtgattccatccatatccttcttggggtcaaggagcttgatcagtgcttcctcatcgaagcgtttcggcaacggccgaaacatcaggcagccgctgaccgtatcatcgtgattgatctcctcaatcgcctgtgcgatgtcttcctgggaggcatcttctgcaaaggcatgcagttcggtttggataccgagctttgcgcagcgtttggtcaccatcttctgataggtgagatcctccggacgctcccccacacggataaaggcaagctttgggacaatgctctgctggcttaactttcccatacgtgcagagagatcctctatcaggctgcgactgaccgtcgtgccctttagtttttccgccatctgatccctctctctacccgtgtatatgcagcatccgctttattgcaaccgtcttcgagcatcgactgcgtacgtgagaccagcccagttgcgtagtcagtatctttcatagaccgtgcattgataaaaacattgaggcaggcggcacgcagcgccgaggagagcagtgtcgccgcagcgcctacatcgctcatgagcatggttgagccaatccgtgtcaggtcatcgactatatctatggcttcgcagatcgtctccatcatgtactccggtggctcgcaggcgcgcctgagagcttcctcgagcaccgagtttcgataggctttttcctcttcggttttacgtggcagcttgtacgctttggaaagcgggataaaagctttcccatcctcatccgccaactctaagaggcgggcacggatagcttcgagcttcggaaggtactccctgagcgcctcctgggcgttttcatagccctttttgttggccgtgagccttgttaccatctcacccaaggcgactgctaccgccgccgctgtggcgctcgcaacaccaccgcccggtgtcggctctcgggaggccaacgcatccgtgagctcggtaaccgagtgttcctgaaatgaatcgtgtgacacagtattatttctttttctcgtcaatcggacaacccacacctagggagcacactcatctcaaacgtgagcatgctacccctcagtgtgtcaatccgctatttttgcctaagtaatttagaacagaccgacgattctgccgtcttcggtaacgtcgatcttctctgctgcaggccgcttcggcaatcccggcatcgtcattatattccctgtcaaggcaacgataaagccggcgcctgcggagaccttgaggttgcggacggtgatggtgaatccagtcggggcacccagcttgtactggtcgtcggtgaaggagtactgcgtctttgcgatgcagatcgggaggtcgccaaagccttgatcgtcgagctgctgcatctgtcttctagccttcggggtgaactcaacaccatcagcgtggtagaccttctgcgcgatatcggtgatcttctgctcaatggactcatccaggtcgtaggcatagtgcagctcagaaggctgctcgcagagcttgaggacttccttagctagggcgatgccaccctcgctgccttttgcccacacctcagagagcgcacactcgacgccgattttgtggcactcctctgccaccgcatcgagctcagctttggtgtccgtcgggaaggcgttgattgcgacgacgcatggtaggccgtagatgtcccggatgttggagacgtgacggatcaggttcgggatgccctgcttgagcgcctcgatgtcctctttgccgaggttctctctcttcacgccgccgttgtacttaagcgcccgcaccgtagcgaccattacgactgcgaacggtttgatgcccgtgtagcggcacttgatgtctaagaatttctctgctcccaagtcagcaccgaaaccggcttctgtcaccacatagtcggcgagcttcatcgcggtcgtcgtggcctcaacggagttacagccgtgggcgatattggcaaacggaccgccatggacaaacgcggggttgtgctcgagcgtctgtaccaggttcggcttgattgcgtctttcagaagtgcagtcattgcaccctcagcgtggatatcgtggaccgtgaccggctttctgtcgaaggtataggcgatcaccatgcggcccaagcgtgccttcagatccatcagatcggtggcgaggcagaatgctgccatcacctcagaggcgacagtgatatcgaagccgtcctcacgtggctcgccgttggcggcgccgcccaaaccgtcaacgatatttctgagctggcggtcgttcatatcgacacagcgcttccagacgatccgacgtgggtcgatattgagctcattgccctgcttgatgtggttgtcgagcatcgcagcacacaggttgtttgcagccccgattgcatgaaagtccccggtgaaatgcaggttgatgtcttccatcggcacgacctgcgcatagccgccacccgcggcgccacctttgataccgaagaccgggcccagggagggctcacgcaaacacaggagtgcgtttttgccgagcttacacagcgcatcttccagaccgactgaagttgtggtcttgccttcgccggcaggcgtggggttgattgcggtgacgaggatgaccttacccttacgtggcttatcctttaaggaacgaatatcgactttggctttgtagttaccgtagagttcaagctgatcagctgatagaccagcttttttagcgacttccgtaatcggaagcatgggtatttcttgggcgatttcaatatccgattttgccatgtaaggcttcctttcgcttcttggctgccgtggccaatggttaccgggtttcacggggcgatctgaccaatacgtactatccactgtggatgaacatcacagcaccgtaaagtataggcgtttttctgtattccttgaaaacgccacagcatacggtaacgcgagcgttacccaagacgaaaagccctagggaaacgatgatcaattcgcctcgatgaggccagtggggccacacgctgtatgtcgccggcttaaaatgtcttgaaccacgcagtgcccatacccacatagatgcctatctgtcttctggatatggtatagctacatccacgcatttcagcatatccaaaaggaagatatggacagatagatgaacttttaggaccttaaatcctaaggtctaaggaaaaagacccagcgagaggtgctcctggagcggatggatgcgatcgttgtatgggatagctggattgcactggtagaaccctgctaccactgacaggctcttgtcaggcatgtgcgcgctgcaaagacgatgcttaggatgtatctactgcaggttatgtttgctcttaagacgagggaacttaaagatgctatcctgtattgtcactcctggcagcgcttctgtgcacgtagacctcatgtctgagcaggtaccagatgcaacgacacttgcgaagatgagccatagcctcgagcggcagggactcggcaaagctatgcttcacgacctgaattcggagctcgagaaggcagggatcacggcgcggggcggctccatggtggatgcgaccttcacctgggccccgagctccacgaagaaccacgaccatgcgcgcgacccttaaagcgcaccagtccaagaaagggggagcctggcgtatcggatacaaggcgcatatcggcgtggacgtcggaggtggccttgtgcatggtgtggagacgattgcctagaatgtatccgacatatcctgtggcacatgcactcgtaagggaagatgacaggttctgctgcgcagactttaggctatataggtatagcgaagcgcccttaaggacgcataaagacccacacctctcatctatgcgctaaagcgttgcaagaaagccttcgactagagggggccttgcctgtgcactcaatctttttcacgacgtttctgttgaagcctgccgtgggcgacaccgccttgagggtctgccccagggcgagcaggtcgcaacgaaagcgagcagcaacagcgtgatgcgctggcctgaagccctgaagggcacatcctcgatgcaggagaccccgcactccctgcatgcccatcttggccgggacacctctatccttgcctctccatctcgagaggaagatgccaaagcgcgatgggagtcctgccgtttttctccatcggctgcccgcagcagggacacgacggtgtgtcctttacttcgagcctgcccggcacggagagtatacggggcggcgtcgggtatcttttggacgacgtttcgacctcctcggtgcggatgccctctctgggctctcccgtctgcacaaatccttcgagatgcgaggggattgaaaggaaggcaggagcttctttggcatgggaaatggcaggcagctgggctgctggcgatgctacacttgtcagcgcgctctccttgttcgggtatatatgttgcgatgcaagattgcttgaggatggccgctttctgtcttgcgggcactatgcttagggcacggcccctacagcttttacgatttcgaaccaaaataatcaacagcatgagaaagaaactctgtgtacagataagagagaagaacagaaacttccttgtgagaagagctggttctgtgaaccagccctctgctcatacggtattcggttgtaaccgtcgcgcttagtcttcaaagtccgtaagttgctcctgcaactgggcaatcgtggtctcgaattccttcttctggttctgtttcttctcgatgatggcaggtgcggcttttgccatgaatcccttgttattgagtatgcgttcaacaccggcaaggttcttcttggcggcatccagctccttgtgcagacgcttagtctctgcctcgaggtcaaccaggccgccgaccacaacaaagatctcgaggtcgatatcggtgagagagacggagcccctcggcttctcctgctcctggcccagcgccagctgatcaatgtagccgacgctgcatataaacccacgctgggactcgaggacggctgcatcttccggcgtggacttcacagccacgtcgagctgtgctttcggggagaggcgatagcgggcacggactgaacgtaccgcggagatgacacgggtcgcgagttcaaagtcgtgctctgcctgctcgttgatgaactgggtgaagcgctcaggctctggccactgtgccaccatcaggaactgggcggagtggtcatctaagccggaagccggcagggcatcccagacgctctcggtcacgaatggcatgaccggatgcagaaggcgcatcgaaacgtcgagtacgaagaccaggttgcgctgcacctgcagcttttcctcaggagtaccgtggagcagcctcggcttgcacagctcgatataccagtcacagacctcaccccagaagaagttctggagatcacgcgcatagtcgccgaagttgtaggtctcgagttggtcggttgcgttcttcacggtcttggccaggcgggagagcatccaggcatcctcggcggtctctgccttcggggctcccggtgtatagccgtccaggttcatctgcacgaagcgggaggcgttccaaatcttcgtcacaaaggagcgtgcctgttcggtgcgcggagacttgatcagttttttggtcttcttgtcgatctgcgcgtcgaacttcacgtcctggttgttggtgatcaaggtcagcaggttgtaacgcatcgcgtcggcgccatacttttgaatcagatccatcgggtcaacgccgttgcccttagacttggacatgcggctaccatcttttgcgagtatcgtcgcgtagatgtagacgtcgtagaacggcacctgatcggtgaagtagagtgagctcatgatcatgcgggcgacccagagagcgataatatcacgggcggtgactaacaccttcgtcgggtagtggccttccatctggtcggtgcaatccggccagccctgcgtggcaaaaggccacagctgcgaggagaaccaggtgtccagaacatccggatcctggtggatatgcctgctgtggcacttcgggcactcggtcggatcctccatcagggcatcctcccagccgcagtccttgcaatagaagaccgggatgcggtggccccaccatagctgccgggagatgcaccagtccttcaggttgtccatccaggtgaagtaggtctgagaccagcgtgcggggtggaacttgacctccccatccttgacggccttgtaggcacggtccttgagcttatcgacggctacgaaccactgctcggagagccaaggctccaacgcggtgccgcagcggtagcagtgcatcacggagtggtcgagctcttcgatgtggtccatcagatcgtgcttctcaaaccagtcgcagatagcctcacgcgcctcatcgcggtccatcccggagaactcaccgtagccgtcaaccacatgtgcagtctcgtcaaagatattgatctgcggcaggttgtgtgtctggcccatcacatagtcgtttggatcgtgggccggcgtcactttcacaaagccggtaccaaacttaggatcgacatgccaatcggagaagatcgggatcttacggttcacgatcggaagtatcacggtcttgcccacgaacttctgcttgtcggggtctttcgggctcacggcgatgccggtatcgcccagcatcgtctccggacgagtcgtcgcaatcgtgatgtatttgattccgtcaaccggctcagtcagcgggtacttcatgaaccacagatggcccttctcgtccttgtactccacctcatcgtcggagatagcggtgtggcaatgggggcaccagttgacgatacgcttgccgcggtagatcagcctggcgtgataccagtccacaaagaccttgcggaccgccttgctgaattgtgggctcatcgtaaactgcggatcggagaagtcgatggagcagcccatacgcttgatctggttgataatggtgccaccgtatttgcgggtccagtcccagcaggcgtcaatgaacttgtcgcggcccatctcgaggcggtttttgccctgatccttcagcgctttatcgaccttggtctgcgtcgcgataccggcgtggtccgttcccaggatccagcgggtcgaacggccgcgcatacggttgtagcggataaacgtatcctgagtagaatcatccattgcatggcccatgtgcaggataccggtaacattgggaggcggtatcaccacggtgcagtccccggtgcccttgttacgctgatagcagcccgcgtccatccacgctttaatcaagcgtggctcattggtgcttgggtcataggtcttaggcatttcttccacgatacaaaacctttcgacatgctccgtttaacggtggaggcactcgtgtcatgggcgcgcgccttaaacagaaaccttgtgtgtagaagactcttgcaaaagagccaaagagtagcataccacgcacgcacagagcctggaaattgaggttaaagcccttacatgtatgtacagctcctctatgagcagtacctacagtggattcagattctgcctatgcccatcgcggtgctgctgcagatcaccgattaacggacagccacacggtgccctactttcgtaccaatgggaacaaggagcaatcccatcagagcattgtgtgagttgcacaggcttgtgtctagttcaatccatcctgtcatcccgactttgggcattgcataatcctgcagaaaacaccgcgttaaagctcacgtgtcaagccgtacttctccggtaattacaaactggttgagcagctgacgccctatctgcccaaagtactgatcaggattcaagaaaatctgttggagccgcatgaaagctccaatgtctgtctcaacaactacagcttcacgatggatgtggcagtctatctttcccgtcttttaggcaaccggtacagtcttacctttaccgccggtggagtgaaccatgtagcagattgactacaggaatcgttgcagcgccgaaagccgcaacccaggcgtattgtaatcctgagcaccttggatcaagcggatcaggaagccctcagcaaagagatagccgatcagtttgtgggcgtagcgttctccatcagattcatgtcgcttggccaacaggctctcaatccggataccgatattgtgttcaccaccgatcacagcatcagtgaggaggatccccgtatcggttacccttccaacccacccgatggatagactctgtagaagctctcagcacgagtcactgatatctctgcagagactgtgcttaagctctttgaccgcacgcgctggtatgtctctgatacagatatcagagaggctgcaatcgattactacttgtcgtcaaaaaaacagatgcctggctcaaaactgagatcctctcgaagctcgtagcagaacggagggcaactctttactgattactttgaaaatagggtggcgatcctgaaacccatccatcccatcaagcatcaatcgtttgcttctgtgttgatgctgaagaagggtatctcctggggaaacgaccataccatctcgcttgtcaccctccttgccctggactcaaagcatccggaggagatcacttcctgtgagcacctgctgccggggctcttcagactgggatggagatctcagttgaacgactccaccgactacgatcagctcagggaactcttcaaggtacggctcaacaaacagcattaacactatcccgatatgatacaaggcccagaagacatttgatctcctgggtcttgttcattgtaatgatgcaatcagagctatgcgctcttcggcatcctcttatgcaccttcttggattgtgaggaatgaatcagcttcgggccctctttgccctgaaccgcttctttcgtcacaacaacgcgcttgatatccagatcagatgggatatcaaacatcgtatcctgcagcgtggactcacagatcgccctgaggccacgggcacccgtgccacgctgaattgccaagtgagcgatctcctgcagcgcatccggttcaaactcaaggtcgactccctcaagctcaaacatacggtgatactgcttaatgatggcattcttgggctcagtgaggatcctgactaagtcattctccttcagctcgtgggtcgaggtgatgactgggatacggccgatgaattccgggatcataccgaacttcaccaagtcctgagacatgacctgtgacatcagcgaatcttcgtcctcatccacatcctgagtaagctccgcattgaagccgatgcccttcttaccgatgcggtccgccacgatcttatcgaggccgacaaacgcaccgccacagataaagaggatgttggtggtgtcgatgcggatcagttgctgctgaggatgctttctgcctccctggggaggaaccgaggcaatggtgccctcgaggatcttgagcagcgcctgctgcacaccttcacccgagacgtcacgggtgatcgagagattctccgccttgcgggcgatcttgtcgatttcgtcaatgtagacgatacccacctctgcgcgcttgacgtccccgtcagcggcattgataagcttgaggaggatgttctccacatcctcacccacgtagccggcctccgtgagtgttgtggcatccgcaatcgcaaacgggacttccaggaagcgcgcgagcgtctgagccagcagcgtcttaccggtgccagtggggcccagaagcaggatgttgctctttgcgagctccacatcgctgtcgtccgcatcgtcttcctcagtgggcgccatgatgcgccggtagtggttgtagaccgcaaccgacatcgttttcttgacctcttcctgccccataacgtactgggacagctcattgtagatctcatgcggcgtcggaagctctttcaggggaagacccggatttaagatctcctcccctgcttccagatccggcatactcatgccggagagctcatccgattcacggataacgtcggcgcaggtcctcacacactcatcacagatgaagatgttgttcgggccctggatcatcttacgcacttgatcgcgggttttaccgcagaacgaacagcgtatttcatcgttgttcggcattcactactcctcgcttgctgattccttacgcgactggacgatcttgtcgatcaagccatagtcaagtgcttcctgaggacgcatgtagttgtcacgctcagtgtccttgttgatcttctcgatcggctgaccggtggcctggctcagcatctcattgagacgctggcggatccacttggtctcgttcgcgacaatctcaatgtcggtctcctgaccctggacgccagagctcggctggtgaatcaggatcatagagttcggcagcgaatagcgcttgcccttctgaccggaagccagaatagcggcgcccatcgaagctgccataccgacgcagatcgtggaaacatccggcttgatgaagttcatcgtatcgataatacctaatccagcataaacatctccgccaggcgaatcaatatagagggagatgtccttgtcagaatcctggctctccaaatggagcagctgggcgataactaggtttgcagattctttcgtaacctcctcgcccaagaagacgatacggtcattcaacaggcgtgaatagatgtcgtagctgcgctcgccacgtggggtttgctctacgacgtatggaatcagaggaatatccttcggattgtgcatacaaaaactccttttgcaaatatgataggcctctaagaatatccccagcagatgcctacgcattactggggatagcaaattttttaagatgtgtccaaatagtggaactaaaaactacttgttgtcgccctcgtcagctggcttggcgtcctcagctttctcgtcggccttgtcggagtcatcagccttgtcagagtcgtcagcgtccttcttgtccttctcagcgatctcgtcgacgatattgacctcagcgttgtccaccatccacttcagtgccttatcgcggcggatggactctctgattgcgggcatctgtccattgtccgtgaaggtcttgatctgggccttgatgtcctgagcgccagaacgcttgaactcgtcctcgatatcgtcctcagtgacatcctcattgaggtgctttgcgagggcatcgagagccagcgactgacgggcacgctcgtctgcctgctcgcgcagatccttcatgaactcatcggaagagatgccacgggccttcaggtagatgtccagcgtgagaccctgacgctgcagctgggtcaggaactgctgggcgatctcgttcaggacctgattgacatagttctcagggatcggatcgagcttgacgcgctcaccgagcttctcgaccagacggtcctccttgaggctcggaagtgacgtctttttgtcagactcaatgtcgtccttcacggcgtcacggagctctttgatcgtgtcgaagccgaagttcttcttagagaactcatcagtgagctcaggagtaacctgctcacggatatctgtgagcttgaccgtggcagtgtgattggtgacaacgtcaccgtcttccttcttctcggtcgtagtccaggagatgtccttggtgtcgccctttttcatgcccatgaggccatcaatgaagtcagaggaataggtggaagagtcggtgttcaggatcttgcccttgccggcaaggtcagacgcgttctctttgtcggtgatgtcggcagcgataatgtcgcctttctgcacaccgcggtcctctttgatggactcaacggtctcgtgatagctcatcagctggtcgagctgctggtcgatctcggcttcagtggcctcctcaggcggcatctgaatggacggcgcgtcgtaggagtcaagctcaacctcaggacggaccgggatcgcgacggcacagtcgtactcttcgccctccttagcgatcttcggatctttaccgaagctcacctgctcaaccgggacgatgtccagctcgttgagcatctgcggctcaacgtcgttgaggagctggttggtggcgtctgccaggacggcatctctgcctataagagagtcaataacagggcgcggggtatggccacggcggaatcctttgaagttgtagcggttagcaatggtcctatacgtatctttgatcgctttgttgacatcttctttggagatggtgagctgagcggagagctcgttgtctttacgctcacctgctgtgacggtaatcttcaaggttcctccatgaactcgttctgcaagctgtgtttcctgacgcagtttctcacatttatcctgtattgagtggtgcgggcgaaaggacttgaaccttcatgagataaatctcactggaacctaaatccagcgcgtctaccagttccgccacgcccgcaacatacacgcacagactaagaataatagcaaatttcagggatttgcgtgcacctgaagctaaatttttccctctctgtgcgcgaatttgtacgcacccaccatatcatgttcacacagagccgtcgtctacgatcagttccttaccggtccgacagatcctgcagggcatagacaccaagagtagtctcacgcagcgtctcgatcgactgtaccagcgccgtcgctgcggacatcgtggtggccatatcgataccgcgctccacggcctcgcttctgatcttggtgccgtcgccgcgggagttgtgcccgtgcggggtgttaatcaaaaacgcgacctcaccgtttctcatcaggtccaacacgttcggatgcccctcacggatcggtttcacgatcgcacagtcgatgcccgccgcacgcagcgtctttgcggtgccctttgtcgcaaccaggttgtagcctaagtgcctcagtgacattgcgaccggcgcaatcgagcgcttgtcacggtcacagacactcacaaacacgttgccggacatcggcagatcgtagtcgatggcctcacgggtcttcgcataggccctcggaaaggtcgtatcaaggcccatgacctcaccggtggatttcatctcaggccccaggatgacctcagcgcccgggaacctgctccacggcatcaccgcctccttcaccgcaaagtagccgaagtcacgcgctggatccggcagatggaaggagtcgatgctctccccgctcataatgagcgccgcatacttggccaaaggtattccgcttgcctttgagctgaagggcaccgtgcggctcgcacgcgggttgagctcaataacgaagatctgttcatcctttacggcaaactggacatttaagagaccatggatgtggcaggctaatgccagtttggtcgtgatcgaccggatcctcgacacaatcgtgtcagagaggctgaagggcgggaagcagcaggcagagtcaccggagtggataccacactcctcgatgtgttcaagcaccgagcccacatagcactcattgccgtcacacagcgcatccacatcgagctcgattgcatcctccaggaaggagtccagatacaccgggtggtccggggaaacctgagtcgcctcagccatgtacttcttcaggtcgttgtcgtcgtagacgattgccatacctctgccaccaagcacgtagctcggccgcacgatcagcggatagccgatgtgccttgcaaccttcttggcctcttcaaaggtctccgccacactcgaaagcgggtaggcgatatcgagagagtccagcagagaggagaatctatctctgtcctcagccaggtcgatcgactccggctgcgtacccataatcggcacgccagccttcttgagcctgctcgagaggttgatcggggtctggccgcccaaggtcacaatcacgcccaggggcttctccatctcgacgacattcataacatcttcaaaggtcaggggctcaaagtagagcctgtctgaggtgtcatagtcggtggagacggtctccgggttgcaattgaccattacggtctcaaagcctcgtttctccaaggcatacgccgcatggacacagcagtagtcaaactcaatgccctgcccaattctgttggggccggcagagaggatcacgacacgcggctttttagcctcacagaactcacttttaccaccttgctcataggtgaagtagtggtagttggtgcgggaagcaaactcccctgcgcacgtatcgacggttttcagctgtggcttcacatggaggacctctcgcagcgccctgatgaccgcctcaggctggttggtcaggtagccgatctggacatcactgaagccgagctgcttagccgccagcaggtgtttggcatccaaaccggaaagtccgcgtttctggatcgccttagcagcctctacgatgtcctggatacgatagaggaaccagttgtcgatgccggtaagcttgtggatcttctccacgccccagccccgtctcattgcctcaccgatatagaggatccgctttggagtcgcccgacggatgttgtcctcaaaattctcctcgtcgaactccatagagccatcgaagtccaaaccgaagtgtccctcttcgagcgaacgcaatgccttctgcagcgcttcctcaaaggtggagccgatcgccatgacctcacccacggacttcatacgggtggtcagagtctctgaggcgccttcaaacttctcaaaggcaaaacgtgggatcttcatgacgcagtaatcaagcgccggctcaaaggaagcaggcgtggtgccggtgatatcgttcgtaatctcatcgagcgtatagcccaccgagagcagtgccgccatcttcgcaatcgggaagccggtagctttggaagctaacgcggatgagcggctcacgcgcgggttcatctcgaccacgagcacgcgtccatccttggggttcactgcgaactgtacattggagccaccgcaggcgacgccgactttctccattactgccagcgcgtagtcacgcaggcgctggtattccttatcggtcaaggtctgtaccggagccaccgtgattgagtcgccggtgtggacgcccatcgggtccatattctcaattgagcagacgacgattccgttgccggcgacgtcgcgcataacctccatctcgatctctttccagccctcgacggactgctcgatcaggacctcagtctcaggcgaaagggccaggccttcgcgcgcgatcctcatcagactctcatggtcgtacgccatgccgccgccagcgccaccgagcgtaaaggcgggtcgtacgacaaccggatatccgagtctgtcggcaatctgttcgcattctttcagggtgtgggctacctgggatttggcaacctcaaggccgatctccttcatcgcgttagcaaagagctcgcggtcctcgccgactttgatggagtcaatgtcgcagccgataacctcaacgtggtatttcgccaggacgccagcttcggccagtgcaacagcacagttaagaccggtctgaccgcccatgttcgccagcagggcatccggacgctccttctcgatgatcttggttacggaagacaccgtgatcggctcaatgtaggttttatctgcggtctccgggtccgtcatgatcgtcgcagggttcgagtttacaagcactacctcgtagccctcttggcgaagagccttgcaggcctgcgtacccgagtagtcaaactcacacgcctgtccgattacgatgggaccagagccgatgatcaagattctcttgatgtctgttctccttggcattagtggtttctcccctcgcgtacatcgatatccaagtagtccttgttgccgtccatcagccgtgcaaaggcctcaaaggcataggtagaatcgtttggtcctggttttccttccgggtgatactgcatcgagaaagctgggatatccaggaactgaataccctcgcaagatccgtcattgaggttcacgtgcgtgagacgcacgcgtccgaatttttttgtctgtgcaaccggtgcgatgtgatgctgagaccaatagcgaagatctgtggggtgctctttcaccccaccggagagctccgggatcagcggcccaaagctcgagaagaccggcccgtagttgtggttctgggcggtgatctccaccttgcccgtaagcaggttcataaccggctcattggcgccgtgatgcccatatttcagtttctcaatctcagctcccgctgccattgacagcatctggttgccaaggcagataccgaagatagggtatttgccgagcgttgccttcacagtctccacggtctcagggacgctcgaagggtcacccggtccattggagaagaagactccgtcaggatatagctcatcgattgcagagaacggcgtattccagggaacaaccgtgacctcacagcctaccttggccaaccagtcgaggatgccctgcttgataccacagtcaaccacgacgatctggtgccgaaccttccgtccttcaggcttcacggtgaagcgatcttcgtgggacacatccgtcacaaagttatgttctgcaatgtggggtgacgcctgcacacgttctataaggtgctcaggatctaagtcctttgtcgagatcgcagcgcgcatcgcacccttctcacggatattcagagtcagagcacgtacatcgacgtcctcgatagctacaacgttgttgcgcttcaggaaatcagggaggctctcgacgctctgccagttgctcggttcatagcacatatcgtgtacgacaagccctcgcaggttcggtcggtcagcctgcatatcgatcttcgtgattccatagtttccgatctgtgggtaggtcagcgcgacaatttggcccgcataggaaggatcagtcacgatctcttgatatcccgtcatcgaggtattgaagacgatttcgccgaacatctctccctcagctccgcaggatcgtccttgaaagaccatcccatgctcgagagctaatagcgcttcaggatgtttgccatcatccaccagaaggttcacaatcacacctttcgtcttaggcttgccctatagttataaaaaaagcacgtctcgcgacatgcttctaccattttaaactatagatttcaccgattttctccttaccagcatcccgtgctgttttaaaggctttttataagtgtagtgactagaaaataattaaggtaatcaaaccttttgtcctgatagatagtgtgaagagcccatgatgaaaatctttatccaagaagtagcatttgaacgttcttctgtatctaacagtctagataatgggtaatggtgtacctacgtcgagctgcggaggcttacatcggccatcaccatatagcgaaccctcttgcagtttcaggtcacctatcacaagcttggttgacccggaagaagtagacctaccagttgaggtagcttttgcatgttgaccttggacatgcctgtgaggtgccgggttcacccgttatctaaactgttagatttttgtatagaaaactcctgctgtgcggatcaaccacccagcaggagtcgataacgatataaagataaaaactataaagccagtctctaacagatgccttgagccatcattgcgtcagcaaccttgaggaaacctgcgatgttagcgccgaagaccaggtcaccctcatggccatactgcttagcagcatcccaagcggacttgtagatgttattcatgatgtcatgaagcttatcatcaacctcctcgaagctccaggagaggtgctcatggttctgagacatctcaagtccagaggttgcaacgccgccggcgttagctgccttgcccggtgcgaagaacacgccgttcttctgcagatactcagttgcatcggtcgtggtcggcatgttagcgccctcaactacgtacttggcgccgttagcgacaagcttcctagcatcgtcgagatcgagctcgttctgggttgcgcacggcattacgatgtcgcacttctcaccccaaggacgttcgttctcgtggtactgagcatctctgtggtccttgacatactccttgatgcggccacgctcaacctgcttgatctgaacaagtgcgtcaaagtcaacgccgttcggatcgtaaacataaccgtttgagtctgagacggttacaacatgagcaccgagttcctcagccttcttgaccgcatactgagcaacgttgccggcaccggagattgcaatggtcttgcccttgatgtcctcattcttctggtggagcatgttctccaggaagtagaccgcaccaaagccggttgcctcagttctggcaagagaaccaccataggagagacctttgccggtgagtactgattgccacttgttcgtgaacttcttataagcaccgaaaaggtagccgatctcacgggcaccggttccgatatcaccggcaggaacatccgtgtccggtccgatgtggcggacgagctcagccataaatgactggcaaaagcgcatgacctcgctgtcggacttgcccttcggatcgaagtcagagccacccttcgcgccgcccatcggaagcgtcgtaagagagttcttgagggtctgctcaaggcccaagaacttcaaaattgagaggttcacagacggatgcagacggatgccgcccttgtagggtccaagcgcagagttgaactgaacacggtaaccacggttgacctgaaccttgccttcatcgtcaacccaaggcacacggaagatgatgatgcgctcaggctcgaccaaacgttcaaccaagcctgccctctcatactctgggtgggcatcgagcgccggttgaatcgttgttagaatctcacttgcggcctgaataaattcggactcatccttataacgctcttggagctgtttaatgacgcgttgtgaatagttcatcattagccctttctccttgtaggaagctctgtaagcctcttgttccttcttctggaaccatgaataactgtatccttatacgcaaggcctcaaacaagaagaaaacgagctgtaacgttttcgttcacaaatgttctttttcagcttacatactctataagtcaactgaaaagccctgttgttaaatttgtgtttcaccgatgccgaaataagccgtcagatagcccgtatatgcaagccacaagtaactactggaagagaatcgcttcaaggctcattgccctagctgtggcgggatagatgtgggatccatttcactctcatgttgtcgcgtcaggcaccccgtccgatgaatgccgagcttccatgaagctgtggaggcatcccgagaagaggttgctcctgaccgccacgctgcggcaagactcgatgtatagagcgttgcgtacaggggacgagtaccatacgcgaagaagcatgcgatcctggagacggtggccctcggcccgccattgccgagagcgcctctctatatcttctgtacggccatcgtattctgctgtccattttctctctattgtcctctatcgccgggcacattagcaatccagctatatgagagacacaagcgagtacggtggccattttcttcagctgacgatctggctattgtggttcgactattctgcgtgatggcagaattgtcaagctgagtgcaacatctccttaaagacactcgtgctatcctgatgctttcaggaccttctccgcactgtcacagcagtcagctccaaccgcatcaccgagtctcctcgtttgtgacccccttgccaaaggcgctaggctgggcctttaagagggcaagaacttggcaggagcccatggtgtccttaaactgttagctctgccaaatggtgggggtcgtcagaagatagactgcacgcctcaaagaggtctgttaaaacatcgtagcacgcgcaactgcgtggcctcctatcggacgtgactcttaagggggtcgtcctcggtagcaacgaggcgggccttagagacgctccgctgtcgtgcgggtggacatcttttccgcggcaagcaagcctaatgccctgatcggcaagcaacgaggagcgcacacaggttcctactccgataagaggtcgtcatctctgtcccagttcccgaggcaagaccctctcatgcggcctgctttggcctctccttgtaggtgtgtaagatcctgtcttgccccttgatctgcgggggcctctttcctgcggatctagctatcccctttcctgcgcagagtggcgccgcatcttgtccttgcgggtccggttgttacccggcagctcgaggcaggcgctatggacctcccgatagaatagtcgtcaaggccacgagcacctgccgccaacctcgaagcctggatgtcgttatctccctcaaaaaacaggaccagttatgtccatgatgagagataaagcgcctagcagagatgcgaggagggggtcgaaaatgccgctttcgaccctggcgctacgcataaggtcgcttaccatcaggacagacactggtaccctgaaaaacgaggggatagaacgagcattctcaggctcgaggcggtgcgcggcagggtgtggcgtgttgcagcctgcacgactctatttctatcgggggtccatagccgcgctcctcgagtctgccgaagaaaccaggcccgcaaggcaagaatgcggccgccacctgcggcaggaacgggaagcagatcgagttgcagcaagagggccgcgagacgagggggtcatagtatcaggactttactgacaccagaagaccggccaacaaagcaggtgccgatgatagaggtgctttgcccttcgagatgggctagatggacatcgcttatcggagtaggaccttggtgcctgctcgtgcttgccgacagggcatgtaaggaagtctgcttgccgcgcaaagatgccaccactgacagcgtgggagcgtatctctaaggacccctttcgggcatgctacagggacgccccttagacgctcactcccgcccccccctaccgatgagaggggcaagcaggttcgcagggcatactcaatgtttacagatgcctttgaggcgtgctagttctactctgcgacccccacatctatggcagaagcttgaacagttaaagaacaccaatgggctccctgcgcgaagttcttcgccttaaggcaaaaggctttcggcagcgtcacaaaccgaggagatccggtatgcggttggagctgatctgtgacagggcgagaaagtcctgaaatacagatagccaacgaggtctttaaggagatggttgcatcagcttgacaatctgccatcacaaatagtcgaaacacaatagccaatcgcagctggaagaaatggcaccgtaccgctgtgtctctcctatactggatttgctaatgtgccggcgataggaggaatatagagaagatggacagcagatacgatggccctacagaagattatagacaggcgtctcgcaatggcggccgaggcaccgtcatccaggatccatgcttcgcgatggtctgtcaccacgtaccacgctctacatcgagttcttccgagcgtggcggcagaatcctcttttctcgggatgctccacagcttcatgaggccgcatctcggacgggttgctgacggacaacatgaagtgaaatggagacccaatctccgcacagctaggcaatgagccttgggggacttctttcccagtagtactttggctgatattacgggctatctgaggcttatttgacactgtgaacacaatttaacgggctttcagttacttatagagttgtaaggcgaaaaagaacatttgtgacgaaacgttacaggctcgttttcttcttgtttgaggctctatgcgatatagggatacagtgttcatgtcgttccagaaagacaagaggcttaagagcttcctacaagagaagggctaatgatgaactattcacaacgttcattaaacagctccaagagcgttataaggatgtcgaatttatttcagtgccgcaagtgagtattctaacaagagtcaacaacggcgctcgatgcccacccagagtatgagagggcaggcttggttgaacgtttggtcgagcctgagcgcatcatcatcttctgccttgggtatgacgatgaaggcaaggttcagtcaaacgtggttaccgtgttcatttcacctctgcgctttggacctacaagggcggcatccgtctgcatcgtcgtgaacctccaattttgaagttcttgggcctgtgcagaccctcaagaactctctatcgacgcttccgatgggggcgcgaagggtggcgctgacttcgacgcgaaggcaagtcgcgacaggaggtcatgcgcttttgccagtcatttatggctgagctcgtccgccacatcggaccggacacggatgttcctgccggtaatcggaaccggtgcccgtgagtatcggctacctttcggtgcttataaagaattcacgaacagtggcaatcagtactcaccggcaaaggtctctcctatggtggttctcttgccagactaggcaacggctttggtgcggtacttcctggaagaacatgctccacagaagatgaggacatcaagggcaagaaccattgcaatctcctgtgccggcaacgttgctcagtatgcggtcaagaaggctgaggataactcgtgctcatttgtaaccgtctcagactcaaacggtttgtttacgatccgaacggcgtgactttgacgcacttgttcagatcaagcaggttgagcgtggccgcatcaagagtatgtcaagacccacagacgatgctcagtaaccacgagtcaacaacgtccttggggtgagaagtgcgacaaatcgatgccgtgcgcaacccagaacgagctcgatctcgacgtgctaggaagcttgtcgctaacggcggccagtacgtagtttgagggcgctaacatgccgacggcacgacgcgatgcaactgagtatctgcagaaagaacggcgtgtcttccgcaccgggcaagcagctaacgccggcggcgttggcacacctctggacttgagattctcagaaccatgagcacctctcctgagcttcgaggaggttgatgataagcttcactgacatcataaataacatcacaagtccgcttgggatgctgctaagcagtatggccatgagggtgacctggtccttcggcgctaacatcgcaggtttcctcaaggttgctgaacgcaatgatgctacaggcattctgttagagactggctttatagtttttatcttttatcgttatcgctctctgtgggtggttgatccgccacaggcaggttttcttacaaaaatctaacagtttagataacgggtgaacccggcacctcacaggcatgtccaaggtcatgcaaagctacctcaactggtagtagtctacttcttcgtccttcaaccaagcttgtgataggtgacctgaaaactgcaagaggttcgctatacggtgatggccgagtaagcctcgcagctcgacgtaggtacaccattacccattatctagacgtagatacagaagaacttcaaatgcacttctttataaagattttcatcatgggctcttcacactatctatcagggacaaaagtgtttgataccttaataattttctagtcactacacataaaaagcgctttaaaacagcacgggagctggtaaggagaaaatcggggaaatctatagttaaatgtagaagcatgtcggagacgtgctttttataagctatagggcaagccatagagaaaggtgtgattgtgaaccttctggtgggtgatggcaccatcctgaagcgctattagctctcgagcatgggatggtctttcaaggacgatcctgcggagtgagggagaatgttcgtcgcaaatcgtcttcaatacctcgatgacgggatatcaagagatcgtgactgatccttcctatggcgggccaaattgtcgcagctgacctacccacaagatccgaaactatggaatcgaacgaagtcgatatgcaggctgaccgaccgaactgcgagggctgtcgtaccgatatgtgctatgaaccgagctcaactggcagagcgtcgagagcctcccgatttcctgaagcgcaacaacgttgtagctatcgaggacgtcgatgtacgtgctcgactctgatatcgttgagaagggtgcggatgcgcgcgtggaatcatcgacaaaggacttagatctgagcaccttatagagacgtgtgcaggcgtcaccccacattgcagaacataactttgtgacggatgtcccacgaagatcgcttcaccgtgaagcctgaaggacggaaggttcgcaccagatcagtcgtggttgacttgtgtatcaagcagggcatcctgatgttggccaaggtatacggctgtgaggtcaacggttttgtccctggaagacgccgttctctgctaatcgtataa

SEQ ID NO: 370 - DNA, 64805 bp, Unknown
  Metagenome-assembled genome
gcggttgcattcccgccagatggacatgcatgttgatgaagaccaggcatgaggaaacggccttggggatgcggacttcgcgcctgcgtaggcgctttctctgaatcgggaacgattgcctcgatgcggctgccagaagtgatgaggaccatgccctcctgggctccatgtctttcctgccatcgaggatggttgctccgatatatgcagtgcgtccggtcgcgcccatatgccttctccttctggatttgcggttatgggtgcgagtctagcaaaaataatgcatcagaggagcggaagaatgcattgcctggcatgccttgcgagggccgcacccgtcgtcccttgtaccgagagtgtaaggcctgcatggtacagcaatgcccgtaccgtacaatgcaggaagtggtggggcggaggcatggaggcaacaatgtagcttggctttcggtcgtcggctcgcattcctgtgcgctcctcattcccaacatcagatgggcaaagaggcagcctgcaggatatgagggattagaagcgtgagagcagggtcctgctcgcgctcgaacgtgtgggccaggtgcttaccgctgcacgtcgctctatttcgtctgtccggaggcgcctcgtttcccgggtcttcgtgctcatcgctgcagcgcttctgatgatcctccatgagattgcctgggtccgctatttccaagggatggagagaagctcgatgggatgtatcaagctccggggatgttcctgtgccgatacgagcctgccgttgcggccttcgtccttctgggcatatggcacaagtctcctctggcagcgatctctgccatcatcatcgctgtcggccatattggcatccatctgggcatctccagagcggaaggatggcgccgtgagagccgcaggcgcagaggagaggggggcgccataaatggctgacagacagctgtcagatggacttcggtgcgatgcagaaggttctgatacagccgttgtcctgcattgacgtggctgatccgtgatacatcattgctatatctggcgaaccgaacgcagaaagccttgctgccatggccgaagactggctctgcgtctgctcatggcttctccagccctgatgtagccacgggactggtcatcgggcggctattaccccacgatatcgagcgctcctcgccgttcaagatggcagggatcgtgcccgtgaagccgtaggtgccatcagaaagcgcggttggtgcatcgccgaagaacgagatgatatggccgtcgattgcggtccaggtgccgtgggcatccccactcctacgacgagctcggcaacccaagggcaccaagacgagggccgggtacgcgcctgctgcgctgcctgacatcacggccgagggcctcctcgcggccaaggggctccaggccgagtacttcgagcgcatcaacgagttgcggcgaaagaagggaaagaccctccgatggcaccttgagcagaccgacgagacgtccgtgatttacgaccaagtacagcgagcgcatcaagccgagctcgtgtcgcaatggtggtcgctcgagcgtgacaactacggccttgacgactcctccctccacgagctcagacacacttgcctacgctcctcgccgaggagggcgtgcaccccaaggtcatgcaggagctggcgggccactacagctcgcagctccgatggacgtgtgcacccacgtcaacatggacgccaagcgagaggccgtcgcctccgcgtccaactcttctagtcccgcccacaaagttggctgtatgcaagtcctcccgtcgcgtatgatgatgagaggcgaggggtagaagatgcaaagtcctggcgattccattatcaagttcgacgatgacgcaacctcagcctgtatggaggcgatgaggtcctgacgaaggcgtttttctcgtcgagcgagctggagtccttcagaactgcgctcactgatttcaagaccttcgcgatgctgccccgaatggtggagtcataaacgagctgcttccaagaggcccgagtacttgccgacctgcctgcggcgacccaaaagctcatgcagggggcaaactgttcctgcgaccggacaaagagggcaggctgcttgcgatgctggtcaacccggacagccaaagaattgccaggaacgttcgcctcaaggagatacagcgagttcctgcggtgaatgacatgagtttcattctgagctcatggcgatcacccagcagctaaacgagattcaggaagcaatcgaccaggctgcaaggcgcagatcacacaccgcgaggttgatggcacggtgccgcgcagtatctcgaatgggcttcggccgaaatcgacccggagaagcgtgcggcggactgcctgacggcacaccgatgctgcgtcgaggctccactcgtgcctcaataccgttaaagagtcggcgggattcttcctgtcacagcctgcgagagagtccctcgggagaggcggttctcgagcaggtgaagccctggaactggggaaagacgcttcgggcggcgacgcagttgattccgcaggccaacgagttgcgacgttcggtcgcccgtgcacctactatgcccaatacgcctccgcatcgagcttcatgctagatgacagaacgcaggtggttcgagatctggacatgtatgccgagcatatgtcgctggcgattctgggcgaaaaggccggccatctaaaccgtggctttccccgaagacgctagacggtctgccccttccgaagaagcgctccagaacgtgtgcaagacggtgccgatattgtctcgttcgtcgagtccgctgtctccagatacaagagctcgatgagtcgtcggtcgggcttatcgaggcccttcgacgacgccggtgaaacaactgcattgccaaaggagtagttagggaatcatggctgtgagcacgggcattgcgctcgtcataatctgtgcggcaatcctcgtgtcatcggcatcattcgcaagcttcactagcgggccgctaagagctcgctcccgtaacgtcactgatgacacccccaatccctgtcgttcgtggcagagattccagctggaacaattcgtggcaaattagtggcagcccacccataggcgaatgaatgcgcaggtaggttgagtgttttcaaccgacgtgcatactgagtggagtgatcctttaacggcatgctccgcctggccggctcagttcgagccggccttctgtatcgtggcccagcgcgggcttcccgcgaccgtttctgatcctgacgcttgcctctacgtcccgggttcggtcctcttctcgatgcccccggcctataggtcgcctgcgttccgcgcggatctcgacagcctttatagcccgcttccgtgccgtcggcggacgggaggcaccgcaagcaagtaccaagcggtagcaggcgcttcgccgcaaggccggtgcggtccttgcgccgcgcgtgcccggattcccacgccagggttgtatagtccggtgtggacaggaggaagatggccagcgacgattccggcatgagggccaggaagcccaagctcgccgtggaggagcagatagcgcacctgaagtcgaagggcgtgacgttcgatttgtgctctgagggggaggcggccgatggcttgagcgacagacgtactacttcaagctggccgcctaccggtcctattcgacaagcgcgtcggcggcgagcgagacggcgattacgtggggctcgtacttcgggcacctgcgcgacctcgctgccatcgaccacacgctgcgctacacctactgccgacgacagcttcaaaagatcgtggtggtcaaccgcgtcatgcagccctgcatggacgatgatggaatcttcacacatggggctgttcgatttcctgctcgacaagaacagccttgactgatatttgtgtaatccagcaaggatcttctgctgttgcgtgacccccaagaccgatgtcttcgatgcgcgcaaacaatcggcaacctgcggccgcgtccatgaggcgcagggcgggttcatttgcttcggctgccgggcggcggcggatctttagcatctggcgcccggcattcccgcggcgtccggaaccagtatctgatatccttgccgtgccggaacgtgtcgcggggcatccggaggatgccgtctctcataggatggcacaccgtccttccgcctggcatctggtgcctcgggcccgcgacgagggcccaaggagtagtcatccattcgtcggggcaagcaggaagtaccgatgatggaggcgggtgcgcaaggccacgcggggcgtcagatcagtcacgccgggtcacccactaggctcgatttgtcggcggcctgcctattggtgcagacgtctatacgcgtgatgatgctgcttcggctacagtccctcgccgtcggtaatcacgccatgtgagtgtgtgttgtggatctggaaggcgcgccagagtcgaagaatagcctggccgaagctctcccgggctccaagcgctcggatggctccctgtcctggccatagaaatggggaccgccgtcgtaccggtggccacgtccgtcacaaccgtgcctcagacgcttgaaatgcgaatgcgatgctttgcggggctgcggacacggttcgtctcttgcaaacgcttgtccggtgctttcccccgcgtaccggctcggcgagatcgccggccgctacttacgcaccacgctgatgcgctggcggatgtggtcgccggactcgatctcgtcgaccatggcgatggcgtagtcggctagctgaggacggactcgcccagcctcgttgagcgtgagcttcctcgccgcccaggatgtaggcgccggtgcgctcgccgtcggcctggaagtccgctgccggggacacgaaggtccatgacgtcgttgcggctgcgcagtttctcgagctcttcgccctgggcggcggccagcggcttgaaggcgtcggggaagtcggggcccgtggccacgcacgcggtgtgctcggggttcacgtagagcgagcccgcgccgcccacgacgagcagaggcgcacatcggtgccggagagcacgtcgccacaggtgctggctcgggcccacgtgcccgccgagcgtctcgggcgccaggcgccgaaggcgtcgaccacggcgtcgaagcccgccaggtcctcggccgtgatgtccatgatgtccttctggacgccttctcggcggccgtctggttctcttcgcgcacgaacacggtcacgtcgtgtccgcgctccacggcctccttcacgatgagcttgccggccctgcgtttgctgcgacgactgcgatcttcttcatgatggtggtcccctttcgtaggttgtaaccttaacgcttacagacactcgtgactatgccatgccgccgttgtaatgacaacacttacaacaagaggccatatcttctccatagttgtaaacagtgacattacaacatgacgtggtacgctgtttcgcagaagggaaagagggtcatgaagttctcgaccaggctgccagtggccaacccaatcatctgctctgcatcgtcctgctcggggagggagcacaagaccacgtcaacgttcctcgcgggaagcgtcgcgtgaacccgtcgtcgtccgcaacgtccgggccagctcaaggctggccggactcgtcgccgtggagccgggcgtcggaggggctcgtctcacaaggaccggcagagataacgctctgggacattctcaacgcagtggaggagactatgtgagcgtctttcgcatgcacgagcatcctagtccccgagtgtccgatcggccgcaatgtcacgccgtgctcggcgcggagctcgatgctgcggagcaggcgcatgctcgccctttcttccatccaccaccttggccgatctggccaatgccacgagggagcgcatcgcgcagcaggagcaggcctaaaatccagatcccgaagcccgtccaggtcatcgatggcctcggctgccgtcttggcagctcgcacggccagcattcgcgcctgcagccgcagatggcctgcccctgccttatccgacaatcctggccagcaagtggcccgaaaccagggctggccatttcctgtggggtccttcccagcccctgcgtgccatgtgatgaacatcccatagaggaggcgtaggcgagaaaggtggcctcgtagctctcttcgcctccatgtcggtatcgatcgctcactattgccttgaaggcggcaaggatggcgtccgtatgccctgctcgatcatgagatcgttttccgtggcggcagcgacaggcagaactcgaagtagcgcagggcccgtcgggatcacgccgagaatgtcgagtcccttgagatggtgctccttctcgtatgagcgcgccatggcggacaaggtaggccgccgattcagctgccctccgtcgacgagagattggcgaaagtacgtggctctgctacgcaccagcccttgcggcacgccgtcgatggtcacctttcgatgcccttctcggcatgaggcgagaactagggaggacccccagcatgtctgtggcatatgcagacacagcatacctctgatacgaaacccatcgatgcgtatcctttgtgcccgttgcatcggggcatgcgcaggacggtgatacgatgtttattcaatggaaagaaatcaaggggcgttcttcagggggggtcccccgcgattaagaatacggagaagcacggaggcgtctgcgactggcttggttggtggcggggaggaatttgcgccgctacttgccgtgctcgcgctggtgtggcgaaccatatacgcagatcgtgggtcggagcgatccagacgcctcgcggccgctaccgtcaagacgaccaacaccttcgagcctgaggccgaaacccatggcgacgccgtgcggggacataacgggcagccatcgtgaccatatcgcctgacgcgacgagtatccgaaacatcttcctggacataacctactcccgaactttcagacacctcccgttacataaagacccacctgggtcaacttccatggcgggaggattttcgggggctagcaagcacgacatggcgacccctggcatcgagcgatgtaatcagcgcttcttactggacgacatctgtgcggctggatacaacatcgggaatgtggactaggactagtggcccggcccgactgccgtctttcccattccgtgtatccaggcaaaccaggcatcttgctggtgtgcgtcgcatgcggacgagtatgtgccttgatatggatgatgtctatcatcagggttcgctctgccggtgccatcataacgaccaggatgggtgctgttctctctaacccggcgtatgccgcccgagctcggcagcgagctcggcactggagcgagagcgggtgaaggcttgtcgtaatcgacgatgcaccccccccgctttccgtctacgacgagttctttccgcctgggcacgcaggtccttataggcaactatttaagcgggacgatctcctcagcaaggtatcagggcatcgctatgagccaccccacaatgggtcatcctcggaatacccgccggcgggtgcttgctgtgcagcgagaccacatgatatgagggcgcatggatgcagcgctttcggaaagcggcgtcacgcacgagctcatcgaacagcccgaccgctggtccgaaacgggcctggagatgcagcgccactgctttttgggatcgatcgcaacggatgaggtcgccgggatgtcacttcgagagggggggtggtctggccttctcgccgaccggacagcggctgacaagaggcatggccgacaggcgatgagagtggcgatggactatgaaagagcaggccgccgtctggtggataagcctgcagggaagagacggtgcgggctatccgccccatcatgccgtcatataccttcggcaatgacttgctatgtaagatggcttctgaggccgggtgctggatgcggaggcatactctctgcaacctcttctggggtccggccggaaccgtgatgatggtggtggagttgggcggctggccgtctagaaatccagtgagccggcgcactatgcggtgttctttctgtcaggcaggtcattctgaggggcatatccccatcagcgggagcggggcgcttgggcctcccgttcacgagctacggtgcaaggttttactttggagacagcgattcctgtcgtcgtccgtgaaggcagcaagagtcccccttggttcctagccgcctgcgggcccggaccttacttctcctcatgtggcggatgaacattgcaagcatcgattgtgagcggattgtagatagtcccctgacgccgatgcgcggtgccctctgccgccgaggaccgattcggcaggccgcatccgttccatcccaccacatcggcaggcgttgatggcggagcaaatcgcgaagtctgcagatcggcaccgatgccgacctggaggatgtccggcccagaagcttctgttaggaatgtgttgctggatcctttggctgcgggcgtcatggggacgaagggagcgtccaggttctggggtggtgtttcgcgacatgtgcgatggatatctgggctcgaagcgggcgcagccacaggtcctcacgtagtgaaggcagctatcgcatcgattagatactggtcattgtccccctcgctccggagagccttcggcgtgaaagtctaggcgcccgggcggccacgggtcaacctgtctggttgggcgagacaggaaatatggggcaggaaagccaagggactgccgggaagactttctagactcgtgcaggggagccaggtgcagccagagctggcacgcttgccgaaaagacctatgcctcttgtcttgtttctgcagccccgtccggcgataggggcccgtcctgagagcccaaaatagttagaattataataacacttacgatgcgggctgtgatgcagtgtctggcccatcttcgggaggtgctctcatggggctggcaaagacgtatatttgtcggcaaagtctctgttagaccagaaatgacaagacatgggtcaaacgtctgccctccccgtatgatcagggtcgccagacagaaaccagcaagcgtgggaacaggatgagacactatactccatgagatgcaggagctcacgcttggcgacaagacgcaggctgaatagcggcgaccaagcgggccgtggcgagggacttggattcggtgcaggcgactgcccacggcggcgtgcccggaggtgcgggtccgccgatttcgtcgcggcaaggggcatggcaggatggctcgcagaggggctgcagggggggctttgggggggggggcggcaggaccttctccaggaaacggatggggctccttgcctcttcagctccctccggagacctggggggctgtagcgtggagaggaggctgcaggcaggagggacctcagggcatgcgcggctgttgccctggcatgtgtctccatcacagacatcctggttcagaggaatgcggatatgcgaggtgatggagaggcctgggcagcccttcaggacgggcccctccatatctggcaggggaacggcacgcaatcgaacgatccctctcagggaaccggaagagggccgccgtgacagatgccgagggcggccgtcacaggtcacggagctccgtggcatgagcgcggcatctcgaaccagaacgggtgcaatcgtgtgggcggcgcgaacagccatttgcgatgatctctcaggcttggctcgggcaggccgacgtgcggcggatcctccgctccttcattcgacggtcccgggagtgtagaccgaggcccagggttgcctgtgcctgggctcggctgcatcctctggcgtatcggaaccgctgcccttgggagggccatcgggcccaggcggccgtccatgggacctcgtggaggtgcccttgccccaggaggcaagcggatatgctccgagccaccagtcagcgggcgatacgccctcttaggctgagccatcgcgtccaatcacgctggcggtagtcgaatgagggagggagtccagctccgtcgtcggacgcccagggcccagtcctgcgaaccgagtcccgaggctgtttcgctgccgcaccacgatgcacaattctggttcgtagattgcgcgcgctcagacggagcctccgtgcctgtgcggcgccctcgggcatcttcaggcggccctcttccgtccgtttcctgagaggattcgtcgagggaggtgcgtccacctgccaggatatggaggggccccgtcctgaaggcctgcagcccttctccatcacctcgacaccgccatatccgcatcctcatgaaccaggatgttctggaggagacatggcatgcaggccgcgatgccctgaggctccctcctggcctgcaggcaatcctctccagtacagcccccatggtctccgggggagcttgaagaagggcaatgagtccccatcgttcttcctggagaaggttccttgccgcagcccctgcagagcacctctggcagcccatccctgccatgccccttggcgcacgaactcggcggactccgcacctcgggccacgccgccggggatcacgcctgcatccgaatcaagtcaccctcgccacggccgccttggtcgcctactatcagccagcctgcgcttgtcgccaagcgtgaagctccttgcatctcatggtagttatgtcatcatcatcgttccccgccttgctggtgtttcctgtctgggcgaactgccattcatcacggcggggagcagacagtatgaacgccatgtcatgtcatttctgagtctaacagagactttggccgaaatacgtctttgatgccagccctatggagctgggggcctcccgcctgaagatgggcgatacggctgtcatccagtcccgcaatcgtaagttgtatatcaaaactaatctaacattttggctctcaggagcagaggcccctatcgccggacgggtgcagaaacaagacagagtcgctagggtcttttccgggcaacgtgccagcctctgtgctgcacctggctcccactgcacgcagaagtctttcccggcagtcccttggcttcattcctgccccatcatttccgtctcggcacaccagacaggttgaccgtggctggcccgggcgcctagctttccggttcttcgcaaggctcgggagaaggagggggacatgagccgggatctatatcgactgcagatgcctgccctgtcatacgggagaccttggctgacgaccgcttcgagcagattacctgatcattgtcgaaacagccacccagaaacctggagcgccccttcgtcatgacccccgcagcccaaaggatcccgcacatcctgacagaagcttctgggcggacattcctccaggtcggcatcggtggccgacttcggcagactttcgggcgattgctttagcccttgtctcgccatcacgctgtcccgattggtggtgacacaggatatcggcctgggccgatattcgtctcggcagaggggcacgcgccagtcggcgtagtggacgtatatctaactccgctcacaatctatgctatagtcgtattttcattcctttgtgtcctcgccttcttactcatcaaacgtttcctgtctgcgcaggcggcaaggaccaacgcaagggaccggctgccttcacggacgacgacaggaagcgcttcctccgcaaaaccccttgcccgctcgtgctgtgaaggtcaaaagcgcagctcccggctgatgggctatggcccctgcgaatgcctgcctggcagaagaacatccggcatattgcgccggctctccattgattcttaaggcggcagcccgccaacttccaccaccatctatcaccggtttccaggcaggaccccagaataggttgttgatgagatgctccgcatccatccacacaccgccggccagaggctcttcatggcaagtcattggccgaaggtattgacgggcatgatggcggatgcccgccacgtctcttccttgcagggcttatccccgtcagaggcgcctgcctctttcatcatatccatcgccctcttcatcagccctgtcgcaggctctttgggctctttgtcagtccgtcggtcggcgagaaaggccagcaatcctctcgaatcatccgcgtgtcgacctcatccgtgcgctcggacccacaaggcagtgcggggtgcggccaatctcaggccctccgttcggccagcgggttcgaatgagctcgtgcgtgacgcctgcttcccgaagcgctgcaatcgcatggccctcaatcattgtgtactcgctgccaagaagcaaccgcaggcgggttaagtcgcgaggtgacccctattggtggccatcatagcgatgcgcctgatccttgctgaggaagatcgtcccgcttacatagtttcctataaggacccttgggtgcccagggagaactcgtcgtagacgagcggtgcacatcgtcgattacgacagccttcacccacacccgctctcgctccagtgcggcctcgatgccgagctcgactcggcggcatacccgggttagagataacatggcacccatctgctcggttattgattgggggcaccgcagaggaacccatggatgatagcatcatccatatcaaggcatctcgtccgcatggcgaccacaccaggaagtgtcctggtttggcctggatgaaggaatgggaaagcggcagtcgggcacgagggccgtagtcggcacaattcacgatgttgtatccagccgcacagatgtcgctcagaacgctggtggaatcgccgatgggccagcgggtcgcccatgctcttgctgcccccgaagactccatcctccgccatggaataagaccagggtgggtctcttagtccggaggtgttctggtcgggataggttatgtccaggagctgttcggatactcgatcgtgcggcgtaggcgatatcggtccacgatgcgtgcccgtttgtcccgcaacggcgtcgatgggttcgctctcaggctcgaatgtgttggtcgtcttgacggtgccggccgcgagcgtctggatcgctcgcgaccacgatctgcgtatgggtcgcccatcccccggcaccagcgcgagcacggccaagaggcggcgctattcctctcctcccgccacccacccaagcagtcgcagaccgccttagcctccgtgtcccttctctttcaatcgcggcccccgcctgaagaacgcccttgatttctttcctttccattgctagcaaaagcgtatcccagtccgccctgcgcaatgccccgatgcaacggcagcaagcgatagcgcactcgatgggttcgtatcaggaggtatgctgtgtctgtcatagccacagacatggctggggtccgccctgttctcgctcatggccgagaagggtcatccgaaaggtgaccagcgatcgagcttgccgcaagggcgggcgtaggcagagccacgtacttcgcaacttctaaggggtgggttctcgtcgaaggatgatctgatcggcgcctacgccttgtccgcgccgatggcgcgcatacgagaaggagcagccatctcaagggactcgcattctcggatcccgagttcgggctcctgtcgctacttctcgagttcgcctgtcgctgcgcacggaaaacgatcttcatatcgagcagggctatacggaaccgccatccttggtcgccttcaaaggcaaatagtgaggcgataccgacatgggaggcgaagagagctagagccacctttcttctcgcctacggctctatgggatgttcatacaatgggcacgcaaaaagggggcgggaagagaccccacaggaaatggcagcccctgttttcgggcaacttgctgcgcaggatgtcggataaggcaggggcaggccatctgggctgcaggcgggcgaatgctggccgtgcgagcttgccaagacggcagccgaggccatcgatgacctggacgggcttcggatctggatttcaggccgctcgctgctgcgcgaggcgctccctcgtggcattttggccagatcgcgtccaaggtggttgattcaagcggcgataatggtgtcctgcctcgcgtcaggcatcgagctccgcgccgtagcacggcgggcacttgggcggccgatcggatcactcgtggctacgatgctcgtgcatgcgaaagacggctcacaatcgtcctccactgcgttgagaatgtctgcagagcgttatctctgccgggtgcctttgtggccgagcccctccgtacgcccggctcccacggcgacgagtccggcagccttgtggagctggccgcatgaacgttgcggacgacgacgggtccacgccgacgcttccggcgcgaggaacgttgacgtggtcttgtgctcctccaccccccctccccgagccagcgacgatggcaaagcatatgtgggtttgccactggcagccctggtcgagaacttcatggaccctcctttccttctgcgaagcagcgtaccacgtcattgttgtaatgtcactgttttacaactctggagagatatggcctcgtttgttgtaagtgtgtcattacaatcgggcggcatggcatgtacaggctgtacgcgttaaggttacaacgttgcaacctactaaaggggcagccaccatgaagagatcgcagtcgtcgcagcaaacggcagtgcctggcacgctcatcgtgaggaggccgtggagcgcggacacgacgtgacgcggtggttcgtgcgcgaagagaaccagacggccgccgagaggccgtccataaaaggacatcacatggacatcacgggccgaggacctggcgggcttcgacgtccgtggtcgacgtccccccttcggcgcctgggcgcgccgagaacgctcgggcgggcacgtggccacgagccgcgctgtgcgacgtgctctcccggcaccgatgaaatagcgggcccaggcaatctcgtagagaaccacgagaaagacgcagcaacaagcactaagatccagggaaacgaagcgccttcgggacagacgaatatgagcgaagtacaggtggtgagcgcctgccctgcacgttcgagcacgagcaggaccctgccctcatgcttctgcagttcctcatatcctgcaggctgcctctttgcccatctgatattgggaatgaagagcacaagcaggaatgcggcaccgacgaccgagaagccaagctgcatctttgcctccatgcccctgcccatcactccctgcattgtacagtacggacgctgcggtgccgtgcaggccttacacactcagtacaaggaacgacgatgcggctctcgcaaggtgcgccagccacgggagatatgcagcactttggtcgctctatatgccacatcattcatagcagcgcatgcggccaggcaatgcattcttccgtaactccctgatgcatcatttttgctagactcgtagccaataccacaagatccagaaggagaaggcatatgggtacgaccggacgcactgcatacatcggagcaaccatcctcgatggcacgaaaggcatggaacccaaggagggcatggtcctcgtcacttctggcagcagcatcgaggcaatcgttcccgaggcggagaagagcgcctacgccggctgcgaagtccgtaatctgaaaggcctcttcctcatgcctggcctcatcaacatgcacgttcatctggcaggaaacggcaagccgcagaagaagcagcacgacaatgcagcgctggtcaataagatcatgagcaacggcctcacccgggcggtggcctatcggctcgtgcgccagtatgcgcagatcgagctcatgagcggcgtcacgacaatccgcaccgtgggcggcctcggcgacttcgacacacgctgccgtgacgagattgcatccggcaaggtgctgggtccccgcatcctcgctgccaatgagggcatctcggtgccgggaggccatatggcaggatcggtcgcaatcgctgcaggctccatcgacgaagcgctcgcacaggtcgagcactgcagggagcagcgctgcgacctcatcaagcttatgatcacaggcggcgtgctcgatggcacgcgcaaaggagaggcaggccttctccgcatggatcctgccatgataaaggccgcctgcaatcgcgcccacgagcttggctacaaggttgccgcccacgtcgaaggcgtagaggggctcagggccgctctcgagaacggtgtcgactccatagagcatggcgccaagcccgatgccaccatcatggagctcttccagaccaccggagcctccctctgcacgacgctctcccctgctcttccctatgcgcttttcggccgctccatctcccatacatccgagatagagcagtacaacggcaacatggtcttcgagggaatcatcgcctgctccaaggccgcactcgaagcgggtgtaccggtcgctctcggaaacgacgtgggctgcccctggatcacgcaatacgatttctggcgcgagctcgtctatttctgcagatacgtgggcgtaacccccgcattctccctgtacagtgccacactcggcaatgcccagatagcaggaatcgatgatgtgacgggatcgctcgagcccggcaagcatgcagacatgatcgtgaccgacgccaaccccctcgacgacctcaccaccctgcgcaatgtcaggcacgtggtgcgcgatggggtcttcatcgcagagcctcacgtaaagcgcaagccggaagtcgaccgcgagcttgacaagttcctgtagggcatgtgtcttcctctcccctggcctcatatgtagatcggggtgtcttcgaagcagcccggcaaaggcatccagagcatgatgcctttcatcttcctcacacgtccttcaggaccgtccgccctccagttcatggagatgctccagatggatgccgatatagccgatagcaaggatgatggcagagagatcgctgccaggggcgacccgtgccatactcccagaaggatgaaggctgcaaccggcaggctcgccatgggcacagggataggtccttagggctgatacatcccatcgagcttccctacgcccctgaaatagcgaacccaggcgatttcatagaggaccatgaggagggatgcagcagcaagcgtgagggtccaggaaaacgaagccccctcgggacagacgaatgagagcgaggtacaggtggcgagcacctgtcccacacatgagagcacaagcagagccttgctctcatgcttctgcagctcctcaaagcctgaaagccggctccttgcccatctggcattggaggcaaagagcacaggcaggaaagcggcaccggcgaccgagaagccaagctgcatcactgcctctatcttgatgcacccgcatttcctgcatgatacggtacggatggcaccacaccatgcaagcagcttctcatccggtcctgaaggcatgcaggcgacatggtcttgcacgctgcatcggcctcgcgcaggcatatcatctgcccatccccacggcctctcgagcagagcagagtctaatctttctgcacagcaccccaccagatgatttcggtgcgatatctgtgaaccatgccgaaacgcttgccggcccaataacaacagcctctgagcaagaggcgatagcaatgaccgaagagggatactgccccacaacgcaatgcaacgaccaactacatggcaccagctgtatgagaaggtctcagcactgcatctttcggatactctggagcttccactgggcttccgggctggcaatcgccgcacgggtgatcgggccatccccgaacagcaatgacggatcgaattcccctcgctcaaaccgtatgagatactcacgctccccatctgtcttgggcagcacgtagccagagacaaactcgtgcgcagctgcaatcagcccttcaatagtaggcacctcttcatctctcctgagcatgggcaggagctgttcctcgagttcgcgcgacctgtcagcgaatcgctcggggcgattctcgaaaccgcgaggaaacgtcgccgaaagcgatgcatagaacaagattatactttgtgggctgtagcgcgttcttccatgctccttccatcaagcacacgtctgagattcgctacgtcgtagaggtctcgagccttcacgcgatcgaagaatgccttggcctttcctccggcaagcttcgcatccgagaagacggaaacggcgagctccggtcttagcggggatattctgtgctcgaccaatatcaatggagagcggttcatgtagatgcaatctatcttgatgtggtctgcaccccaccgcgacctgtagttcaatacaaacgtcctgccagcatggccacctttcgccccggagacagcatatccctgggaacgagccacctcgtctatcgacctctcgactatcggcctgtcggcgagcatggcattcctgtcgagcgctccaacatacgagaggtcgatgtcgacggaaagcctcagcacatcgagcatgaacaggttgatggcagttcctccgtggagtgcgaatttgcctgccagcaatggatgctcgtcaagctcggtgagcggatcgaggagcctctcaaccttgtcaagcgtgcgcggcggaaactcccttacaagtgcgttatccacgattgcacctcttccttgcttccgggcaggacgagccgccatctggcaacccagcttaccgatttaacgcccgcaggccccagacggtaagggcctggccccagccattcctcaagcagagaaagactctcttcgttcacatgccattcagcctgtttctcggacagcagccatccaacgcgggacaccatagaaggccctgcatcgatggccagcccaaccagctcctccacgttgagatatataaaggcgctcaggcttcgcactgcctcctcgattcctcctgccaaggcaggcttccccaggcagtccacgaccgtctgctccctggttgtggcaagatacgcacctgcaggtgatctcatggttttcgaccttgcgttttccaccggcccgcaggagcggtatgtgatgcctcggaagtcgaattcagagtgcacgatatctgagcggaagcgacatacgaagcccacattatgtgcgacgccgtgcgcttcaagagccgagtggtacgagatgactgcaccggcatcgagcgcagtgacgacttccgtctgttctacggagacatcctcgaaccggccatgattggagacgaggagaccacgacgcgcacgctccacggcacccgatctcacggcgaggcgcagctgctcctcggccgatgtcggagagtccatcgcctcgaagagtgaggatgtggtgaacacatggtggctatttacgtagtcagtaaacttcatactgcaaattttatcatgtaaccccaattttttattggggtttccatatatgtatagcagcatatcgtgcagcaacaccgtgaaagcgagaacgctttgaaagtcagcggttcaacttctttcgaagggccacaggaatccaacgagagtctatagcacgcacagtactcaatgcgaaatggacgccgtcttcacgggaaactccaaggggcagaaagtgggctgcgacaatcggatagcctgaacgctcattcagtccatcgctccgagagattagttactccactcgatcgctgcaggcagcttcgggatgatgtcgcaggcaaagcggcacacaccgacagagcggatgccgagaagagcggcgacacctacctcattatggacggcagccaaccacagcgcccttgtctcaatccagctatccccattagcactttggccagctgacaaccgcctcgacccattcgacgagctgctcaaaggaggttgtcccgctagcgattccaagcatttcagtgaggaactcgtcatgtcgcggcttgaactcatagccagcaagcctaagacaggtaccaagcagcgcagcgcccgttcgcttgttgccatccacaaagggatggtcgctgatgatgccgtagcagagcctgcatgcttttgccacatcgctgccatagagctcgattcccccgaacgtctgatggggccgagcaagtgcagactccagcattccttcgtcgcgcacgccgtcgacgccaccgaacttctctattgcagcagaatggatagcaaggacctagctcttccctatcgtcacaggcccactcatttggcaagccctgagaagacgtcggcatactcatccatgaagtcgaccgcaacatcgagcgcatcgtctgtcgctgtagacgcaagctggatgattacccacggcttgttgttcttgagcaccgttacaaggcggcctgtacggtttacctcagccgtaaccttcgaaaaattgggctcttcggtagtttgtgtgggtagcccgccatggctttgcgcaactcgcatgcagaaaacacgcagtctcaagacgaacggccccgcgaggggcctccccgcaccgttttcccaaaggatttcacttcgtcaaatgcatccgatccgaagggaggaccgcgcatgggaacgattctgcactacgtcctgtcgcttgtgaagactgtcgtggtgggggccgcgataagggggactcgatagtcgtgcgggtgaggccgcacaggcgcgagcagctgcgctgtccggtgtgcgggcaccgctgcagctgccacgaccacgtgccggtgaggcggtggagggcgatggagctcgcctcctcgaggtgctaccttaagtagcgccccgcacgcgtgagctgccccgagcacgcagtgctcgtcgagcgcgtgccgtggggcaagggcggcatcgaggttcacccgcgactttaaggactgggtggcgtgccttgctgttcacagcccgctctcatggactgcaaggctggccaggatcgagtggaagagcgtgggcggcatctgcaggcgggtgtaggaggagatcgaggctgcacgcggacagggccacatcgacggcctgaggcgcaaaggcataagacgagacgagctacaagaagggccacagatacctcacggccgttgtcgaccatgatctgggatgcctcgtctgggcacacgagggatacggcaaggaggtgctgtcgcttttcctggacgggctcacacgcgagcagaaaagctcgatcgaggtcgtcacggcagacgcagcgaagtggatagaagagctggtcaggaagcgctgccccaatgcaagatgggtcatggaccccttccatgtggtcgaatggataaacgatgcgctcgaccaggtgaggcgcgacgaatggcaggcagcgcgccaggcagacaggcaggcgagggccgcaaaggcccagggcgcggcacgtgccagggagctcagggagcgtgcgcgcagcctctcggcggaggcctttcgcatcaaggggagcagctatgcgctcgcgaagaacccctaaggacctgagcgcgcggcagagggagcggctcttagagctgaagcgcgcagagggccatcttgcacgtgcatggacgctcaaggaggatcttgaaggccatcttccgcgcaaaggatgcgcatgaggcacaagggctgcacgacagctggctgaaggccaccgcatactgcaggatcgcgcccatcgtcgcagtcgagaagaaggtgaggcgcaggcgtgccgacgtgatagccgccgtgaatctcggaaccggcaacgggtgcgtcgagagcatcaacaacaagatcaaggtgggtgtgcggatgagctatggcttcaggaacatcgacagcctggtatcactgctcatgctgcgctgctccgacgagcagcctgccatgccctgggaggaccggaaggaggagaagcgaaagagggacgagcgcaagcggaaggaccgggaacgcgacaggaagaggaggaaggggcgcgccgcctctgccgcctagccttcagccacagcaatcaacgaaggctctaaattaatgacagaagatacagctggctgggcgcatgcaaatctctatcgcagtacttgtccatttgccttaagcactgactgcatgacttctcccacattcttgctcgcaagttctgccttaaagctgtcctgtatcacatgaagatccttatcaagtgcctcatggatatggccaccgaccgggcatttgggattcgggttctcatggaagcggaacagtttatcagcactattagtttctaccgcgttgtagacgtcgaggaatgttatctgagagagcgggcgtgtcagggtaatcccgcctgggccacgcttaacttcaatgaggccagcatggcgaagctgattcatgatgttacggacaataaccgggttcgatccgatactgcctgccaagaactggctggtaacccttcgcgtcttcctgaaatactctgtggccaccaatagatggatcgcaatggtgaactttgtcgatacttgcatgagcacctctcctatttttgctctatcacgtgggtgaaacagatgctgaaacaatttccacagtagagacagtgttcctgctcgaccacatatagaacgctcccatgatcaatgcactcctgtgggcataccggcagacaggcgtcagtgataacaaaacctcccgcaggttttggttcagatgcatcgacaagcgtgaattcctctctcgttatcaacttcgtcgacaggtcaaagaactcccttttaccatcactcatcttgaagacccgcaaagcttcccgggactgctcattcggatagaccttcaccatatacagattctcagcaaagatctcatccaatttctcagttccgatattttcgacgtagccacccagcgagattgcctgcatacgcattgacgcctctctacggctcatgccttctccaccgcacatgccggtcattgcgatgtagtgggtatccatcagctgccgatagaatcccctgcccttcgccatgagaaattagagcgtctccccatcagtgaacatcatatcgatcgcacgcgttgccggatgtcccccgttgccggctgtagccacgacaaccacatggatatcatgcaccaatgtgataaagctatgatgtaatgatatactttatatcatagtgaagcagcacactgtcatatcaaaaatgcagatattcttgtgttttgttgcatcattcgtcgagcatggaacgttacatgctgcttcatgctgtcctatacaagcgtaccgatggcgcttacttggtgaggatacccacgtcgttgtctttgcacagctcacggaactccgcggagatcccttcagttgtcacaacagtgtcgatcgcgtcaaggttgcagacagagaaggtggaacgtctgcctattttggttgggtccatcaggacaaccacctgttcggcactttggatgcaggtcctcttgaggcttgcctcctcgtcactcccacaggtaaatcctgcttctgcggagaaagcagtggctccgataaaagcgatatcgaaggagagcccctcgatctccttactggttctgctgccataggtactcagggaaaaacggttgagcctgccaccgaggatgatcggctgtgccacctcaagccgggccaattcattggcgcaggagatactggttgtaaagataaaggagcggacatcgggtaatgccgcagccaacatagttgtcgtactgcctgagtcaaggaagatcgtactgttagggcgtacaagctttgcggctgctgtcgcaatctgacgcttagcgtcaacatttctcgtttttcgggctccaagtaaatcatcagtccccaccacgaactcaacggaacgagcgccgccgtgaacacggatgatccggtgctcctggtccagtgctttcagatcggtccgcagtgtcatctcagacacatcagggaaggccgccttcagctgagcgaatgagatattcccctcttgattgataaactcaacaattgcatttctccgctctttcacactgagtccctttcccctcttcagacccccatgctagcaaaagaggcgcgacgtgctttgcagcgccgcgcctccttcatattcatacaaacatgttagttaccgagggctatctagcctctacgtcaggccaattcttcagaacgtagcgctctgcttcgggattccacaggccattgttcttgtcgacaatgtctgccagatcgccgtagcgcttatcctttgcagccatcttgcgcaggtcagccagagcaaccagtggcatctccttgtgggtgtagatgagcttcttaccacccgggatgttcggcaagttgcaggtcgtctcgccggcaacgttcaggccaccgatgtgggtgatcatgacagccgggttcatacggccctcttcggtcatgcgcagggactcgatcatatcggaggtgttaccgccggtggtgcccattacgtggtgggagccatagtggacctcgtagaagttgatcggcgcggagaacttcttatcggtcgggccggagaagaagttcaggcaaccgtcgcgaccgagcagtgcatcggacagggtgacgaccgaggcaaccggtgcgtagcacaggacatcgtcgaagcccttatcgtccttggtcagggcacggatacccttgatctgtgcatcgagatcaccgaacttgccgttgttcacaaagtgtagctcaacgccggtctccttcttgacttgctcaggcgggaagagtgactccgcgcggtcgagacggtcctggttgatgtcagcgacgacgagcatgcccggtcttctgccgcggtgaatcgcgtaggtcaggcagcctaagcccatcgggcctgcgcctgcgacgattgccatgttgccgccctctttaatgcccatatcgtggacatagacacccatgtgggtgtgataggcagcgttcagcgcgccgattgagcaactcagcggctctgccagagaggcctgaaagtaagcctcgccgttgtagaccaggaaactgttggtatcaaagatctcgtgaggaaggatgcagtaggttgagtcaccgccgcagaactcataggagtacccgggggaatccatagagcccttgtagttgatagccggctgaatcgtgaacttctggcctggcttgtacttatccttatatttagcgccgacctctacgatgtcgcccgcaaactcatggccggtgattgccggatgctcagcgacgtctgcgtggacgcgcttgtggttgacaccgagcttcgccatcttataggtggacatgcagatggtgtcggataccacgcgtaccagcatctcatcatccttgataggaggaagctcaaactcgtcgagtctcaggtccattgccgcatgaagtctcactgctcttgatttcacggtattctcctttcgcctttgtggacgccctctttgagcgtccagactatccaaccattcaaacacttttatttcaaaactaattttagagtaattgttgttttaaaactgtcaagaggaaagtcaaagattgtttagtaacgccatataacagtgtggtcattttatggaatattgcaggtaaaacgcttagctttaccgttgattttacgcttaccgccgacttgctaccgctcacctgagattgttgctttgataactatactgttgaaccaaaagtttacattgttgttagcaaagattttataggcgtgcgtgttctttagaaaggggtatgaatggctaaggcaaaagaaggcgtacagcgctttggtaaattcctctccggaatggttatgccaaacattggcgcatttatcgcgtggggcttcctcaccgcaatattcacaacaggaggctggttccccaacgaacagttggcaaccatcatctccccgatgctgaagttcttaattcctattatgatcgcgggacagggtggctatatggtcgccgggaaccgcggccgcgtgatcggcatgatctccatcgtcggcgctatcgtcgcttccgactacacgatgctgatgggcgccatgatcatgggaccgcttgccggctggatcatcaagaagtgggatagatgggcaaagacctggacccccaccggccttgagatgctcgtcgacaacttctcgatcggcctcatcggcctcgcactcgttatcttcagttactacgctgtcggccccctcatgggcgcgatcctcgtgctcctgaccgctggcacccaagtcctcgttaacaatggcctcctgccgttcctcgccttcttcatagagccggcaaaggtcctcttcctcaacaatgcaatcggcaacggtatcttcgttcctatcgcgactgaacaagcgctgaccaccggtaagtccatcatgttcatgctcgagtccaacccaggacctggccttggcctgcttttggcctatgctttcttctgcaaggatgacgacaccagacagtccgccccgggcgctatcatcgtccagtttatcggcggcattcacgagatctacttcccctatgtcctcatgaacccgagggtcatcatcggccccatgctcggcaacttcgccgcaatcctttggtacgtcgctacgggcactggcctggttggccccgcatcgccgggttccatcatcggcttcctgagcatggcaccgggcggagcgatcgtccaggtactcgtcggagtcggccttgcggcagtcatctcttttgccgtgtcctccccgatcgtgcgtgcctctgacgtcagcatcaacgatcagtcaagctctgaggaatccgctgaggcagtcgcagcaacactggttgctgacaaaaccgcaatcactgcaggctccgtcgccaaggtcgtcttcgcctgcgacgcaggcatgggctcctccgcaatggcagcaagccgcttcatgaagcgtatctccaacgtgcgtcccgacatcaaagtcactcactcctccgtggacgagatcccgagtgacgcagacgtcgtcgtgtgccagaagaccctagcagagcgcgctcacaagagcgctccttcaaccgcccagatcgtcgtcatcaacaacttcatgaacgaccctgcaatcaatgctctccaaacccagctcaccacatctgctaccactcagaaagctgctgtcgctgctaccaatgccgccagcaaggcaactgagcagacaccaaagcctgtcaacgacgtcatgaccgcaaacgatgtcaggcttggcctcccctctgtctcccgagaagaagcaatccgtcaggccggccgcatgctcgtggacgccggatgcgtcgacgaaggttacattgacgcaatggtcgagcgcgacaaggaagtcagcgtctacctcgataacggaatcgctatcccccacggcaccaacgcttccaagaagttcgtgaaaaagaccggcgtcgtagccctgcagtaccccgatggcatcgacttcgacggcaacaaagcctacgccctcttcggtattgccggcaagggtgacgagcacctggaggtcctggcaaagatcgccggagctctggatgacaaggcagccgcagacaaactgcgcacctcgaagtctgtcgatgacttcctgaaagtcttaagttagccatccgcttcatacggagcaccacgccgcagtacccccgcacttcacacagcgtgggggtactgcttcgttataccgatgtagggaaaccatacaggctagccagaacaaacagagagactctataggccccgattgcaaccagcatctgataaataccaagtgactctatcgagcttctgagaagcgccgggggtgtagcatggcactaccatatttgtatgaaagaaggtctcccctatggaggatccatataaccgctgcgactggggagcaaagacgcccctcacaatgaaataccacgacgagcgctggtgtaagcccgtgcacgaggaacaggagctcttcgcgatgctctcgcttgagatcatgtcctcaggcctctcctggtccctgatcctcgacaaagaaaccggcatgcggcaggctttcgatcagttcaaccccgaagtcgtagctacctacgatcaacctaagatcgatgagctactcaagaatccctccatcatcagaaataccatgaaggtcaacgctatcgtacaaaacgcacaggcgttcttagcgatcgtacaagagatcggcagtttcgatgcttatatctggtccttctcagattatcagcctatagtgcaccatgctacgaagttcaaagacataccagcacaaagcaaactctccgaaacgatctccaaggacttcaagaaacgtggattcaggtttgtaggccccgttattgtttattcatacctgcagtccatcgggatctataacgaccacttagagggctgtccctggaaatacacccatggtcagagcagaaagtaatgcacaatacatcgctaatagagtcttaacctttgcacatctccaccatagtttgtcttaccacaggtcacacaaggttactgtgtctctatgttgcactgatatgggttaaaaaagggctcttcgctacttatggtgggtagcatatctgcatccccttgagggcgtggcctttaaacgataggatttccggaaaggaaagacttcggtccaaagatgcgatatggatgcttaaggcagggatgctggcaaggctctttaagagatcccttgggactcagcgacgaatgggagctctgcgatgtctggtttaaggagcgcgagggagcgcaagataagctccatgtgagggtggcccacaggaagggccaggcagtcgagtgtcccgtctgtcacaggaggtgcggcacctgtgacacgcgcgagaggaccttgtggcatcttagcatctggcaatacgagaccatcgtgcactgcgcgctgcccagggccgactgccccaaagacggcgtgcatgccgtgaagatgccctgaaaggtgcggccgaaggcgcacttcacagcgctcttcgaggcgcaggtgatcgtgatggcgctctcgggaatgaccgtgacggcgatagcgcatctggtgcacgagacagcccacgcgcatatggaggctgctgggcaaggccgtcgacgaggcaagggatgccgccgactactcggatgtcgtgcgcgtgagcatagacgacaccgccaaaaggcgcaaccaaagctacatcagcatcatggccaacctcgactgtcagcgtgccgtggccgtcacgcagggcagagacagggggcttaggcaggctctgcgccgagcttaaggagtacggcggggaccgcacgaaggtcttagaggttacgcgcgacatggcttaaggcgtactcgcgggcggcgcagatgccccaggccgcacagagcgtggacggcttccatgtggtgcagctcctgaacgtgaggtgcgcagagaggcgcgagtccgccgagaagcacaaggcagcttgcccagacgaaatacatatggctcaagaagagggaggagctcgaccctgcgaagacccatctcagaactgcaagggcctgccagatgggagaggcgctgcaggacgtctattcatgcgccgacagaaaatcggccgcagaggccctagagcgcctctgctcgtggatgatgcactctgccgtggccgagatgaaggccgtggcaagaacgctccgcaaggagcgggaggggatcttgaactggtggaagagaggatccaccaactcgttcctggaaggtctcaactccgtcgtccagtccgcccgcagcgccgccaggggcttcaggagcatcgcttacttcaagacgatgatcttgcttaggctaggccgtctggacttcacggcccagaagaagctggcatgcgctacccactagaaacagcgaagagccttaaaatagactatcgattatacagagatggaatatctatccatcagatctgaggtggaccctgaactctgcacaactctaagcaacgagcgcagaagccacctggggcaaattacaaggcgggtgcagacaccacgcgtcaacgaactgctgcaatgacgcccgagagggccctatggacttccggtgtgggggacgcacacgggttttcgatagcgcactcgtgagcttttggaaacccaccgctccggccactggaccgggagaccgaacctcgctggacgttcaatagcacggctcgagttgagcctcgaccagcccgagccttgccacattgttggaaggctttgggcattgcccaggttgaagatctcaaaaaggttctcagaagccgtagcgcaccgggaacgaaaagcaccgccctttctcacggcgggacggcactcgtgcgttataggcctagcagctgtttcttcttggcatcgaactcttcctgggtgatgataccgtcgtcgagaaggcccttgaacttacggatctcatcggcagcatccacagtggccgatccaaggttctcttgctgttggtgaaccttggatttattttcctcaatgataagctcaaactttgacgctagcttttgcgcaatctccatgttcgatcgataaatgattccatctttttttgtgccagtgctaatcagcttgatgaagaacgcggggtctttataacctttcacggttacctttacctgaagactgtcacagacctctttctgcttccttgtcgaggcgcctacaatggcaccggctccgccaaagagaatcccgcctacagcggctcgtccaattccgcccttcgcaatcgacaagccgttctctagaatttcgtaatcaacgatctgcgaataagagaacttcgtgtagtgcttggcttttgagttgatataagctgagttcgagaggagagcgacttcctcatcgtcattaaacttaccgatatctccaatattgtccgtcggcttgaaattctcgatgtatgctgtctcctcgtcgcgttggctcagatactgctggaattcttctaacgtcatctgcgcggggatcatcttcatatcatctagggtaacgcccatcttcttgaagcattttttgcaaacgaccccatctttaagctgaagcttccttgacatcacgccaatttcagcaccgcagaccatacatgtcttcttcgccatttaaggcccatcctctctcgctcctgtaacgtgcctgccggtatacagcagacacacctctttccaccgagacgattatcctcttgtctgctatcacgagaggagaaatcttgatcctgttagaccactgtagatatagggaaacgaaaagatgtcacggggtcaccctacaatcgggttcgactaagaaaccgacctgaagaaggccctgtatgctcgacatgatacgacaactagcaaagtagctgacctgcaaggagaaggtcgcacttaccgccggcctcaagcagatgatagccgagaagctaacattgcaggccgacaagtccgccacatgcctgcagctcaccaggcacgggtgctcgctcacagcagggacaggcaagctgctcgtgcagtcgaagttagcagcatcccagtggatggagcttacccagtgcctagctggcaggctcacacagcacaggtgtgtgaagagatgcggcgcgtgagtgcacagcgtctggttcatgcgccagcgcgcatgtgaggcgatagcgttaaggcttaagttgttgtacgccgtcggcaaacacttcgcaaagagcctagccagccacgatggggcaggctcattcgagatggtgttccctcaagcagcgcagtgcccacaacatctgtgtgcgggggctctctaacctacagctctgcgttgtctacggcgtagacaagctcggcgcgacggtaagggccaatatgcaagcggcctgggcgacctcggcgcagtgcacgtcacaggtcaactccatgcacttgcggcttaagcacttcatggatcgcatccgcaaggtctcgaccaagcatctctaacactacccagaagtggttctgctacaaggagcagttccgaagatcgaacggctataagcgcgagcagatctacaggcacgagtgagacggtatctaccacaccacccagagaggctacgtgggtatgccaattgcgttccctaagtactgggagcagacgacatgacctcatatccacagtggtctaacagagtcacatcttttagtatagagagcaaagcctaaaggagcagtgcaatgcaatacacctgtgctatctaccaatccccgatcggtgccctcacactctgtgacaatggagccggcctctgtggcctctggctcgagggacaacgatactttggtatgcccatcgccaaaggtaccgagctgaatacctatggaaccacaccgaccctgaagaaggcttgtacctggcttgatgagtattttgccggtaaggctccttcccctaccgaccttcctcttgcaccggagggcagcgactttcaaaaggctgtatggaaagaactgctcgctatcccctatggggaaacgacaacgtacggaacagtcgcaaagagccttgcagtaaaaacaggcagacgagtggcaagcattgccgtagggggtgccgtaggccataaccccatcagcgtcattgtcccttgccaccgagtagtgggagcaaacggcagcctcaccggctatgccggtggactcgaccgtaagatttggctcctaaagcacgagcatgtcgatatgacccatctcttcaggcctaagacggggactgcgctatgaacagacagatgcggcatgatgtacagacacaaaaacaaggtattcggcctctcaaaggaagacttctaccaggcattcaaagcaaaagattcgcgctttgacgtccaagtttttatcggcgtctcatccaccggaatgtgtagcagaccggtactcccatatgccaagattgcgaattacactttcttcgctactaccacagaagcagaaaaagctctccgctacttatggtgggtagcactcttgcatccccttgagcacgtggcgcctagatggcagcaggattttggcgacagaaggcttcggtccaaaggcacaagatggatgcttaaggcaggtatgctggcaaggctctttaagagatcccatggggggcgaggacgaatgggagatcttcgatgtctggtttgggaagcgcaaatgagtgtaggacatcctccatgtgagggtggtgcatatgaaaggccaagcagtgaactaccacaggtgttgtggattggcaatgtccagctagacggaatagacggaatcgggagggacttttccctgaattcgacctggctcatctaacttagctttaagtgtatccgctcgtagctgtaccaccacctgatcactgagcttggcctgcagctcatagaggccctcaaagcgcttacggtgggcgaactcggctttctgtatcttgttggtagactcgacgatagcgttgtcgcaggggcagcccttcgtgcacctcgaccgcatgatcccgaggagctcgcctatcgccgcactatcgaacttagggaaacgatgattaatgccccataacgtgtcagaggggaccggccacacgatttttcacggccggtatgcgggaaaggcagggaaggatgctcatccagcacgtgcaggagccgctatcctgaccatctgtcctgccccatgcaccgcaataaggctccaagacggatcaagcgactctgggagccgggaggtgcagcctgccggcaaaagatgcacatgggtaaggtttgcaagggcgaaggagacattgagcatacaggaggtcttctctatcccccctgtagcgtgtccttaaggggcagaagcggcgcttcacaatgaggaagggatgcttctgcctttgagcgaacggaggccttcctggactcgatacccttttcggctgagagtgcacagttaaggccctttatggtcgaaggcttccttagcaatgcttgagcgcatagatgagaggtgtgggtctgctgtgaccttaagggcgcttcgctataccggtatagccggaatctgcatagcagaacctatcatcttcccttaacgagtgcatgtgcctgagatatgtcagatacattctaagcgatcgtctccacaccatgcacaaggccacctgcggcatccacgccgatatgcgccttgtatccgaaatgccagttcttccctttcttggactggtacgcttcggggtcgcgtgcgtggtccttgttctttgtggagctcggagcctcgatgaaggtggcgtccacaatggagccgccccgcaccgtgatccctgccttttcgagctctaagttcaggtcgtgaagcatagctttaccgagtccctgccgctcgaggctatggcggaatttcgcaagtgtcgtcgcatctggcacctgctcagacatgaggtctaagtgcatgaagcgctgataggaccgacaatccaggatagcatctttaagttccctcgtcttaagagcccaaacatgacctgcaacagatacatcctaagcatcgtctccgcaccgcgcacatgcctgccacgcgcctgagaatggtagctgggttctaccagtgcaatccagctatcccatggcacgatcgcatccatccgctccaggtgtgcctctcgccgagtctttctcctaaggccttaggatttaaggtcttaaaagctcatctggctgcccatatcttttttggatatgctggaatacgttgctgtaattataacatatccgcaggcagataagcatttatgtggatatgggcactgcgtggttcgagacattttgagccgatggcatacagcgtgtggccccagctacctcatcgaggcgaattaatcatcgtttccctagctctgtgacgttcagcctcttattaccgttcagcccttattacaaatatggggcatatatactccagggagtcctctccgacacatatcatgaaccatgggcgcataattcgctaacggtaaaagaaggcagggtccgtggacaaacctgtattctcggaccctacagtgacggtcgctatgatccgatcggcatcagtcgtatcccctatgcttggtcaaactgctcgagattctcaccacgccaatagaggtggttggcgatagcgaaaaggtttgacttcagaccggttggcgattcacgctcctcagcggacagcgtgtaatcagacaggaatgcccaaccacaaccggttttttcaatgctgcacttcttcagggaatccggctcctcgaagtttgagaaacctgcggtagccacctcattgaatcttaactcaatctccggccagttgccgctcttgtcttgggggccgaatctcagcttcagagagaactcatctgtgtcggtgtagtagtgtccctctaaagccgtctctaccttgtccgcgcgagcaagagggtcatagtgcatatcgatcacataccagttgtgaaatcctcccatgcgcttaatgaactgttttgcctctgcatcatctgttatctcattccatgccatgtttaaaacctttctgtctgattagttctctgatccttaaaataactatctagtactttgtatcgttatatttctctatagtaggacttttaagaatgatacagagtatcaattaataagtaattccgatttaatccctaaacctctgggatattcctcttatcgttcactgattctctataagtactctgttttaatttatataatccccttgctgagtttcttacagcccagaatcgagctttcagtactgtaacctcatataggagagctcgtagtctcatgcagtcgatcgcaacgaatcgttaatgccaaactataaaagaaagtatcgccaccattgcgtggcattcatgttaagccatcaaacagtgagacgacgcctcgtatggcatagaactttttacagtacaagatctcttattcgataactgcacgcacggtattcggaaactctgccacataccccgccggctcaggtacatacaacagtccataacttaccgatatattccaatccgtgggtaccgtccacaggagtgggtgtacctctcgccatattggcaatgtcaccaatgccagctcctcattagcagcacggttaaagatttctgcacgatactgcaggagatcaaccagcttgatatcgggatagtcacggtgtatacggtcacacagtacatcgatatcgccatcccatccacgccggaccagcatcaaggagtgcctgcgcaaatcatctaaggtcacagcgtcgagtgaagccagctctccgtcgattgagaccgcgcaacgcagcggttcgcggcagagttccagccccgcacaggaatgctctgcgagaaaattgttgtcgaagacgcccacaatcacatccatgtcaaacacgagatccgcaagcccacgggctactcttgcccattctcgaaggtcactacctgcagactcatccccggacattgtttcttgatcttgggccacaacctggctaacagtgtcgacggcgtcatgaacgacaccctaacccgcacgatccgcttctcctcatgctgcgccatacgggcgcgagctactgactcatgggagtactacacgatatgcttagcatccttcagcaggctctcccattacagtgagagatagtccctagggaaacgatgattaattcgcctcgatgaggccagtggagccgcacgctgtatgccgccggctcaaaatgtctcgaaccacgcagtgcccatacccacataaatgcctatctgtcttctggatatggtatagctacatccacgtattcctacatatccaaaaggaagatatggacagatagatgagctttcaagaccttaaatcctaaggtctgaggagaaagaccagacgagaggcattcctggagcagatggatgcgatcgttgtgtgggatagctggattgcactggtagataccagctaccactgacaggctcttgtcaggcatgtgcgcgctgcaaagacaaagctttaggatgtatcctgctttaggtcatgtttgctctcttaagacgagggaatttaaagatgctatcctggattgtcggccctatcagcgcttcatgcacttagacctcatgtctgagcaggtgccagatgcaacgacacttgcgaagaggcgccatagcctcgagcggcagggactcggcaaagctatgcttcacgacctgaattcggagctcgagaaggcagggatcacggcgcggggtggctccattgtggatgtgaccttcacctgggctctaaagcttcacgaagaacaaagaccacacacgcgacccttaaagcgcaccagtccaagaaagggggggcctggcgtatcggatacaaggcgcatatcggcgtggatgccgcaggtggccttgtgcatggtatggagacgatcgcttagaatgtatccgacatatcctgtggcacacgcactcgtaagggagtatgacaggttctgctgcgcagactttaggctatataggtatagcgaagcgcccttaaggacgcataaagacccacacctctcatctatgcgctaaagcgttgctaagaaagccttcgactagagagggccttgcctgtgcgctcttgtccgagaagggtatcgagtccaggaaggcatctatccgctcaaaggcagaagcacccttccttatcgtgaagcggcgcttcggccccttaaggaagcgctacagaaggatagagaagatgcctgcacactcaagtctttctcgcccgtacaaaccttacccatgcgcatcttttgccggcaggctgcacctcccggctctcagcgtcgcttgatccatcttggagccttattgcggtgcatggggcaggacaaatgccaggatagcggctcctgcacgtgctggatgagcatccttccctgcctttcccgcattccggcctagaaaagtcgtgtggtcggtcctctctggcacgtcatggggcattaatcatcgtttccctagagtagttcatcggctcccagcatctccatcgaagaccttgtgggggcgacagacaagggggtagcttaagtgcaggatgcgcttctacttgcatctgtcgcatctgatagcagacaagcttagatacctgtagatcgacaatgggggcgccggcctcatcttccagattgtctcgataagctataagaggggctcgacggtgcgtcggtaagcgtggggatagcatgtgggccgacgtcttcggcaatgcgcctatagccttagctatagccgacaggctatactaccgctgccatctcatacgcatcacgggaagctcctacaggatcaaggacctgcctgcaactagcctctctcaaaggagggcgcaggcaccgattctggctgattccattgccccggctggtgcagatatattgcccaaatcggtaagtctggggttgactttagcaatcgaggacgactacctgtctttcatggtggggagtgacctacctgaaggccagggccgaccacaggatctgcccgatggggcttgacagggacgcgatgaaggagctcatagggcttaggcttaaggagtgaaagccacacgagacctggaagaggttcctctcctcgctgcacgcctgtgggcagtcgggcatgagcatgtttaccttagatgcccacgaggaggctcgcaggcgacacataggtgcaccaggacctcgaaggctcaacgccgaggtgaagcgcgcccagaagctcatcgctatattcccgagcgaggacttactcatcaggctcgtggggacctaccttatcgaggagaacgacagatgggcagcaaagagcaagcagtacttgcctgtcgacggtcgaggagctatgggaggaggaaggagatgctcgcaaagatagcccgcacgcagcggcagatgaggcttgattcgtgatggcttgcaggtagcggttgcttatgggctaatttacacacaaatttggacttgactgcatcgagagccgctaccatctcccgatcctcatcaccgagaatgacatgggcgcccgagaggaggcagacgctgacggcgtggtccacgaccagtaccgcatcgactacctcgaggcccacatgcgccagacagagcttgccgtggcagacggcgtcaacctcatcagctactgcccctgggccttcgccgatctcgtgagcacgcacaacggttctgccaagcgctatggctttatccgtgtcgaccaggacgataccgacaccagcacctatgcccacacgcccaaggactccttctggtggtatacacactccatcgagacaaacggtaaggcgctccacgaagcataaagagtcacatcttcagactgacacgctagcccagcaatgtacccggcaggacttctgctcttcctgcgattgcctgaagcctgcagccgcatcatatcttcggttctgcgtgctgaatattatttttacgtactatatagtacgtgttatatcaccggagattggagggctgacatgttcgttgcgcgcgaaagagagcttgcatcgcttgagcagatgtaccgcaaggacagtttccagatggccatcatctatggcagacgacgcgtaggcaagactgcactcatcgacaggttcatcgaggacaagccggcactctacttcactgcacagcagaggacgatacgacagaatcttgagctcttcagtacgcaggtctatgaattcttctcgatgccgcagacgcttccggctttctcgtcgtggcacgatgcgatagcgttcgttgcagacaaggccgccagctggaccgattcgcgtcctttcgtctttgtcttcgacgagctgccgtatgccgtcgagacggagccatctctcccatcggtgctgcagacagcaatagaccacgggtttgtacagacgaataccaagatcattctctgcggtagcaacgaagggttcatggaaagcgaagtactgagcaataggagccccctctatggacgccggaccatgcagattcatcttcagccgttcgactacctggacgcggcgaagatgcttcctagaactagccacgaggacctcatcgcctactatgcgacattcggcggaacgccgtattacctcacacagatcgatactgcagaaagctatgccgagaacgtgcgcaggctctgcttcagcccgcacgggctgctctatgaggagcctctgatgcttctgcgcgaagagcttcgacagccagctttctacaattccacgctcgacgcaatagccgccggcgcaacttcatcttccagaatcgcggagcaggctggcatcaatccgaactccatcagcagataccttaggatacttgacggcctgcgcatcatcgagaaagcggttcccctcggaggaggatcttcctccagagatgcccgctggcgtatcaaggaccctttcttctcctattggtaccgctttgtaagcagatatctcggcagcatcgaagaaggagcgggcgacgctatcgtgccgtatgccacccaaggccaggcatttgccacctatgttggcaagcagttcgaaactgtttgccttgaatgggtacgccggcagagcatggagggcaggcttcccttcgcagcgctcgaattcgggcagtggtggggtaccgatccggaaaagcgggagcagaccgacatcggtgtggtagccacaaacagcatcgaacacaagttattggtcggtgaatgcaaatggcgcagctcattcaatgagagcgctgcaatagaagcgcttgagcaccgctccaccctcctcaaaggattcatcagacgctacttcatgctcttcacaaaggaagagacgagcaagacgacacaggagaaagcatatgccagagagggcctccagctcgtgacagcaaacgagctgtttgaagagctttgacgaagcagaggtgtgttagagccgaatcatcctgtaccacttcgtgccgtactcatcagtacaatattgaatgatacggaactgtagtgcatccactctagggaaacgatgattaattcgcctcgatgaggtagctggggctgtacgctgtatgacatcggcttaaaatgtctcgaactacgcagtgcccatatccacatagatgcctatctgcctgcggatatgttataattacagcaacgtattccagcatatccaaaaggaagatatgagcagccagatgagcttttaggaccttacatcctaaggtctgaggaaaaagactgggcgagaggcacacctggagcgggtggatgcaatcgttgtgtgggatagctggattgcactggtagataccagccaccactgacaggctcttgtcaggcatgtgcgcgctgcaaagacaaagctttaggatgtagcctgctttaggtcatgtttgctctcttaagacgagagaacttaaagatgctatcctggattgtcactcctggcagcgcttctgtgcacgtagacctcatgtctgagtaagtaccagatgcaacgacacttgcgaaattccgccatagccttaagcggcagggactcggcaaagctatggcttcacgatctggacttagaacttgaagaagcaggaatcacggcgcggggtggctccatggtggatgcgaccttcacctgggccctaaagcttcacgaagaacaaggaccacgcacgtaacccttaaagcgcaccagtccaagaaagggaagacctggcgtatctgatacaaggcgcatatcggcgtagacgctggtagtggccttgtgcatggtgtggagacgattacctagaatgtatccgacatatcctgtggcacacacactcgtaagggaagatgacaggttctgctgcgcagactttgggctatataggtatagcgaagcgcccttaaggacgcataaagacccacacctctcatctatgcgctaaagcgttgcaaggaagccttcgaccataaaggaccttgcctgtgcactcttctccgagaagggcatccagtccaggaaggcatccggccgctcaaaggtagagcatcccttccttatcgtgaagcggcgcttcgatccccttaaggaagcgctacagaaggatagagaagatgcctgtacactcgagtctttctcgcccttgcaaaccttacccatgtgcatcttttgccggcaggctgcacctcccggctcccagcgtcgcttgatccatcttggagccttattgtggtgcatggggcaggacagatgtaaggatagcggctcctgcacgtgctggatttccgcattccggccgcgaaaagtcgtgtggccggtcccctctaacacgttatggggcattaatcatcgtttccctagaggtgtattgggcacctttgtctgaatgaaaggctgtattttctgccacatatcctcgacactgagccacttccagtgtatctaccacaccatcggctcccgttctatccaacagcgatcaagcccaccaccatgtaggtattcagctctcacacagcaagaaagatagagccagcccttttccacgaagagataggtgatatctccaacaagcttataggtggagctagggaaacgatgattaatgcctatgccgcccgcgaaaggccacgtgactggtcctttctggcatatcattgggaattaatcattgtttccctagggctcgtgaagtcacaatgtataagatcaggctttggtttggcatatctgtcagggactgtggctctcttctgatctgtaaagggggtgagccctttattctggttcagtcctgaaacctgtgtgcgggcctatcatgccgcagccccagaaggcttcgaatagcgcctgctcgcatcgaatatcttgaggaagaagtactcgtcgttagggtatccctagcctgcccccccctgagcgtcttgatcatctggttcgtgccctcgatcctgtcgctgctgacatggtgcctggcgtgcgcgacgatgccgtccatgtggctctccacgagcctggcgaaccacccgaagtgcctgtctttcgtgccgcggcagacctcgacgaccctctccatggcatcgcgcatgcgcttctcctgccgatagccgtaggccctgctgagcatctcacccgcgatgtcgcaggcggcaaggagctcgttctgcgagatcagctccttgtagcgctccctggcgcctcccttctgcaggacctcctgcttgccgaagagggcgtttccccttgagactaccttgccggcgtgtgcatcgcgctccttcctctcccttgtgtccgcacaggacatgaggatgtatgtggagcgcttgagggaccttgcagccttgctgtctccatcgtcccttaagccttgcctgcttatccttcctgaccttacagatgaccttttcgttgaagttcttgatgaggtggaagtactcgtagacgatgtccagatgcggatggcgcttaaggaaggcgcgcccgaagcctgcattcatgtcgcaggcgattgcctccacatacaacatccactcgctgcccacgaagtcgcagaagtcatacacgacctgcttcctcttcgtataggcgagccagagcacgtgaccggtcttaaggtcgatgatcacggtggcccagcggcgggcattgtgcagcttgaacgtatctgcgcccaggtagcgggcctggcgcttgggcttcctgagcttcagctccttgccttccccttccgtgtagagcccagagagccttgccctgtcgatctttttcacgacgttcctgttaaggcctgccgtgagcgataccgccttaagggtctggcccagggcaagcaggtcacacacgaacgtgaggagaggcagcgtgatgcgctggcctggcgccctgaagggaacatcctcgatgctggaggccccgcattccctgcatgcccatcttggccgcaagacctcgacccttgccctctccatgcccagagggaggtgccgaagcgtgatggggacctgcccgttgccctccatggcctttccgcagcaggggcataaaggagttccttcgcctcaagcctgccggggaccgtgaggatgcgcaccggcctgctgcatcgtctggccgaggtgccaaactcctcggtgcgcacgctctccttaggcacgcctgtctgcacgaagccctcgagatgagaggggatctggatgaagccgggagcggcaatatcatcggcatgggaaacggcgggcagctgggctgccgcagatgctacacttgtcatcgcactccatccttcttcggagtctacatgttgcgatgccaagattctagaggatggccgctcttctgtctctgagggcgctatgccgctggcatccgcccacagcttttaggatcgaacctttattcttaagctcgcacatgcatcttcttaccctgtagagggtagtgtgggaaaactcatcagctagatagcagtgggtgtaaacctagccccaaaacctctgtcagagtccacccacaagcgcctgatagcctctgtaagctcactgcacccgttttctggtgctcctaaaagaacacccatgaataaaagcttgagcgtaataccttaaggagtaaagcctatatcttgatcgagaagttttccttctcctcaagcttctgcttgtaacaatctattgcacttaagatcctttgcgaagaaggccgtggctgcctttaagaaggcatgttccatctcaagctcttagctgcgcttggcataaggcttttgaacttttcctctttagcctcgccgcgctaagcagctgatagcctatctcttcgatcttttacccagcggatctgtgttttgggacttaagccctaattcggtggtaaggtgggctatcggcttgccagtagagatagcacactcagctgttttcaggcgctactcatcgctgtatttggtagcaagattgtttgccaccggtcgtcttttcggtcggcttgtcttgcagttaagaggagcctcataattcctcaagctgcactgtccgaaaaaacgatacaggtcatgcatcggcgatgtctcgcccgagcgcaagcgtctcgtcgaagtctgccacgagtcggttaaggcaggccttgctaccgtgaagccatggtgggaagtgcagctggtcgtgacagaggatggctacgaacttctgtcctggtaggcagaacagaggagattgtttcggaaggcatgcgggagcttctcctgcatgccttcctccgtatctgggcaccgtctgcgtgccagccctttgaagcttttggccgggacgatagactggtgagaagtgccataccggaaaggggtcctaccatgctgaatcatttctcgaagcatccgctctgggagtgccacaaaacgctgatccgggtggcgcaggggcaggagcctgccgatatcgtccttcggcacgtcacgcttgtgagcgtgacgacgcatgagcttctggaagatgccgatatcgcgattgcggcaggacgcgtcgcctatatcggcatagaaggacatacagcagagcactgcatcggcgagaagacggaggtcttcgacctcgccggtgcctatgtcgcccctgccttcatggatggccacatccatgtggagtccgcgatggtaggacctgccgagtatgcccgtgtcgtcgtaccgcacggcacctccgcgatcatgtgggacccgcatgaggccatgaatgtcgcggggatagaagcgctcgatgtccttatgaaggatgctgagcgtgtgcctttgaagtgctatgtgacaccaggctcctgtgtgccggctgttcctggcttcgaggatacgggtgccacgatcgatgcagcggacatccacgaagcgatgaagcgggacgagatctgcggcctcggcgagatgatgaatgacccgggtgtgctctcctgtgcagacggtccgcttgccgagatcgaagagaccttgaaggcgggaaagaccgccacgggccactacacgatgggagacaccgaccgtggccttgaggcctatatcgcctccggtgtctcctgctgccatgagtcggtcacgcgcgaagaggcgcttgcgaagctcaggtgcggccaatacgcgcagctcagggaaggctctgcctggcagaatctcaaagagcttgcgcatgctgtgacggacaacgagatcgatacacgcttcgtgaatctcgtgacggatgactcccatcccgagacgctcgtatccgaaggacatatcgaccggattctcaagaaagcagtcgccttcggaatcgatcctatctctgcgatccagatggtcacgatcaatgtggcgcagtgcttcgaccttgcacaggacctgggctcggtcacgccaggcaagtgcgccgacatcgtcgtgcttgacgacctcaaggacttctgcgcccgccttgtttttattgacggcgagcttgtggcaagagacggacaggcgctctttgcacctgagccgtacgcgtggcccgcaaagttcctgcatacgatgcatatcacggatgagatctcagctgatacgttcaagatccctgccctgaaaaaagatggctccgtcctgcctgatgggaaggcctacgtccgtgttatcgcatcctcggcaggatccacactcacgaaggaagagcatctcgaagtgccggtacgcgacggcgcgcttctcgccgatcctgcgcaggatgtcctcaaggccttcgtcttcgaccgccatcacgagggaggccagcacgcctgtgccttcgcgaggggcttcggtatccacggcgcgctggcccagaccgtcgcgcacgacgcacacaacctgcttgtcgtcggagactcggatgaggacatggccatcgcggcacgcgagctcatcgcatcgggcggaggcgaggtcgccgtccaggacggaaagattctgggcaaggtcgccctgccgcttttcggtatcatgtccacctcacccatcgagaaggtcgcgcacgacgttgccggcatagaggctgcctggaaaaagatgggctgcacgatgccaagcccattcatgacaatggggctgttgtcgctcgcctgcataccggagctcaggctcacggaccggggccttgtcgactgctgccgctactgcttcgtgccgctccttgtcgaggacggggactgagccctctcaaagaggccaagctggaagtgtgcggcctcgctcatgggaagcagcgcatagcgggaaagctcgtctgcacgggtagagatgaagcgccttgtctcgaagtttgccatgatgtcttcgaaggaggggagcgctgccgaaagcagggcactgggctggagcttgcgctcgccgatgaagatgccagagagctggaaggactcttcgggaagcgtgatgctgagctcctctgtgcattcctggctcgtgcaggaacggacgggatcttttaccttgaggtcttgctcgtcgagcgcgcctgtcacggagacggagtacgtcttcggggccagggccacagcacctgagcgctctgccagaaggcagcgtccctctctgtcgtgcagaagcacgcttacggcgaggccgtttgcaagatgagcgcaggagaagatctgtgcagggtcttctgcaagcttttccgctaagaccgtctgcctgaagtgcttagccaatgtctgggtcaagtccgaattcgtgtgtaaattcgcgaacgccccacatctcctatttcgccttcatgagcccgcactgatcgcgcgcgatggcgacgagcgcggacgtccgcttctcgagctcctcgaccgccgggcggtagcaggccttcctccccggcccctgccaccagcctgagctgtaatcttttggtggacagtaggattcagggactggcagcagatatgctctgtccagatacccacctaccaacaccagcagattgaagcgatgagatgtcgctaagcgcaagcgagatagagaaggcaaagtcccgcacgaagccggaaacacccaaacactacactgaggaagtattgcctcgaggctatcgactactacaggaaggcacgtaaggccaacccgaagaagagcatcaaaggatgcgccgcgaagcttgaagccaacgacaagaccttaaacgactggatcatcaagcactcaaagaccaaaagggtggcccaggaaaggatagacgagcacaagcagctcgacgcagtgaagaggcgcatgcacgagctcgagagcgagaacgagttcggcggattagcattctgagtgcaacacgatagcccgctggatgcaggcgtggcacactccggaaggctacgatgttggttgtctcgtcaacgtcgaaagctggaaggaatgtgccactacacacatcttagcctacaggagaaagactgcatagccacgctgcatgcagagggaagctcaattgcctatatcgcggcagagatatcggcaaggacagctgcagcgtctgccacaagatcgcgaggaacgcacgccacggacgctttagggcatgcgctgcccaaaaggagggcggatgagcgccgcaggagatgcagggcgaaaaggcggctttcagaccctgcgcttacgcagaaggtgcgcttactcatcatggacagacactggtccccggatgagatagacgacatctcaggctcgagggtggcggcaggtgcaccgttgagcctgccgactattcttaccggcaggtccatagccgccgccctcgacctgtcgggatccggcccgcaaggccaggtgcggtgccacctgcgcaggaagaggcccgagacgaggggcaagatcaagatcttacacaccgtggatgagaggccagagcaggccgatgagaggtctcgtctcagcgagtgggcagacgacacgctcgtggcagcggggcccatgtgcctgctcgtgcttgccgacagggcagtgaggctgcttgccgcaagaagatgccaccacaacagtggaagcgtctctaaggccgccttcgggcttttgcagggacgtcccctcaagacactcacttccggataggggcaagcagctcgcagggcatgcagggctcacaaaggccttgggaggtgtacagttctacttctgcgacccccaccatctatggcagaagctaacagttaagaacaccaacgggcttctgcgaaagttcttcccctaagggcagcaacttcggcaaggtcacaaacgaggaggtgcagcatgcagtggagctgatctgcgacaggacgaggaaggtcctgaaatacaggacagccaacgaggtctttagggagatggtgcactcagcttgacaatctgccccctgaaaagatacacgagccaatttagatatgactgcaggttgtccattctcatgccgatgaaacgatagatgtatctcttaagccaggaacacatgttattgatcagtgccatattctctagatagttcttatccttctcattagcaatgtatgattcgctatgaagatggagcttctcaatgagaagattatgggcattttcaccatcatgaactaacactgatccaggagcaatatggtccttgagcgcatgatagattcttgtgcttgagggctttccatgacgtgtggctctatcaacagaattgtttactgttagatttacatattcgtatctttccgcaatggataagcaatttcctgacataaaagggtactgttgacggcaatgcctgtacggatgcaggcagctcttggagaggagaacgcgatgaaactgcttcgcgccatgcgcgagcccctgaagtatgtccagggcaaggatgcgcttctgaagttcaaggacgagatgggctacatggggagccgctggctcttcatctgctcgaagagcggctacaaggcctgccacgacaagatcgagcagagcttcggcgacgatggcagctaccgccgctacgagatcttcggcggcacctcgagcaagggcgagatcacgaagatgaagaagatcgtcgaggaggacaagatcgacgccgtctgtgcctgcggcggcggctctgccgtcgacacggcaaaggcgactgcctactacaccgacaagaaggttgtcatcatcccgacggttgcagcaaccgatgctccctgcaccggtctttctgtcatttacaatgacgacggtagcttcgacaagtacctcttctatccccagaaccctgatgcagtgatggtcgactcccaggtcatcgccgatgcacccgtgcgcttcctcgttgctggtatgggtgatgccctcggcacgttcttcgaaggccgcgcctccatccgcaccgagtccccgagcctcgagggcacgggcatcacgcgtgccggcatggcactggcaaagctctgctacgagacgctcagagactacggcaagcaggcccttgctgcctgcgagcaccatgtggtcacaccggcactcgacgcgatcattgaagcgaacgtttatctttctggcgtcggtgcagacaatgtgaactgcgcagcagcccactcgttctataacggactgacggcgctcggcggccacagcgtgccacatggcaactgcgtcgcctttggcacactggtccagctcacgctcgaaggcgccacgaaggaagagttcgaggatgtccagagtttctgcctcgaggtaggccttccggtgacgcttgaggagctcggcgtcacgaccgaggaccagatccgcacgatcgcagagcatgcctgtgtccccggcgaaacgatccacaacctcgctggcgatgtcacgcccggcgagctctatgcagccatcgtcgcaaccgacgctgaaggcaaggctgttctcggcaagtagcttccagcacatagcacgtcccaggagaggtaccggcacgtccgggtctcccctccttctgtgcggagaatgagtatcatagtgggaaaagaagaaccggcgaaggaagaaggaccatggagaagctgccgcctctgcagaagatctatgaagcatggagcgccctggctgatggcagggtcgagatggatgaggacacggcagaagtcacgtcctcgaacgataccaagcactacacagtcagctggtccggagatgtctattcctcggacgacaatgcaagctactggcagggctatgccggctaccccgtccttgcagtcctcatgaagcagggagagcttcccttggcaaatgcgcttgtgccccgctttgcacatatcgattggaatgccctcaacaagaaacacaagagagactatgccgcagcagcccaggaagctttcgaggctgcaggacttaccgaggaagagactaccgaggcagaagctgctgcccaggaagcgcttgacgccgtggcggcattgccgatcaagatgaggcgcaagggacgtcctgccaagtaggcggatgcctatctcatctgccgtatcatcgaagcagaccgatctttgctgcaaagcagccagaacagaggaggagcaatgaccacgaccgagctcatcaagctggaccatggatgcgcagagggcaccatggtgccggcgcttgcaggagagaaccacgcttccctccttgtaatccgctgcgcgaagggcttcctcatgtgcggatacctgagccttgagaaggcagagcagctcgacgatgtggccgtgcgcgttgccggcgcaagcttcgatgaggtcctcgcgaacaagatcacaggcatgacccccgccgctgcagccctcggcatcactcccgatatgaccggccgcgaggcagcagagatcctgaaccagcagtaagcacacacaagcttccgcaatcctgccctcaagggacaactcatggattgtgggagtatttgtctccccatgttgtccgataccgtatcatcgggtggaccagattgccgcccaagctccggcccatcaaagatatgaggcagaacagatactcagcgttctgccagcaccttccagaaagaggattccatggaactcaatgaccactagatcaggcagctctgcagcctcgccaacaggcttgaggcaaccgtcggtatcggcaaggtaggcatcacggacgccgtcgtgcaccagatggacaatatactcgaagcacatgagctcgtgaagtgctccgcccagggaagcgccggcatggggacacccgcgaggcagctatcgccctctcccgcccgacccattccgccgtcgtccaagtcatcggccatcgcttcgtgctctaccgcgagacccaccgcgacgacgtggagaagatccagctcgtgcactagcacaaaccaggcagcctgagactatgccggcccgtttccagaaggaggcgggccggtgctttatagcgataatattggcaaatgaaggttctaggtcaatgcgccaggcagctgagcggaaccacatgcacaccatcgggacgcgtataggcatactttccgccggtgagtaccatcaagaagctcggtgcccccatcttttcgtgatctaccttctcgtaaaagcgacaggagattgcccacaccttcttctatgcgatcctttcctccgagtttcacctctatgccagcccagcgcccgtcatggagccggatgacagcatcggcttcaaggccgttcttgtctcgatagtgatagattcttcctcccggcggacgtgcatagacgcgcaggtctcgaatggatagctcatcgtgttcagaccgttgagcaggccctgcgcattgcagcccaatgaagctgctgcaagggacggatcgcacagatgccagacccgcgctttgcgcaagaggggtcttcgaacgaaggttgggggcccaagcttcgatatcggtaatgacatagagcctgcgcagagcattgagatagacccggagtgtcagatcgctgattttgagaccagtgtcttagacgtctgcaaggagggtggcaaatgatgcctcctgagcgctgcagcatgcaagcgagcgcagaagtgcccgtgtcctcgaaggatcaagatcctggtctgcggcctgagagacatccgtctcgcagagtgtatctatgtaatcttctgtaacgcccggatccggtcttccgaatgagatgggggctgtccacccaccattgcagatgagatcggcatagccctcgatatcgatatccgagcttcctgcgacatgctcgttcctctcaaaaagcttcgccaagctcacgtcccttgaagaatccccggactcctcaagagtcatggtgtccatttccatgcgcacaatacggcccgttcccgtatgctttggagcatcctcgttatcgaggctgaaaggagttgccgaacccgtcaagatgtattggcccagaatgcctcccgcaacatccaccacattgattaccgtatcccagaggacaggagcgacctgccactcatcaatcaggcgcggcttgtctcctcgcagcgagagagatggctgcatctcgagcgcacctgcacttgcagcaagcacatccggattgcgaagcatgaaagagctctttgctacctactgacaggtcgaggtcttcccgcaccacttcggaccacgcacaagaagtgcgccagagcggttgaagcgctttgcgagctcttcatcagctatccttggcatgtatctcatatttggcctcccatcagggactattgtaccctactttagggtttggctgctgttccacttcagggtctagctgccagtgcagtcttcgactatgccctggcggccaaacttcagctttcattcttaggggtgatacaccgcttggtctgcgagctcttcttactggaagatgcgttccacagctgccttgtactcatcaggctcgcggaccttcgatccgccataccttctgtaggtccttgaaagcaaaccgcgcataggaccactacaccttaatgcggaagagagtatttccgcccatcttctccacgtacccctcgagcggcctctcatgaaacttcctgatctcatcggctgtgacagcaggaccgcccttgagcatacggccaagtgcaggatttgccagaatgccacagcctagaaggacatgcgtcgtcgcaggatagccctggaccaaggcaccgagatcagccggagagaagatgtctccactatatgccacaggaaaaggcatctcctcgagcgtctctccatagcatgcaaaatgcggtgtccctttgtagagctccgtcctcactcggggatggacaatgagctccttcagagggcagcggcagaagatgtcgaggagtctctcatactccgagacatcagcgagtcccaagcgggtcttgaccgagaccggcagaggcgaccttgtacagatatcctgaaggaagcgctcgagttcctccgcatcgcgcaaaagccctgcttctttgccttttgcaacaaccgttccggaaggacatcccacattgaggttgacttcactgtagccaagctcggccagaagccctgcagtccagacgaaaccgtcggcattcttcgtcagcagctgagggatgacaagaaggtcgtccagcttcctgagcgccttcagcgtcttctcggtgaagggcttgcccaggtgtgccggtgcgatgaagggaagacagtatctgtcgagcttgccgaagcaggaggcatggacctcgcggaaaacatgtcctgttattccattccttccataggggtgagcgagaattccacgggcttctccttcatctcatctcggcagaaacaaccattcccccttgtatccgctgcttgcgcatctcttcgggagtcatccgcacagagaaagagggagacgcccacaagcatctctctccacgcaatctttctgtctttggatctctatgccttgtgccaaggtgcatggccattcgcaatgttgagcaggccctgcgccagccaagtcggcatcgctcctcctgcacagttcacgaggccgaagagcgcacatcctgcgctcgactgtatcgacatgcggcactgcgggtcgcttggatcgtcgtagcccttctcgattgcaccgacgatctggtccatcatgaatcgtgcgaccttcgaggtctttgccatctcgatgagcgagtccgtctcgtcgtaggtgccctttacatggtgtgtttccttggggaccggctttccgtagagtgcctcgaagtctgcaagtgccggcttcccttccggcttctcataccaggtgtccgcaaggcgtgcatcagccaagctcttcacagcctttccctcgtgctcgatcgtgcaggcaagcggaagatcgtgcgcagagaatcctgcatgcacggtgtaggtgccaccgagctcctgccagccgtccttccagacgcggaaggcagcaggatcgagcgcaatctcgacctgcttcgtctctttgggcgtaagctcgacgcgcgcaaagccagcgagtgcaagcacaggttcgggaagcccatccttgggtgccgtgatatagatctggggcacgacaacaccggtgcgcttgcctgtgttcgtgacggaaagcgtagctgtcatgccgtggacggcgaggtctttcatctcaaatatcgtataggaaaggccttcgccgaagtgatgcgcaaccggcaccttggccgtctcgtagtagcggtagcccacgaacgtgccctcgcggtactgcgcctggcggtgtggctctccccaccagcccatgcatggcacatcgcctgcatggaaaggccaggtctccgtgagcctgccggaagcgtctgtgtcaccttcaaggcaacagcacggttgcctttgctcccgcttctccgccaaggcctgcccagagcacggcagatacttccttctcccagggaagctcgacggcagatccgctctgcacgacgacgaccgtatgcttggctgccgcggcaaccgcacgcacgagctcgtccatgccggaaggaagctccatgtccttccggtcatagccctcggactcgatcgtctcaggaagccccacaacgacaactgcaacctcggctgcacgtgctgctgcaactgcctcgtccacgagtgtcggcgtcgtcgagccgttcttcggatcgtagccggcggcataggtccagtcagacctcaggccagcaagcgtctcgaccttgcgagcattgatgtggctcgagccgccaccctggtagtgcggcgtctttgcaagggcgccgatgagggcgacctttgcatcctttgcaagcggcagcactccgtcatttgcaaggagcacctgtccttcctctgcaaccttcaaggcaacagcacggttgccggcaatgtccacagatgtgctgcctgcctcagcatgctcaatcgcaagcgctgcaatcctctccgcgcaggccgtgatgtcggcctcgccgagcgtgcccgcgtgtactgcatcgagcgcctgcttctcgaggtgcttgccggcgcccggcatcgcaaggtcgcacgtcgccttgtacgcggcggccctgtcgtgcatgccgccccagtctgtcgtgatggcaccttcgaagccccactcgtcgcgcaggatctcgcacagaagatgcctgttatccgagcagtagatgccattgagcatcacgtaggcgctcatgatcatttcaggcctggcatcacgcacgaccatctcgaacgccctgagatagatctcgcgcagcgtcctttcgtcgatgaggcagtcattcgagaaccgcttgtactcctgggagttcacggcaaagtgcttcacgcacgagccggagcctgtcgactgcacgcccttcacgtactcgctcgccaaggtgcccgtgagatacggatcctcagagaagtactcgaagttcctgccgcagagtggacttctcttgatgttgagtcccggaccgaggacgacgccgacaccaagcgagcgtgcctcggcaccgattgctgtgcccatctttgccacaagctccctgtcccaggttgctgccgccgtggcaagcgacgggaagcaggtcgccggctccgatttcgtcattcctttcgcatcggtgcccggcttctggtagcgaaggccggaagggccatcgctcaccgtgagggcaggaaggcccttttcagggatggcctgcgtgcgccagaagtctgcaccgataccgaggtgcaccttctcctcgagcgtaagagaggatacgaccttctccgccttcttcttcgtgctatcgtccacagaaatgctccttattacctaatccttgcaattgaaatgatgggtgccggcaccgaccgccttttccgtgccgtcaggcaaaatgatgtcggccgtgacattggcaggaatcgcgatatcgaagctccagcccgtatccgtcctcttccagccggatacaacctcgccgcagatgctcgcataggctgccttggcataggagagatccccgcccggatgaggtgcaatgcggaagtggtgctcgcctgcgcactcgatgccgcacatgcaacggaagagccaggcgcagatggcacctttcgaatagtggttgagagagccgatgccgccctgcgcagaggtgccttcccacgactcccatacggtcgtcgctcccaacttcggcatgcagagccaccccggcagctcctcgttctcgaggagacggtaggcagccttcaggtcataccctgcaagcacatcgaggatgagtggcgtcgagaggaaacctgtgccgaccctccagccgtacatgtcgagcgcttcgatgagacgcttctcggcgaagaccgtctgctcttggtcaagaagatggaaggccagggggcgcacgagcctggcctggcggtccgtatcgagcgtgtactcctggaggtgcgagagctcctgataggctaggcggcacccatccgcatagcgctggtaaagcttctcgtcctcgagatgcccgagctcgtgggcaatctctgccatgcgcgacatcacgagcgccgtataggcagtcgcgacctcggggtgcggtgtcacggtatccttccagtccatcttgtgaacatcctcgggctctgcccactcgctgtagcactggccggtattgacgaggaacttcttcgcttcgcgcgagagcacaatccgcttcgagaacgcgcccctctttccacatcttttcatcataaatcccgcatagcgctgcatgccaggatagaactcggagaggatgctcgggtcgttgtagtgcttccagtagcgatacggaatgaggacgccggcatcggcccagccgaccgagccgtcgaggaacttcatgtaggagtccacgccgccgtagggcgcgatctgcgtgagcgcgccatccttgcgctgtgcatcgaagaggtcgtgcagccatttgcgctcgaacgtctcacagtcgaagagataggaaaaggtctcgaagaagatctgtgcatctcccgaccagccatggcgctcgcgggtcgggcagtcgatcgggatatcgagggagttgcccttcgtggaccaaaccgtgcagccgaagaagcggttcagaagctcgtgcgagctctcgaatgtccctgtcctcagcatgtcggaatagatggcctcggcaaagaggtctccttcatgcaagtccgtgtcggtctcgacctccacatagcggaaaccgaagacggcaaagcgcatctcatagctgttctctccctcgcggcagacatactcgacctgctggagcggtgtcgcgaagccctcgcgggcacactggatgttcttgagcgtgaggtttccctcggagtcgagcagctcgcctgcacgcaggagcacgtgctggcctgcatgggccgagatggaaaagccaatccagcctgcgatgttctgcctgaggtcgaagagaagcctgccgttcggagccttctggcacgcaggcacgaagcgctcatgggcacgcaccggcacagagtcggatgcggttggcacgaccttgcaggttgcaaggcgcgcatgtcccgaatagctgggcacacgggtcgcatcgacgatctcgccgtccttgttgtcggcgaaaaggatggggccatcatccgaccattcccagtctttaccggagcagatgcactcggagatcccgtccttataggtaatctcgagctgagccagaagcttcgtctgcgtgccaaactggttcaggagcccccaggcgccggtcgagccgcgataccacccatcggcgagctggacctcgagcgcatgcgtaccctcctggaccatatcggtcacatcgtatgtctggtagtggatcctcttacgatagtccgtatatcctggcgccatgcagaagtcgccaaccttgacaccatcgatcctcgcctcgtagaggccgcaggccgtgatatagagacgggcacgcacaacctgctttgctgttttgatgaggcggcggaagcagtcgatagggaagcgtccctcgatgatgggctcacacacgacctgatcgggccctgccggatgcatggcagagatcatttgtttgaagttgctgacggcgctcaacctctgggacggtacatcgtagtcgccggagatccaggacgccttccaatccgtggcatcgagaagccccatctcgatcgtagcggcatcggaccagggaccggctttgtgccctcttcatcccagatgcgcacctgccaggagacgcgctcgcggctcctgagcgggatgcctggccacatgagctccattgaggcgctctcaaccttgccggtatcccagagaagggaaccatcgtctgcccgggagattatctcataggcgctctgggcgatgccactctcatcctgccagcgcaggcgaggcaatgccatatcgattcccagcggattcgtgaggtaagctgcctcgagattcactgcatgcatgaccttactccctcaactcggtagctgctgcctcgtgacggctcttgatctctgcctgctcctgtccaatcgtcttttctacatcgagcttcgagagcaggaagacgataacgatggaagtaatgatgtcgaggatcaggaagaagaacacgaagacggccttcgtggcgtcggactgctgggcggcaaccgtcacgccgtccacgaccgaaggcggaatatagcccgtgaccgagagcatgaggttgaagacgccgtttgcaataccgccacagacagtctgggtgatcgagtagatggcactcgacagcccatcacagcggaagccgaacctccactcgcagtggtcgagcacatcggcgaagagcgccatgaacacataggcggcaggaaggcagccgatgttcttgataaactggccaacaaggacgatcggcatgctcgtcgggacgatggcacagatcgcagagccgacagcgacgataacgaagccgacaagcgtcgtattccgaagacctgcacgtttcgcaatcggccagacggcgaagataccaaggcccatcgggataccgccgataacgttcacgagcgtcatcgttatgccgtcattgtaggagccgagaacatagttgcagtagtagagaagcgacaggttcttaaagttcatcgagagcgtgtagatgaagagatagagcataaggacaaaccagtagcggtcgtggatgacagtcttgatctgctcgcggaagggcagaggctctgtctcttcagactctccctgctcctcggtcacgcgctcgcgggtgtagtagtattccatcaagatcataggtaaagcgatggcgcccaggatccagcccatagtagcccaggcctcgcgggaggcgccaaggatcggcagcacgaacatcgggaagagcatagcgatgatgatgccggtcgccatggtcatcgcgatgttgttcataacagaaagcgagccacgggcgtcggagtcgcgggtcgagagcgggaccatcaggttgtgcgccatcgtatagaatgagtttgcgcagagatagaagaggttgtaggtgatcgtgacccagatgacctcagcagcaatgccgaagctcggcaccgtgaagcagagggccgaggtgatgaagaagatcggtgccgagatcagaagatagggacgggctttgccctgacgggtatgcgtgcgctcgatgagctttccaacccagaggttcacggcggcattcgcgatcttcgagacgatcgggaagatgagaaggaagagtcctccccacacgagggtgaggcccagggcatctgtgtagtagacattgagatagcttgcaagcacggcgttcacgagcgcgggtccgatcggccctataagatagccgaagatcttctccttagcacccactttgtctgtcttcacgcgcgagtcgaagatacgtctgttcatgaatgagagagatatgccgcccgccatgcgattcctccaagctgtctggccacttttctgatgttggcaagattctacggagggaaagcagaaatgtatgtcatatctgttctatatttgtcgtatctgttattgtgatgacaggtggcaggaaacggcggatgaacggcggcgtccatggacatcggagacctcgactatatagcccacctcgtgacagacatctcgatggtgccggtccgcgtctatgcgggccacgacaagattctcttctcgagccctgcacctttcccccaggacccggcagacccactcctgccccgcctcgagaaggaatcatcggaggccttctgcttcgagacggacgacttcgcgctctacgggtgcgtgcgaacagagaagctcctcttcgtcgtggggccgttctataacaggcggcccgacgaacttacccaagaacgcctcagcatcgccttgggcgtccttcccgatcagatgcctgccttcaaggaggccatggacacgcttggcatcatgccccgcgagaccgccctcctcatgacctgctctctcggctttgccctcacagggaaacacctcacggtcgaagaccttgcaatcagcaaagagtaccaggaggcgctctcgcgcgagatggcacaggaggagttcggtcgcaacacattccgacccgatgagcgcacccactcgagccgccaggtcgagcagaagatctcctctttcatctcccagggcagaccccaggagcttaggagctaccttgcaagcatcccgaccttccgtgccggcacgctcacgaagagctacctccgccacacgaaggacctcctgatcgtcgaggcgacgctcgcctcgcgcgctgcaatcgagggaggtctcgccgaagacgaagccttggggctctccgacgcctatatcggccgctgcgaaagtatgcaggacgtgagcgagatcgctgatctcggctggcatatgctcctcgactatgcagaacgggtcgagaggctcaagataggcaacgacccctccccccttgcccgcgacgttgccgactatgtgcatgcccatatcttcaaaccgatacagacccaggaagtggcagatgcactctcggtgagccgcggatttctttctacgcagttcaagcgcgagtgcggcatctcactttctgcctatatccggcgcgagaaggtggaggaggcaaagcgtctcctcaagaacaccgaccagccactccttgccatctccatctatctcggcttctgctcccagagccacttcagcacagtcttcaagaaggccacggggatcacgccaaacggatggcggaagcgctacgcttgaggctctccaggctgtctctgcggtgaggagttccagatgaagcagtacatcgtcgatgccttcacggagaccctcttcaagagtaatcctgccgctgtctgccttgtagacgcctggtctgaagattccctcatgcaggccattgcaagagagaatgctctctccgagatggccttcctgcttcccaaggaaggatcctatggccttcgctggttcacaccgaaaggcgagatcgatctctacgggcatgcgactctgacctctgcctttgttgcaaaccagatcctgcaccgatactttccttcgaaaccgcaggcggcaggctcgacgtcgtacggagagacggcctctatgcgatggatttccctgcctttgcgctgatacgcatggacgtcacgcctgccatggagcgtgccttcggagaggtacccaaggaaacctggctcggagaggaccttgtcttcccggagcttccaggaccagccaaccaatctgaagtgcgggttggcaggaaagatggcaccgtcaggcgctgccatgcccgacccctcatccggcaggccggattcttctggcgcctttgtcgcttcctaccccgatgccggcgacaggaataatgacctgtgtcgatatttcggacggcggattagcattttgagtgcaacaggatagcccgccgaatgcaggcgtggcacactccggaaggctacgatgttggttatccaagtcaacgtcgaaagctagaaggaatgggccactacaagcattgtaagcctacaggagagggactgcatagccgagctgcgtggcacaaggaaaggtcaattgcctatatcgcgggaaagatcggcagggacagctccagcgtctgccacaagctcaagaggaatggccgctacggacactttagagcatgtgctacccaaaaggagggcggatgagcgccgcaggagatgcagggcgaaaaggcggctttcagaccctgcgcttacgcagaaggtgcgcttactcatcatggacagacactggtccctggaggagatagacgacatctcaggctcgagggtggcggcaggtgcgtcgtgagcctgccgactattcttacaggcaggtccgtagccgccgcgctcgacctgccgggatccggcccacagggccaggtgcggcgccacctgcgcagcaaggggcccaagaccaaaggcaagatcgagatcttacacaccgtggatgagaggccaaagcaggccgatgagaggtcttgcctcatcgagtgggcagacgacacgctcgtggcagcgggacccgtgtgcctgcttgtgcttgccgacagggcagtgaggctgcttgccgcgagaagatgccaccacgacagcgggagtgtctctaaggccgaggtcgggcttttgcagggacgcccccttaagacgctcactcctaagtggggcaagcagttcgcagggcatgcagagctcacaggtgccctttgaggcgtgcagttctacttctgcgacccccaccatctatggcagaagctaacagttaagaacaccaacgggctcctgcgcaagttcttcccttaaggacacagacttcggcaaggtcacaaacgaggaggtgcagcatacagtggagctgatgagctgatctgtgacagagcgaggaaggtcctgaaatacaggacagccaacgaggtctttagggagatgttgcactcagcttgacaatctgccgacagaaatattgacacaggtcactccataaagtcacagaagagcgcccataaaagcaacaaggcgctcaagaacctcctcatatcagctgcactccctcgtggggagagaagcgcttcatgagtactacgatg

SEQ ID NO: 371 - DNA, 12467 bp, Unknown
  Metagenome-assembled genome
tccacctgacatcgacaagcgtaacctgttcgttgtcgacccggctgctcgtcacaccgtggtcactcatgcggcgatccattttctgatagggccaacgtcaaaggataatcccctgtctgcacttggtgtccgcccgcgaagtgtccgcgcgtgctcaactatgatcgctaaggaggcctatactgcgccttggatcgtgagcatcatagcgacgcctattcctgcctgcctgggcgatgcaggggaacgtatcatacggaacaaggaagggccttccgcgtgttttagtgggtagcacgccagggatgtctgagcgatgaagttaagcttttcagccttaggaagatcatcgtcttgaaataggcatgctcctgagaagctagcagcgctcctgcgctgatactggacaagggaggtagcccttcgagaaatgattggtcaaatctcctcgccatcagtttttaagattcccctcacgctccttctaaggtacctgccactctcttcacttaagtagtcacggcagagtgcatcatctacagcagaggcaatctgggtccttggctgtagattttctgtcggggtcagcacatatacgtcctgtattttgcctctgccctgagacaacacgcgcctccctgagatgtgttcttcgcgggatcgagatctcctccctcttcgcaaggctggcaactcctttcaggatctcctccccacaagtacgactccggaatagcctgctgatctctcacttcccgtatgctgccttctcaacgatctccatagagcgtgggcttgtccctcgtgcagaggctatggcgtcacacaacgtctcagtccgagagcgcctcacttatcgcttgggcctcaaagagtgccgtagatgcggcttgtcgggtgcacctcccagagcatccttgcggtttggccatgcacgccgtcttggggccctcaaatcaccgcgtagttacatgggtctcgtattgccagatgtcgagatgcctttatgtgttcccccttgtcgtctgctatagccgcctgtggcagggccgggctcaccactgcccgaccctggctgcgccacccttcatatggaactcgtccctgcgctcatctgccttctcgaccagacaaccgagagctccattcgtccctaaggcctccatgggaacctcttagaagcctcgccagatactgcccttaagcatccatatccgtcaccttaggatcgcatcgctcgctggccagacatacggtcttggctgtctcgggtaccggacagagtgcaaaggatatgcaagggcgccatcaaccaaagagcgaagacgctctacagaggccttgcgaagaagtgcagcaaggagccctggcgcgctctccggcgctccgacgtcctactccagtcttcacaggtccatggcagcagagggccgagtgcgaacgctctgccatccccagatgctcgagtatctgactcgcgctatggccaaagctgtctgtgcagtcgatcccgaggcggttcgtgatcggtggtggcgtcgtcggctccgtcagagttcttcaaggacgagcttgccgagcgcttccggagcactgactgccatctgcaggaacacaaagatcgtgccgaaggacctcggcaaccaggctggatgtatggtgcgggatctctgtgtcctctcggcgaagaagtagtaaggcaccaagtccaaaaacatgcagaagggctgcagctccaaggggctgtttttctttgcgcttcgtgattgggattgctcaagaaggtcgcgtacgagtggcatgctcatgcaatgcgtgccgccacgccccgcagagagttcgcctgacgggaaggtaggacctgatgtcgctgccttgtcgaggaggtcgagcgtgatcggtgtgcgctcgtagccacgacctcgcccggagctatcgccaggacatgggcacgagttccagagctcccattccgatccacgggtcgtcgccgccgcaggggatgagacgcacatcggggttcctgtcgcctgggcaagagcgctcggttgccagttccttgcgacgtagtcatagccgcgcctgcggcgacgcggaaaagacgtagaggtccgtcgtgccatcgatcaggggtgttggtagaggaatgctatctacgtcgaccatcgagagcgagatgtcgagatgcatcgaggagcggtgcatgccgatatcgaaggcatagacctcggtgtagctacgctcgaagaggctgtgggcgatgtattcgatcgagaggggctcgtgcgctctgagcagccgatgatgacagaatggttggaaaggacgagcacgtcaccgccttcgatgcgctgaggaaacgaaaggtcgtagaggtttcctcctgctctccttggaaggccttcgcatgctggcgtacatagcggagcacaatcgcctcacgtttgcggacacgcttctccatatgtaggggagtagatacacatcgtggccaagcgagatcgagttgtcgcgcatgaagtagatgttcgggagtgggcagacggcaaagactgcctctcgggtgctgaggttgccgaacgaggtcactcggccaggcgtggatcgtgctcttgatgccgacagagcacagtctcgacgagctcgtctaccggcatgtgcagtgtagaggtcctcgagcctctccaagagtgccggagacatgatgtggaggcctcgaggaactccgagacgaattcgtagcggaccttcggcgatttgaaggcggacttcatagatcggtgaggtagagacctcgacgccggcatctgttaggatcttggcaaaggcgtatgttccctctgggctccggccagatatgatggtgtatcttcgagagcatgccctggagctgcgagggaaggacctggcgattcgcgtccaggcctgtgaagcatcacctttctgagcgcccgatcccgaatacacctgtgtcattttgagcctcgcttcctctctcctgtacaggatgcgccaaccaacgctgactagcctattacatacccatatagatatctaaaaccaaaaggcatccgaaacgtgacgctccaaagtgtcgtgtttctgggggcctttccccctgttgcgggggtcacatagagagcgggcggagatgttctgacccgtatactttgggggaatcgcagaggcgaggagcgcgcggatggattatggcattctttgatatcgacatacgctaatatggcggacccgaagaacggctggggaaacgaggcaccgaagtctcgaagcatgctatcaggcgtttgcggagctcggtaatgtcgccctgctttctactggaagggccctcagggcatcctgctgccttaagatttgccgttcagaggatgcttgcttcgatggggctctggcttcctggtggaagtggctaatggtagacttgcgaagcgcttggcttcacacaagatggggatcctttcagcggacccgaggggagggccttcgcgggtgagcggcgcggcttcgagtggcatgcgagcaggtcgagagtatggaggatctgaagtctgtttgccctctcttgagtggggaagctggccttccgctactttgattttgggacactaccggagagcagtttcttccagacgcactttacctgttaccagtccgctccgactactatgagcttgtgtgccccggtgtcggaaggagtggcggcacacggcctcgtccttgcactagaagaggagagcgggacccgtcggacgcacgcttgccttcggcgattcggaaaacgatatcccactcctgcgtgcggcgccgatgtcgcagtagtcatgggcaacgcgtttctacaacaaagaagtggcaaccttgtgaccgacgatgtgcatcacgtacggggtccccatgcactggcacatctgggctatgtctgagagtatgagcagaaagaaatgctaatgcagtgaagagattaacacaggatggcaagcgtgtacaagtgccgcctcatcctttccgatatggacagcacgatcctgcctaagggggcaaagaacgtgagcgcaaggacgcatgaggcattccggaaggcgctttctgcagggataaccgataggcccctcttcaggcagggccagaagctggatcgccaccgatgtgtttcgggagatgaggcgtgctgtgccacagctgtggctacgaacggcctcgagatctatctcgaaggcactgcatccatcatgaatacttcggtcacgaggtccttgcggaccttctggagtgctcgagcatcatccgggatgcgggcttctttgcttcgaggacagaaagccctatatcgtgcgtgggacacgggaagagctttctgagtcctcccggcatatgccggggccgctgagatgaaagacacgctgcccgacggagcgataagaggtgaacatattccgtactggcattacgcgtcccgagacgcagaagcttgtcggatgctctgagtagggaagcggagggactcgatttcgatctggcatttcctggttatctcaatgtcatgcctgctggttggaacaagggggcggcatcgaggtgctctgcgaggctttgggctgcacacagacgaggtcgtcgtcttcggcgatgcgaacaacgaccttacgatgttcgagccgtagagaactctgtcgcggtctcgaatgcgatgatgaggctgggcagctgcgacgtggcatatggcgcctgtacggatgacgcggtcgctgctgcgatagagaagctgagctgtggcatctggccctttcggagatagggtaatcagtggtaaaaacctctatcggctgacgctgcctgtctgtgcataaacaagagcactgtctctgcactacacttctcagacatatagctgctatattctttcgtggattctccggtagctttgagtctcaatgacaagcattacgatgcaacgcatctgatggaatgcccagtgcaatgtagaaacgctcggtgcttataaggagtggggatatggcagcagcggataccaaaggcgacctcttgcgctatctggaccatgcgaccagagagctatctcctggcaacgtaactgcgtttacgacagcacagattgcaaaagagtgtcatatcagcagaaaccttgcaagccagtatctcaatgagcttgtaagggacggctttgttgtgaaggtcggtgctcgacctcggctcttcttccatcggaggggtctggaaagatacctccagaagccgctgaagaattctgaatatgcttctgtcgaagagctccttacaactgttggctcgtcgcagaggcacgatttcgagaaactgatcggttgcgacatgagcttgggagtatgtatcgaacagctcaagagcgccatttcctatcctccgcatggtttgccggtattgttggtgggagaccatggaacaggcaaggagactctggcgcagttgagctacgagtacggtgtgaattcaggagtatttgcaccagattccaaatatataaaggtagattgctcgcgttatgaggaaaacgatagcgccgccgaaggagatattttcggaacgagaggtcatgctggcgccgtcaaagaagcgcagggtggcattgtctacctcaaccgtttcgaccatctgtcgcggacggttagtgagctcattatcaaccgaatccttgaaggtagttcgattgcttcgatgcagacgactcgttatattctctcaactgtgtgttcgctggacaatgcgaggattcaatcaatgagccgtatgttgcctattacggtacatcttccgcgctatgcggatcgtgatgtcgacgagcgtactgctctggctatgcattatttccgcgtcgaggcccgtcgtgccgctgcggatatttcgattagccggggagtgctccggacgttggtggaagcagatttcgatgagaacatcgatggtctgaaatcatgtatcgcaacctgctgtgcaagtgcctatctgaatcgtgaggatagcagacttgtcgttcgttcttataatttgccgctgcatcttttgggaggaacggaagcggaaacggatgatgaccagcttgtcaatggtgcaaagcctatgtctccgaaccttagcaagcgcatcatggcgtatttcgagagaatcgttgaattatatagctcatatgaagctggacagattgtcactgatgagcttgagcatgctctcttggagacggtgcatgcctacgaagactatctaagctttgatggacaggcctccaatgcacgtatatcagcttacgagcgggtgcttggcccgattttggaagaaataaatagtagctacagcatcgaactgactcgaaagacagcgcgaatgctggcccaggggctctctgtacaactttggggtggcacaaggcttgctcaggcaaggcgcaagagccggagtgcgctcgctcgcctgattgctacgctgcgtcaggattcgcagatggctgcgacaatagccgatcagattgcgctccgcatacgctctgcgctcggagcggatcttgatgagtgtgcgcaggttatacttctggttgaggtcatggagacgctgagcacatccactgaagtatctgattccttcggagtcattctctgtcatggttatgccactgccacaagtattgcggatgcagcgaacagattgctgcacaaacatgttttcgaagcaatagacatgacttacgatcagcagataagcgacgtggtcgcaccgctgacaagaatgctagaacgttattcatttgtacatactgtcgctatgcttgtcgatatggggtcgctatctcagattgcagacgaagtgcctggaatttcgaatggcaagctctatatcgtgaacaatgtttcaacaggtttggccctcgaagtgggcaatgcactcatgtcgcacgaaaacctcgaggatgtgctggataccgtgctacctttatgcaccccctcatttcgtgttgtcgaagcgccacacagtgaagaagcaattgcattctgctctgaagcaggtggtggtgctgctgaaaaacttcgttgtctcattcgagacagcctcccagacgagcttcctatgaggcttgtgacctgcgattatcatgaactcgagcgtctgggagataaggctccggtattttctgcatatcgagtacgagctgtggtgggaactatgaatccaggtatcgaggcagtgcctttcgttgcactcgaagatatcctatataagggatcttcggaagcactcgatcgcgcattgcgtaatatgctcggagcagagggcatagcttcgttccacaagagattgctgcgcaacgtgacgcttcgcaatgtcgtggaatcgatcactattctcaatccagagatgctctatgttgaagcagaccatgctatacagaagctctcagagctccaaggcaaatctattgatgcgcggtgccagattgctctctatgttcatctttgtggtctgatagagcgtctgattacgagaaatttcgttgatagctatccaggtgatcttggtgattttcaagcgaaacatgccgatttcattggctggttccgacagtcgtttgatgatatgtgtcacaagtataaagtgggaataccactttctgaaatagcttatgtatgccatatgctgcagaacgttcctgcagagcaagaccataatgctgatattgcggacgccattctggaggatgagtagctttccggaagagagtgctgcgacattatttctctcgattcatatgttcgattgagcctaatgcctccggcttattgcagaagtgtcgagcgatagtgtcgaatctcccagcgtttctccatggacgtgggaagccggctgtcgaaatggttgtcggaatggcgatagtaccttctagctcctttttcctggacaacattccctacagtacagatgtcaggaggggggatgacgagtccaaggggagcgcgtcgttccgaccatgtgagagaaaggagcgagatgagcattaaagcggggaggatagactaccgtttgcttcatggcatcgtgcaggggttctggtgcccaacatatgcaacgcagcgcaccatgattatcgatgacgacactgcgaatgatgaagtactcaagtctgcgatgaggatgtccaaaccctcgggccaagcactctcgatcatcacacatgagaaggcttataccaacttcaaagctggcaagtatggcaaccatacggtatttgttattgctcgtgaaccaaagactttccttgatctcattgagatgggccagaaaattccaattctcacactcggccttacagagttgccaccaaagggtacgcctggcgtccaggcaggccgtcgtgcctttatcaaggaagaagatatcccggtttatcgccgtattgttcaggctggtactcctgtcgaagtgcggtatatgacgacagacaagcctgtaccaatttcgcagtacatcgatatttaggagggtgatatcaagatggaagtaaatgctttgcagttcatcctgatcgtaatactttccggattcagagcgatggatcaatattccacgcagctcttcccgttccagcacgcactcatgtgttggctcactggcatcattctgggagatccgaatactggtcttgttgttggtggtacgattcagttgatgtctatgggcgcagctggtctgggaggctcatcagctcctgactatggcatggcgggtatggtggcaacggtgcttgcctgccttacaggaacagacgacatttcaatcggcctcgctgtaggcgttgcagtcgctatgctttacgttcagctcgacgtcatgttcaagatttacaactcctgggtcttcaaggtaatcaggggacatgccgtcaaacatgagtataacaagatgcttcgttcgttcttcctctctcatctttggctcttcctccagggcgctcttccgatggctcttgtacttgcatttggccagcaagcagtcgatgccgtgcttgcggctatgccggattggttcacgacgggccttactgttgcggcaggtattcttcctgttaccggtttcgcaatgctcctcactttcatgccggtcaacaagttctacgcctttcttatcgttggatatgttcttgcagcatatctcaagctctcggtgctccctattgctcttcttggtgttgctatcgcaatcgagtacttcagactcaagactgaaggcggcgtagccactgcagctgcatcacagaacggaggtgagctcgaagatgagtaacttcttcaagccgaaggatttcaaggatttcgatgaagcttctgcaccagtgcaacttcctgatggttcctatgagccagctctgaccaaggaagacctgaagatctgcagccaccgcatgcttttaatggacacggtctcctattcgtatgcaacacagaacgctccttgctgcgcatttgctgcatactatgcactgcggaagatctacggtaatgatcaagatgcgtttaacacggccattctcaaccagctcgattgcgtattcaatgcaacgcctcctgttagtggtcttctgttgggtgcaggtttggcgatggaggacaaaggccatcttgctggtatggcagcggagaacgaccttaagatcggccttatgggtccgctttctggcgtaggcgatgtcctgatttggattctccctatgaccattctcggctccattgcaggttatatggctatgcaggggaatccagtcggaattcttctgtgggttgctgtttgggcagtcgttctggtatggcgtcttcagaactacgtgcagggttacaatgccggcgccaaggtcatcaccagcatggctgacaagattagtgtccttactgatgcagcttcgattcttggcctcaccgttgttggatcactgatctactctgctatcactatctatacgccgctcactttcactttcggtgatgtctctctgtcgctgcagaccggtgttctcgaccagatttttccgaacctgttcgccgtgcttgctgcagcattgacgtatcacttgatcaagaagggtgttaagctcaactggatcatccttggcatcattgtcatctgctggatttgcacagcatttggcattcttggagttgctccgactgcatagcaaacccctcctctcccgcgccgggcatcaggctcggcccgagagaggctccatcagaaccagcataaaactaatgatgcgaatgaggtatagatttgcattgccggttctgatggagcaattagagattgccatgctgcatctgtggagatagatagtcagacttttgcttctgcattttctgaacctgaaagtgagcatgccttatgagacacattgtccttgcatcgcaccaccggtttgcacaaggccttgctgataccctcaattttctcgggaacaagcagcccctcgatgtcatttgcgcctatattgatgaacgccccttggcgcctcaagtggaagagctgttctccagctatggtggcgatgatgaggtgctggtgctgactgacatcttgcagggaagcgtgaaccaggagtttgctccgtacatcaacgatcacgtcttcctcgtcactggtgtcaacgtagcaacggcattggagctctgtcttacaccagaaccgttgactacggatgaaatcgaacaggtcattgatcttggcaggcagtcgatgtgtcttatcaatacgtatcagcctgccatagacgaagaggatgagtagaggtagaggagctgtcgaagatgaagatttctgaagcaatcaagctcatcaagaattactgttcgggtattgcatttgagacaggtaagcccatcgatgagaatacgacgcgcgacaagactacctatgggacggaacatctggatgatgagtgcacaggcatcgtcacctgtctctgggcaacagctgatgtgattcgtgcagcaagatctcgggacgcaaacctcattattccgcatgaggcactcttctggaatcatggcgatcatcagggcattatggcaggcaatgccacattcgaggcgaagaagaagctgcttgatgattggagcggtactgtctggcgttgccatgattacatccattccaaggtgcccattgataagaatggggctcttgctgatggaatcttctatgggttcgcctggaagatgggatggctcgactataggtgcggggatatgtcgtttggcttggactatcggattcccgcgatggctggcaaagagcttgccgcttctctcgtgaagaaactcggattgaacggaacgcgtctcattggcgatccagatgcctctgtcgaacgtgtgcacatacctatgcatgtcctcggaaattccacctctgacaatcatgagatcgagtatgtcgataagcagcatgttgatgcattggtgacgatggaattcatcgatttcacggtgagcgaatatatccgtgacgctgccctactcgatcagggaaagtgcgcgatcacggttggccatttcaatctcgaagagcccggcatggaatatatggcccattggctccctgaggcgctaggaacttcatccgtgccgatcagctttgttccgatgggcgatacctatcagtacgtgcttgcaaagaattagaggcaaacatgaatctagatcctcgtccaatagctgacagcgtgaatattcatagctttaagcaagagtataaaaaagcgggctcttcgaaacttctagggaaacgatgattaattcccaataatgtgccaaagtagaccagccatgtggccttttgcggccggcatgggcattaatcatcgtttccctagtgggcagcacgacagtgctgcattgagttcgcaggcccccaacggcagtatttccccaacaggcggttcttggtggggaagtcaaagatgaatacgcaagcaggcatgccagcacagctcttcgagcgctcgatggagccttggagaggagtggaaggtctgcgatgtctggtttaaggagcgcagggacacacccgatgagctccacgtcagggtcgcccacaagagaatccaggctgtgacgtgtgtcctgagatagatgtacttctaggcccaggtgtctgatatccaggtttaatagagcacttctttagggcagactgtggtggcagtatccgcactgaacgcattcgaaacgattgatcgtccatgtcctggtcttcctgtctacgtaatttctcccggaggtcagaatcaatcatgcacattccggcaatctgatccactgcatatcgatatcaatgtgtcctcttgacccttccggaataattgtaggctcagcagagtgcagctccttgggcagacgggacacttcgcc

SEQ ID NO: 372 - DNA, 4811 bp, Unknown
  Metagenome-assembled genome
acacgagctcgaaagcgagaataagttcctaaaaaagaggcagccttcttcgccggaagcctctgttgaaggacaggttttagctcatgctggagaagagggcaacctacagcgtctcgatgatggcgcgcgtactggaggtgagcagggctcacttctacagatggctcaaggccaaaggcggtgaggacctatggggtcccctcaaggaagccatctgcgcgatatgggaggaaagcgacaggcgctttagctttcgctaggtctgatccaagctcacaggagatccaaagttacgcaaaatttacagtgacgacccgctaccgcgtgcgcaggtgcatggctaagcttaggcatctgcggcatctgatccaatgcatcgaagagaacgatactgcccgcacctgatacccccgagcgtcccgccctcacccggcgcggcttttcgtgtcttgtgccgacagccaagctcgtgggcgatacaacctatcgcaggaccacggcaggctttatatatctcgccgtcgcacacgatctgtgcacacacatggtggtgggctgaagcatacaggacaacatgagggcagggcttgtcgtctttgccctgaagatggcatattcgcgcggatacgtggccaaaggggccatattctaagcagcccaggcagccagtacataagctcaaagctggccgcctgctcagccgtacccgacgtgaggctctccgtggggagaaccggaagctgccacgacaatgcgctcgccgaatcgcttttcgccacgctcaagaacgagtggtactaccataagcgcctcttagatgcatccacgaccaagcacaaggcacacgagtttaatcgagtcatactacaaccgcttccgcccgcataagtccataggagatcgcgtgccggcagaggtgatgcaggagttcttcgagcacctcgagaggccttgcatacgatccaaaggtgatgcagaccgcataaaaaatctgagattcctctgtccattatattgacagggttcactcctgccttccgaccgcacggcgtcgtgccggtcacggcttggagcgtctatgtcgctgcagcctcccggtcggatggcaggaaggtagcggctcgcaggggtcccgtgcgaattccaccttcgattcgagggttcccgctcggagtcagagtgaccaggctcggccacgggcttttcgtcttgctccgctgaaggcccctggcgcgcgccctgggtgccgcttcacggcggttcgacgtgcgtctgggagcccccgtgcgagggtgctcgagaaaattctatccgaggggcggatctcccgtttccttgagctccacgagcgcccagatgtcgcggcagatgcagtagcgcgcgacgtggccgtagttcgagcggtccggatggcggtagccttcggcattagtcctgatcacgggtgcgatgattcccttgtcacgcagctccgtcatgccacgcgccacctggtacttcgtgagtcccgtacgcgcgcagacctcgttgctcgacatgacgcctatcctgccgtcggaaaagatcgcatggcagagcgccgccatgaccgcccagccgttcctgccgacctgccgcgcgacgaggacgcccacgagagcatcgggcaggatcgtgaagctctgcttggcgtacagtgcgaaggtgctttccttcctcgccccacttagccctcgtctaccgacttgcataccacggcctggtccgcgaattgccgctttacgaactcgtcgcatgcgccgctgctcgtgcgccaggccttgcggatcctaaatgcccgcaactcgccgctgttgaccagcctgagcaccgtggaaagggaggcgttcaagtactccgccgcctgagccagggtgaaaatctctccctctgggcttgtccttgcttcgctcttctcctccatgggaatcctcccgtctccgttgcttctgattcgtctctagtgggcacgctatgtcagaaggcgcgcaataggcaggaatcgctgcaaattagagtggaagcgcttcaaggtgatgcgatgggggattgcgacgtctgttgaaaactcgggcggtttgagcccttctcgggccatttcttttataaaaattcaaagataagttcagaacggttgcgccagagcgcaaattcacccttagttgcttgcgctggagcgcaaaagaggtttctctgggccgcaaccatatttgcgccggggcgcatgttaataactactgcttgcgccacaccgcaaccagaagccggttttcgtggcgtttttggctactcgcgaaaaatttttggcggtaaaatgtcggtcaggttggcggtcagatgtcggtcaaaagaaaaccccgacctgttttcgcaggtcagggctgtaattttggtcgcgggggctggatttgaaccaacgacctccgggttatgagcccggcgagctaccaactgctccaccccgcaatatgcgttgcacctcagtgcaaataataaatataattgcttccttggactgagtcaaatctactacgttttctacacacttaatcatattaacataccagtcgacgtggatacattgctggtggcaggtaaatagaaaccatgcagtaaaccaaacatcactgatccatgggaatcgttctaccctcttgaatcattttacttggtattcatcgatgtacctatcctcgagatgctctaagaaagcactaataggtaaaaatgggctcttcggtagtttgtgtgggtagcccgctatagctttgcgcagctcgcatgcagaaaacacgcagtctcaagacgaacggccccgcgaggggcctccccgcaccgttttcccaaaggatttcacttcgtcaaatgcatccgatccgaagggaggaccgcgcatgggaacgattctgcactacgtcctgtcgcttgtgaagactgtcgtggtgggggccgcgataagggggactcgatagtcgtgcgggtgaggccgcacaggcgcgagcagctgcgctgtccggtgtgcgggcaccgctgcagctgccacgaccacgtgccggtgaggcggtggagggcgatggagctcgcctcctcgaggtgctaccttaagtagcgccccgcacgcgtgagctgccccgagcacgcagtgctcgtcgagcgcgtgccgtggggcaagggcggcatcgaggttcacccgcgactttaaggactgggtggcgtgccttgctgttcacagcccgctctcatggactgcaaggctggccaggatcgagtggaagagcgtgggcggcatctgcaggcgggtgtaggaggagatcgaggctgcacgcggacagggccacatcgacggcctgaggcgcaaaggcataagacgagacgagctacaagaagggccacagatacctcacggccgttgtcgaccatgatctgggatgcctcgtctgggcacacgagggatacggcaaggaggtgctgtcgcttttcctggacgggctcacacgcgagcagaaaagctcgatcgaggtcgtcacggcagacgcagcgaagtggatagaagagctggtcaggaagcgctgccccaatgcaagatgggtcatggaccccttccatgtggtcgaatggataaacgatgcgctcgaccaggtgaggcgcgacgaatggcaggcagcgcgccaggcagacaggcaggcgagggccgcaaaggcccagggcgcggcacgtgccagggagctcagggagcgtgcgcgcagcctctcggcggaggcctttcgcatcaaggggagcagctatgcgctcgcgaagaacccctaaggacctgagcgcgcggcagagggagcggctcttagagctgaagcgcgcagagggccatcttgcacgtgcatggacgctcaaggaggatcttgagggccatcttccgcgcaaaggatgcgcatgaggcacaagggctgcacgacagctggctgaaggccaccgcatactgcaggatcgcgcccgtcgtcgcagtcgagaagaaggtgaggcgcaggcgtgctgacgtgatagccgccatgaatctcgaaaccggcaacgggcgcgtcgagagtatcaacaacaagatcaaggtcaccatagccagcggatacggattttgcaacactgacaacctctgagcgctgatcatgctgcgctgccccgacctgcagcctgcgctgccctgggaggacagggccgaggagaagcggaagagggacgagcgcaagcggaaggaccgggaacgcgacaggaagaggagcaaggagagggcagacaaggcgaaggctgcctagccgagctccgggccacacaaactaccgaagactctaaaaatgactgaggacctccagcataaccgcaggagttcctgtcgcctccaaaccgtacaatgaggatgcaaggttgatgcatccgagagggcaaagaaagagatggtaaaggggcatgcaggcgctctgagtaggcgcgaatgcgagagcaaagagacattgatgggccttttgaagaggttctcagacgaggagtcgtgcgaggggaggctcctcgaggagaaggtctccggcggctttgtctgccccgtataggtaaaatgagctcatccactctatcgccgggtgtgtcagctgttatacaaaaggagtagccatgcaatacgtgattgcactcttgatcggttatgcctgcggtaacttccttaccgctgatgttgtctgccgtcacgtggttcacaagagcgtcttcgacgtaggcgttggcaatccaggcatggcaaacgtggggca

SEQ ID NO: 373 - DNA, 26454 bp, Unknown
  Metagenome-assembled genome
tgacgtggtcgccgtccacgccgaccgcgaagttcacaggcacaatgtacggcgtgccgtccgtgtcgttcagcgcgacgcggcacacgtcgcaccccttcaagacctgcacgatctcgttgaagtcagtaatctcgcggttgctcttgcgcatgcgtcctccttaggtgtcgtcgcgcacattctacggcaacccgtgccacacccgccacgcacaaggataaatgcatgaaacctgacaaataccggagtgggatcagacgaccattgcgaatttccgttcgcctcagagagcacctcggcgatggcctctaagctgtaatcttctggtagacaactggacgcaagtatcctttgcccagatgcccacccaacaccacctgtagatttaagccatgagatgtcagtgagtacaagcaaggcagaagaaggcaaagtccaagtcgaagcttcccaggcagtatatagatgagtagcacttaaaggctaccagtgctgcggcaaagccaggcaggcagacctaaagaaaagcatcagagcgtgcgccaagaagcttgagatcagcgataagaccttagatgagtgggccgtcaagtacgaaaagatcagggaagctcacctaagccagggccgaagagcaaaagaagccagataagacgttaagacgcatctcgctgttagaccataattgacctaagaagggcccaaaagtgtccgggcctttgcctacaatgtatgtcgtcaaacaaagtcatcgtggagcagagggcccggatggattcaatgatactgcagcagatcaaaaagatggggatcgccgagaaacgcgagctcttagagagactgaaggcactcatagccaagaagatggcaggctcggcacttgcgggaacacccaagaggtgcccgaggtgcaaatcactcagtttctattgcaagggccacgacgcgtgtggccttaagagatggaagtgttgctcgtgcggcaagaccttctttgtaaagacgggatctgtcctggctatgtccaagctcacggccgccacatgggccgcatatgcaaagggcacgcttgcaggcatgtcccttaagggagcttgcgaagagctgccatgtgagccttaaggacattgtggttccgtgcgcatgaggctcttcgagctgctgcaggccgctcttggcgccttcaggtatggacccaccgtctcctgccaagagaacggcctctatctcgacgaatcgcttgcaggcaacagggcaaggccggccacccagatgctgagggaggcgcacacgcacggccatgccgtgcattgctgtggcatatcgaacaagaaggtctgcgtggagtgctgcgcaaatgacctaagcgacgaatataccgtcctctgcggcaggggcaggcccgaggacgggaagctgacagatgccctttcaggtatcgtcgacagcttatgggtcgccaccgacgaccatgcaggatatacgcgcgtggctctcctcgcttggggtcttcaagcacacggcgagcttagcctcgtcaatgcgatgcagcgaaggctgcgcgagttcctgcttttcttccatggggtcttctacgaagtggctggggcacttgtcttgcctgctttctgtggatagagcaggtaaggcattctgagcgggagaagaaggatatactctcaggcaagcttgcaggaggcaggtatgtccataccaggcgtgcgctcatagacatagagcagcccttctggagctattggaaggacaggggcgtcaggtcaattatggtctaacagcgagatcgcagaatactttggcggaaccgcttagacgaggagcgctgcataatgccggacagaaatctcatcgagataggcgtgactgttgcacagatggcagtcggcatgcatctcttcgcgagcggcgttttaaggagggagcatctccttgtgaagccccttctagccggcattgccctccttcttctcctcatggcagcattcccgatctccagcgccagccccagacttgttcatccatcaggctacgatgagctggcagaagccatccttatcgctctgttctagtctttggcgctccttgcctctgccctcttcatccactccttccgggatgcagggctttggcccgccatctactgtgctgttgccggctacacgctccagaacctctcgagcggcctggcagatgccgtcgagctcgcacctaccatcgcaatcgaaattgccctctgcgccgccgtctatcttgcagcatggccgctgcttgtccgtcctgtccgcaagagcggccttgccgcctcgagcgaccaggacaccctggcccttctcgcaatgatcctctttgctgtcatcctcttcgatacggtcaacaaggagctggcaaccctttccgtgcctctttccctccttcttgccctgaagctcatccatgccatcgtctgcgtcgcccttcttatcatgggcttcgacttcctcatagccagacgctcgagagaagaggccacgctcaccgaaagcatgctggcggcggagcgacgccagtaccagctgtcgcgcgagaacatcgatgcaatcaatgtgaagtgccacgacatccgccatcagatctgccatctcgctgatggcgggagctcagtcacaaggcaggcgctcgacgagctctcccatgaggtagcggtctatgacacgcaggtcaggaccggaaacgatgcgctcgatacaatcctttcggagaaggggctcatctgcgagaggaagcagatcccgttccgctgcatcgccgatggcaacgcgctttcattcatgcagccggtggatatctatgccctcttcggaaatgccgtggaaaacgctattgaggcatcggaaagccttcccccggaccaacgcgatatctcgcttgccgtgcgaaggaccgctggtatggtatcgatccatatcgagaacaggttttctggcacggtggacttcggagcagacgggcttccctccacgacaaagcaggacaggcagaaccacgggttcggcacgcgaagcatccttctcacggttgagcgctatggcggaaccgttgctatgaagggagaggagggcgtgttccacctaaatgtcctgattccgcagccagaatagctgaattcctggatggtacgttatccagatatctgcatcatcgctcttcagcatggcacagcgccgcatgccttgatgggggatgcggcgctgcaggtgttccagacaagtgtctgcaggctagcaatcaggcaatcagcgcaaggccattcattgcgacaagagccacgcccacggcaatcaggatcagctttccgagcgaagcctcatgggcgcgtgcggcccagcccacaagcgcgaggatggctgcgctcacggcaagcacagccggcacgccgagagagagctgctttgccgcttcgacattgagcgagaccatcgtcacggcaatcgtgagcaagatccctccgatgacaggacggatatagcgcctgatggcatcgaaagccggaatcttctcgagccggtcataggcatagtaggcaaagaggaaggtgaggccggagatgccgacaccgatgccgaagccggcgactgccgtgagcagcgcagcggcgctcccccaggtctcgccgaccagatagccgacaccgacaaggaccttgcagatgatggatccaggcatggcattggataccgtcacgacctgcccatagtaggcagcgttcgagaccatgccggaatccacgaacatcccctgcccgaatgccaggtaggcatcgccgcctccgaaagacatgagcaccgagagcgccgagcgcgctgtgaactcgaatgcctgggggcagacgatgagcactggaatgatgcaggctgcgatgaaggcaagccaggcaagcgcttcatggggaagcttcttgagagagccggaatctgatctttcaagggcacccgattcatgcgcgctcgcagcgagtccccaggctgcaagagcgaccatggcagcccgcagcacatgggaaggcagagctcccaagcttgcggagaatgcacgggaggccagatatgcgccagctacagcgagtgccgctgccatgcgcagatggcctttccggccctcggcctttccccgcgtgaagagcaccgcaaagaagaaggcgcctaggacatcgagcgtcgagacccgcggaagcgtgatgctccccaagccaagctcgcctgcaatctttgcgatctttcctccgcaggtcataagaaacgaggcagcaagaagtgcggtcgagactgcacgggaacgtgtggctgcccgccttccgcggatctctcccactgcataggagatgagcacataggcgatgagcatgctcacacctaccgatgccatatgcatctgattgattgcggtggtggaagccgatgagaagagcgagatgaacacaagtgcaaggagcgctcccggaagccccatgcccacagctcctacaatcatgccggggattccggcaaccttgcgtcctacgcctgatgcaacctcgaccggaagggcaccgctcgtgatattggcgacaacgacctcgcggtcgaactcttccttcgtgatgaggccatcgcctttgacgacctcacactcgataacaggcacgagcgcattgcctccgccaaagcctatgaggcctatccttgccatagacgcaaacagcttcccgcacttggcaatacggcccgagcgcgcacagacctcgcacgctactgtcgagatgtcatatgcggtatccacgcgcaccacgctcctcaggtatccaaagctgcagcgtcccgactgcgcccatcccctgcttcaagactgcatggctggtctggcgctttctttaaaggtaatcgcgccggtaggattaaagaagacaccggatccccgacgctagcgttcgtcctgggcgaaccttgcaggattcagtggcagtaagctcctggcatctcttgaggaagctgccaggaccgcatgccttcattgcatgcggccctggccgtagtgcatattgaactactcaaaggcttggaatcatgctgaggccttcggcagcgacagggcaatgatggaaggctactcttcagactcagcaggcagcttgcccagcgcctggtcgaaatcggcaatgaggtcctcgcagtcttcgatgccgacgctgacgcgtaccaggtcgtcatacaccccggatgcaagctgggctgccctgtcaaggtgcgccgcaatcgtcgttgccggatggacggcgagggtgcgcgcatcgccgatgttcgagacaatcgatacgaggtcaaggctgtcaagcatggcaaatgcccgcttcctgcttccgagcctgagcgtgaggatgccgccatacctgtctttgaactgccttttggcaagctcatggcccccatgggaagaaaggtccggatagcgcacctggagctccggtacctcgccagaggatgcaagctcatcgagatgggctgcgagcctgagcgcattgctgcagatgcggtccatgcgcagatcgagcgtctcgacacctatctgcatatagaaggccgtctgtggcgccattgcagcaccgagcgcagggctgacatcgcttctgaggctcgggaggatagcgagcttgccaaagcggctgaactttgccagggcaggatagcgctcgaagtcccaggtgaagcgccctgagaccgtgagcgtgcctccaatagagtctgagaagccattgatgtatttgctcgtggaatgcacgacgaggtcggcaccaagaccgatggacctcacgaggcacggcgtcgcgaccgtattgtcgatgaggaggggcacggcgtgcccgtgtgccacacgggcgattccctcgatatccgcaacatcgagacgcgggttttctatcgtctcgacatatgccaccttggcgcgaggagctgcctcctcgagagcggcagcgaagtcgtctggagcagagctcttcgcgaagcggacctcgacgccgagacggtcaagcaggaagagcagttcgaccgtgcctccatagagcgcagacgctgccacgatcacatcccccgcctggacgagggtcatgaaggctgccgtaagcgcacccatgcccgaggcataggccacggtcgctgctccaccctcgagctggttcactgtacgctcgaaggcggcaacggtcggattggcaacacgcgaatccaggcttcctgttggcaaagacctcagcctactcctctgtactcgcaaacgagaatgcgctcacctgcgctatctcaggaagcgtcgccctgcttgcattgggcggtgcccctgctggatgcaggatccgcgtcgtgaggccctgctttctgggcattcctccggtcatagcgaagcgcccagatcggccgcggcatcggaagcgctcatgcggcgcacataatccgcaatggcggcaggatctgttccgacctccgcctgccatccacggaacacgaggttgtccgagcgccttggcagcgcatcgtgcacttcaggcgcaagcgccagaaggacggtcacgccggcacggttgagatgtgccacgacctctgccggatgagattcggggccaggctgatagagataggcgtccaacccctcggcgacaaggcggtgctcgatatccttcacctggtcgagcgtgaaagtgccgctctctgtatcagctgctgcgccagatgcaagcgggaactcgacggttatgccggcatggcccttgagcaccatgcggaggtggctgtctgccgaagatccttgccctgcatcctgatcgtcgacacgctccacgacaccgcaggcgcttgtcgcgttcgtgatgcggtcgatcaagatcagctcgcccatcgtgcgatggcgcttgaactcgtccacgacgataggctccgtgaaggcgagctgcacgaccgcaatctcgttcttcgagagcctgtcagccttcttgcgctcgccggtattcacatcgatggcatagaggatgctcgtgagggcgccggggatctccttcgtaccaaggagcacatagaagtcgcggcccaaagagagcggcttgtcatccatccacaggacagtcgccagcacggaagaggcgaccttgagccctgccccgcgctccaggacacagccgcgcgacacgtcaacctctcgatcgagctggatcgtggctggatctccgaagctggccttttccgcagggctgcctgccaccaggatgctcttcacatgtgcatgctcgccgctcggcagcactgtcagctcgtccccgacagaaacctcgtcggcctccacctggccctggaagccacggaacgtatggtcaggacggctcacgcgctgcactggcagatagaagccctctccgagagatccggtgtctgcatcgaccgtctcgagatagccaaggagcggcagtccctcataccagggcgtattctcggagcgtgtcgtgatattgtcgccttcggtggcacttaccggaatgagcgtgacatgcgcaagccccagctcatgcgcaagctcatgcacttcctgctcgatctcgtggaaggtctcctcggagtagccgacaagatccatcttgttgatcgcaaagacaaagctgcggatgccgacgagcgcacagatgcgggcatggcggcgggtctgcggaagaagccccttcgaggcgtcaacgaggatgacggcgaggtcggcgaagcttgcaccgactgccatgttgcgcgtgtactcctcatggcccggcgtatcggcgacgatgaagctgcggcggtcggtcgtgaagtagcggtaggcgacatcgatcgtgatgccctgctcgcgctcggcagaaaggccatcgagcagaagcgagtagtcgatggcgccgccacggcttccgaccttggagtcgagctccagagcgcgtgcctggtcggcatagatgagcttcgaatcgtacagcagatgcccgatcagcgtcgactttccgtcatcgaccgagccgcaggtgatgaacttcaaaagatccctcatcagaaatatccctccagcttgcgacgttccatgcttgcagagccgccgtccttgtcgatgacacgggtcgtgcgctcgctctccacggctgcgagcgtctcgtcgatgatctcgtcgagcgtcgatgcggtgctttccgtggcgcccgtgagcggatagcagccgagcgtgcggaagcgcaccgaacgtatctctggcttctcgcccggcttgaagcggaagcggtcgtcgtcgaccatgatcagctgtccgtcacgctccacgaccggacgcttggctgcaaagtacagcggcacgatatcgatgttctcctggcggatgtagagccagatatccttctcggtccagttggagatcgggaatacgcggatcgattcgcccttgttgatatgggcgttatagagcttccacatctcaggacgctggttcttgggatcccaggcctgctgcgcattgcggaagctgaatatgcgctccttggcgcgcgacttttcctcgtcgcgcctgccgccgccgaaggccgctgtgaagccgccttcgcgcagagcctgccgcagcgcctgggtcttcatgatgtcagtgtaggcgctgccgttgtcgaaggggtttatgccctgggcgacgccttcctggttgatgtactcgatgaggtccaggccatagcggcgcatcacgcggtcacggaactcgatcatctcatggaacttccaggtggtattcacatggaggaaggggaagggcggcttctccggatagaacgccttgagggccaggtgcagcataacgctcgaatccttgccgatcgaatagagcatcaccggcttctcgcactgcgctgccacttcgcggatgatgtagatggcttccgcctcgagcgcatccaggtggggcgagcgctcggcatcgggcttgcgagcgatgtccttgcggatgttctccagctcctcctcgcgtgtcagcggacgctcgtcggcgcgtccctgctcttctgtcatcgtgccttcctctccttgcacgtatctcctacggcttcatcgatatcccgcagggtctccgtgcgcaatgcatagtcaccgatacgtcttgcttgcgcccctgtcatgtgtctgctcagtacgcgttggcctgtcctgaatcgacgtctatctcatcgatgctgtcgtcgggatgcacaaagctccagctgctgtgcgttcccgaacgcttcacatgaagtgttgtgcctctgcctcctgcgtcagctccgagaaagtaggcaatggctccagcaggacaggccttgaggcaggccgtgcagccccagcagtcacgcggcctgcgcatccatgcaagtccatcttcatcgagcttgatgaggttgccggggcagacgcggacgcaggcgccgcagcccacgcatgctgccttatcgatcgaaatgctcaagatgctcgcctcttttcaccagcggacgcgtgaaggtctcgatgtgcccgtctctcatgcgcgaattcacatagcaggcaaacgactggtcagttcctggatggtccacattctccgcgaatgcatgccagcgtgtctcgcggcgcgcaccaagatgtgcaatgagggcgcggcagacgacaagtcgttcgcgcagctcgtagatgcgcagaagatcgtccgtgtccttggcgccaaggccatcaacgagcggacccaagctctccgtctgacgcttcgcctgggcaagcccggcttcggtatagcgatagcccgaggaaattcctcctgcatagcggtccatcgccgtctgcatggcctcctcgagctggtcggcatcgaagagggccgccaccgcaggatctccgcctgcaagatggtattcatagccgcagacgatatgatcggcctggggcgacagggcatcgtctcccgccggctctctcttggcggcatgcgcttcgaggtaggcaagggtgctctcagctgcaatctggccttcggccaaggcgccggtcacatatttctgcggagcgcctccggcaacgtcacctgccgcaaagaggcctggcagcgtcgttgcacggctctcgtcgatccagtagccgcttgcggtgtggccgcctacgacatagggctctgttccctcgatctcgacatctacctcgtcgggaccggtgcctgcttccatccagcgcagcgtctgcgcgggagacatgttgagataggcatgatagaactcgcgctcggcctcttttccgatgcctttcgtcctgagcacgcagggaccccggccttgaagcgtctcctcgacggttccccagacgcgctcgctcgtgcgcagcccatatttgttctcatagacctcgcccagagcattgacctgcggtgcatggacgccctgcgcaatcgtgcccgtaggtgcaatcgtatctttgcacctcagcgcaatgaagcgcatctcgaatgtcgtcatctcggcgcctgcagcaagccccattgcatagccagctccggtatcgaacgggcagtaccacatcttgtggcggctgaagccaggattgttcggacggtagaggccggaagccccaccggtcgacatgatgacggcacgggcatggagctcataggcgacatcagacgtggccgagaagccgacggcacctgcgaccttcccatcctctacgagaaggtctgtcacatcgacgtgctcgagcacctgcacattgggctggcggcgcgcagcacgggcgagcaggggctttatgttctcgccgttgatcttcacattgcgtgtcccgcgttctgcatagctgccgtcaggattgcgcagatatacgaggccttcatcttcaagcgcatgggcgcagtcattgagccgctcagacatcgagatcaggagatcccagcgcgcaatgccgcccgcatcgtccattgcatagtcggcatagaactcaggcgtacggcccttcgtgatgtaggcattgattgcattgacgcctgctgccaggcatcccgagcgctcgatgcctgccttgtccacgacgacgacatccacctcgggatgggcacccaacgtgcgtgcagcgaaacagcctgccgtgccgccacctatgacaaggacgtctgtatcgattctgacgcgccgcatcctgccgcctctcatctgacccgcgcgagggcgcaggtaaatctgcttcgttacaagacattaaagggatgtcgttagggcatgtaaacaatccggcagtgtcaaagtttccaacagtagcgttcgcttttacctatatagctatttttcaggcattttgctgatccatagcgctctctgtccagtgagcgccgccagcggccacgttgcagagaggcgtcaaaacaatacgatggaaacatatgaaagcaggcagaggaggtctccattgcagctccagcagctccgatatctgatcacgaccgcggagtgcggatcggtacgcgcagcggcccaaaagctctatctgtcgcagtcgagcctctccgttgctatccgcgatctcgaacgcgagctgggaatcacgatcttccaaaggacaagccgcggtgtcagccccaccgatgaggggctcgaagcgatcagctacgcgcgccagatcgtggaccaggcagacctcatgctgtcgcgcttcgccgagaatggcgaatccgaagtgcgcttcgcagtatcctcacaacactacgaggtcgttgtcgaggccttcggcgacctgctcgatgcccatgccgaacgcgcctgccgcctgacgctgagcgagacgagcaccatccaggtgatccgcgatgtccatgaccacaggagctcagtgggcgtcatctacctcaacgactacaacaggcatgtggtcgggcgttcgatcgaatcgaatggcctcgaattcaggccgctgttcatcgcacgtccgcatgtgttcgtccgtgccgatagcgagctggcgaagaaggcaagcatcaggcctgaggagctatctgcaatgacgcgcttcgcgcatctgcagggcactgagggctcggcctacttcgcagaagagccgctggccgacctcccctgccacagccatgtcgcgctcagcgacaacggatctctggcacggctgctttccgagcatgatggatacaacatcgcgacaggcatctacccatctgaccggggcatcgtgccggtgccgctcgagactgacgagatcatgaaggtcggctatctcatccgccaggacgctgcggcagatgccctcagagaggagttcctcgatctcctctgcgcccactgcgcttcgcacgaacctatgatcaagccctgcgacgaggtgctcgaaaggaccggacgccttcaggcctgatatgccatgcatctgccaataccagaggcctgatagtacgaggcacattgcagagagcatggctggacagtctatgaggcgagcgtccggttgcagggatctatggcctactggcggaaagtggcttctcaaaatatatggctcagtcctaattcctgtgggtacccccatcacgacgtcacgacttagctctggaagacttcgggtagcgcctgctggtaatcgaatatcttgaggaagaagtactcgtcgttagggtatccctagcctgccctcctgagcgtcttgatcatctggttggtgccttccaccctacccgaagagatccggtgcctggcatgcgcgacgattccctccatgtggctctccacgaggcgggcgaaccactcgaagtgcctgtctttcgtgccgcggcagacctccacgatcctctctatggcagcgcgtatcgcatccgcatcggtgcacgaataggcctgcgcgagcatctcatctacgatgtcgcaggcggagagcagctcgctttgggatatgagctcctcgtagcgcttcctggcgcctcccctctgcagggcctcctgcttgccgaagagggcgcttccccttaagaccaccttgccggcgcgtgcatcgcgctccttcctcttcctggtgtccgcacaggacttaaggatgtatgtggagcgcttgagggaccttgctccttaagtcttgcctgcttatccttcctgaccttacagatcaccttctcgttgaagttcttcacgatatggaagtactcgtagacgatgtccaggtgcgggaacctctcgaggaatgcgcactcgaagtctgcgttcatgtcgcaggcgatggcctccacattggatatccactcagcgagcacaaagtcacagaattcatgcacgacctgctccttcttggaatgagcgagctacagcacatggcccatcttaaggtcgatgatcacggtggcatatctgtgcctgttgtgcagcttgaacgtatctgcgcccagataccttgcctaccgctcgggcttccggagtctggtctcgccgtcctcgctcttctccgtatagagcgcagcgagcctcttcttgtcgatctttttcaccacattcctgttgagccctatcatgagggacactgccttaagggtctgacccagggcaagcaggtcacacacgaatgcgagcagcaacagcgtgatgcgctggcctgaagccctgaagggcacctcttccgtgagggtgctcccgcactccctgcatgctcatcttggtcgcaagatctttatcctcgcccttcccatccccagaggaggtgccgaagcgcaatggggaccctaccgtttttctccatcgcctttccgcagcaagggcagcatggtgcatccgacactgccggcctgcccgggaccgtgaggatctgcaccgccttcctgcatcttttggtcgacgtgccgaactcctcggtgcacacgccctctctgggctttcccgtctgcacgaagccatccagatgcgaggggatctggatgaagccaggagcggcagcctcatcggtatgggaaatggcggacagctgggctgccgtggacgctatacttgtcagcgcgctccatccttgttcggagtctacatgttgcgatgcaagattctagaggatggccgcatttctgtctctttgagcatcaagccatgggcatcggcccacagcttttaggattgaaccgttctatagtagagatagagtgccgtttcgcagctggatacttcaacgctcagctgtatggcatattggccttcagcacggacgataaggatgaagcatcatttctgcatgattcaggaagagtctctatcattctgcattgcatcggacttgcatcgcttctcttcgcgctatcatcatcccaatccagaatgtcccagcagattggatgcagtatgtgcgagctctttgcaatcaactcgggcaggcccgtcgccgccaatgcatatctgaaagagtttttcgaccacagccatgacaacccgcatggctggggcttgacacggagagagtgcggcaacgatatccatgatcccgaggctgaagtgaagctgtagcgcgagcctgttgctgcctatgagtcggcgctcctgccgaagctcctggctcgccctatcgaggcctgccgtcacgaagcgcatatccgcttctccacaggcggagagcagtgcgccgagaactgccatcccttccgaggctcagacatatcgggccgcgaatggacgctcatccacaatggcatcctcttcaacgaagagcttcctgccggctatgaccgccgcgagcagggcgagacggacagcgagcgcacgatgctctttctgcttgacgtcctcgacgaagcagccttgcgtgcgggaggcgcgctcgatttcgagggaaccttcaatgcccttgcaggcgctctttcgcagatccccaacctcaaccgcctgaacctcatcatggatgacagctcctatacttacgtgcacacgaatacctccgaagacacactgcacttccgccagctggcagatgacgctatcgtcttctcgaccaagcctcttagaggagaagcggagaaggcgctctggaagcccgtgccgaggaaccgcctcatcgcctaccacgatgggcatctcgttcgcacatccgtgcctcacggctataccttctgcgaagccatcctcgatctgcgcaggaagttcggcgatgcgtggcctgaggtgcttgcgtcgtagatgccgggaagtgctcaatgcgtcgtgacggctaccatctggatgtcattgccagcctcatctttccctatgctctccccgtccacgatgaccgtgtccgccctggactccgaggggaagaagaagccagatccggaagcccatcgatggtgatagcatcagctgaatcaggctcgacctcatctgacgcaagatgaatgacgcagaagtcataggcgacatcctcttcgctcaccggcaaaacagatacgctgccgctcagccttgctgccacgcctgagacaaccttgctcgtgccagatatcgcaggcacaaggatagccgcagccagaagcagcgttccccatttccagatgcttcgccagggcagatctttccgtctcagaaccggcaggaacaatctcatcagcgggatagcgatgatgaggccaattcccagaagcacggctgcttccaagatcatgaagccgttcgcttcaaggcattcctggctggcaagctgcatggcatgggcggaaagctgcatgaaaacctccgcgtcgcggctgcctggatccatccgggcacgacgataccaaggtatctgaaatgattgtatgcgcggatttcgcaattcatcgccttgcggcaacaggcctgacaatttcattgcactcctgcgcccccatccagcgcaagcatgctctgacctgaaccgtctctctgcagtccctcatgccacacgccgaaatgggaatcagcgtttctgaaatagataagcgggttgcctatcataaggtcagatgcacagagcagcgattcagctgagagcagcaaggcacctcgattcatcggaagaaggcatgaactatctgcatggtgcaagagcgcatgcatccctagggctgcttcagccagaaggccgcaggtggaaagatggcacagaagacaggagcgttcgattcccgagatgtcctatcccttatagccgcaattctctcggtcatcgtcttcgcatgcttctggcagttcagggaagcccatgcgagcctcccctacgccctctatcagtatatggtccgtcccgtagcggcaatctccattccgttcttcatctcaagccacttccgcatcattaggcttcccaggagggccctgttcatcctgaaggcagtttgctgcgtgcttggtatcgcctatatcctcctcgtagccatcctgctgaaagccggcggcgatacgcttcttgacctcatcatggcagcgtatgcctacattccggtatatgtaccctatcttgcagcgtcttcaggcctgatcctgggcgcaagacagaacattcccgattaggcattgcagatgcacagagccattacgcaagcccagcatcgggtacgtcatccttgcctgctgctgacctgccaatgcctgccagcaactctgtgcatgcaggagaggcactaggaacgcagagcacgactgtcattcctccgacgaagctgtacatgagctccaatgccatagagccagatgagagggaccgtgccgtatcgacgccgtatgccatgagcaccagaaccggaggcatgccggagccgtcagccaatatcagagaaatgaaaagcgccagcttcaggacttcagctgtcaaccatttacgtctggatagagatccattcagagacagccgcctatgccgattcctgcagcgacttatctaagcggttaaaagcctgttatcagattgaagtctcgctttagatgtgcaatttatgaaagtagcatgcattcagtactgtttagcgctttcaaggctggctgaactcccgaagagagatgcatgccccaagaagagcgcaccgacaataaggaggctgtcagcatgaccactaacatcacgcgtcgtgatgctctctcgctgtttggaggcgctgcagcttttgcagcgctgggaggactcgctgcatgctcgggcgcgagcggtgagaagaagtacaagatcggcgtccttcagctcacggaacatgacgcactcgatgcagcgaacgctggctttgtccaggctctggatgattcaggcatctcctacacgatcgaccagcagaatgcccagaacgaccagtctgcctgccagaccattgcacagaagctcgtgaacgacggcgatgaccttatcctcgcaatcgccacccctgccgcccaggctgtggcaggtgccacgaccgagattcccatcgtcggcacggcaatcaccgacttcgccgcctccggactcgtcgcctcaaatgatgctcctggcggcaatgtgacgggcacttccgacctcacgccggtggcagagcagttcgaccttctcatgcagctccttcccaatgccaagacggtcggcgtactctactgcaccgccgaatccaactccgacgtccaggtacagatggcagaggcggctgcgaaggagcgcaatctcaccgtgacgcgctactccgtatcgaactcgaacgagatacagcaggtcgtcgaatccatggtcggcaaggtcgatgcctgctatgcaccgaccgacaacaccatcgctgccggcatggcaacggtctctatggttgcaaacgagaacaagcttcccgtcatctgtggcgagaagggcatggtcgacaacggcggcctcgccacctacggcatcgactacaacaagctcggctacaaggctggcgagatggccgtcaagatcctgaagggcgagtccaaaccggcagacatgcctatcgagacgctcgacgccagcgagtgcaccctcaccacaaatgaggagacggcaaaggcagtcggcatcgatctctctgttatccagtaggggattgtgatacgggcacggtaggtattggcctgccccatacattcccaatcgattcgtacccggcgaccattgccgggcacgcttttggaaaaggaggaaactcaatgcttctagctctatccggggccgtgtaccagggcatcctctggggcatcatggtcctgggtgtcttcatcacctacaagatgctcgatatcgcagacctgaccgtcgacggcagctttgcacttggcggctgcgttgccgccaccgcatccgtcaccttgggtctcgatcctcttgtcgctatccttctgggcacccttgccggtgtcatcgcaggagctgtcaccggccttctgcacacgctcttcgatattcctgccatcctcgcgggaatccttacgcagattgctctctggtctatcaacctgcgcatcatgggcaagtccaatgtgccgctcctgaatgtcgatacggtcttcacgcgtctttcctcgcttctgggcgtctcccagagcgttgcttccttcattgtcggcatcattgtcgccgtgctctgcatcgtccttctgtactggttcttcggcacagaaatcggctcagcgctgcgtgcaaccggccagaacgagcatatgtgccgcgccctcggaatcgatgtccgtgtgacgaagctcattgccctcatgatttcgaacggccttgtcggcctttccggcgcttttgtctgccagagccagaagtacgctgatatcaatatgggcacgggcgccatcgttatcggtcttgccgccatcgttatcggcgaggtcctgggacgcctcaccccgggcaagctccaggcattcggcagccgcctgacctctgctgtcgtcggctctgtcgtctatttcctgatccgtgcaatcgtcctccagatgggcatggatgcgaacgatatgaagctcttctctgccatcatcgtcgcccttgcccttgtcattcctgtcatcctggagcgcaggcagcagcgccttgcctacaagaagggaggcgagtgctgatgctcaagctcacgaatgtcacgaagaccttcaacaaaggaacgttgaacgagaagccggctctgcgcggcgtgaacctcgatcttgctgacggcgacttcgtcaccgtgatcggcggcaatggcgctggcaagtcgacacttctgaatatcgttgcaggcgtcttcccgcctggcggaggcacgatcgagctcgacggcaagaatgtctcgcgcctgcccgaatacaagcgcgcagcagatctgggacgtgtcttccagaaccccatgcgcggcacggctgccgatatgcagatcgacgagaacctggctctcgcagcacggcgcggacagcaccgcggactcgcctggggcatcacgaaggaagagcgtgaaagctatgtcgaccgcctgaaggagctcgaccttggcctcgagacgcgtctgacctcaaaggtgggactgctttctggcggccagcgccaggcgctgacgcttctcatggcagtgctcaagaagccgaaacttctgcttctcgacgagcatacggctgccctcgatcccaagacagctgccaaggtcgtctcgctcacccagaagctcgtcgacgagaatgggcttaccaccctcatggtcacgcacaacatgcacgatgccatcaggcttggcaacaggctcatcatgatgcatgacggccagatcatctacgacgtgcatggcacggagaaggcaaagctcaaggtggcagacttgctgaagaagtttgaggaggtctcgggcggcgagcttgcaaacgaccgcatgctcctctcgtagaggcatcttcgcttcctggagccataaggatcccctctcgcattcactgagtcgcgggaggggatttttgattgcttgtcttgagacatctcagaggcaggaagtccaggagcgcaatgttgcgctgcagcagtgccagctagctgttctgctgctgcgactgctcatactcttcctgtttccccgatctccagagctgatcgagctcttctgcagaacacgcatccagggcttgtctgaaacctttgccgctctctccatcgaagcccagcggctgtggaactgtcggttcgcgaatgccagggcagcctctgcatcgatatgctccttgcgtgcaacattgacaagagagaagaggacgtcgccaacctcttcgaaggcacgctcggagccggatggctctgtcttaaactcccccacttcctcatgggccttgccccagacatctgatgtggtctgccagtcgaagccgaccttggcagtacgcttcgagatcttctgggcctgcatgagagcgggaagcgagatgggcacagagtccagaagtcccggctcctcgcccgacttcttgcctttcgaaatacgctcttcgcgcttcacctggtcccagatgtccggcacgtctgcaacatccgtttgagccggaacaggtttctccccttctggagtgccgaatacatggggatggcggcgaatcagcttgcggttgaggtcccggcagacgtcgtggatatcgaaggaaccttcgtctgccgctatctgtgcatgaagcagcacctgcatgagtacatctccgagctcctcgcgcagattggcatcatcttgctcatgagttgcgtctacggcttcgtaggcttcctcgatcatgttcttcgctatgctctcatgcgtctgggccttgtcccaagggcacccgtcaggttgcctcaggcgccagatggtacggacaagctcctcgaactcaggctgcgtttcaggcgagccttctcgttcgtgggtcagtgcatccacgctgctgcagagcacatccagcctgtccgcttgatcggtacggatatcattcgtttcttcgcaggtggctctgtgtccagcaccggtgctaccatttcgatctttgctcatgagtccgcctttcttcccgcctctgtcgtcatcatacgtcggctctggttcctgtctgcctgcatcaaccacgatattgcatagcccagagagatggagccgcatctgcatgtctgattctgcgcatcgtttgcgcagatgaaatgcaggctagcgtatgatgttcagatgcaattccgatacactcataaggcaggatgtatggcaaacgataatatccgcatcttcgacctgcattgcgatacgctggacagtctgtccatgcacggtatcaagcccttctcacagcatctttcaccagtccaagaaggagacgacctgcttcataacggcatacagctctcgctcgagcgcatgttccaggctggcagctggtgccaatgctttgctgtctgggtgccagacgatctctcccaggcagggatgacgccccacgagttctacgccgaggtctctgcatatttcagaagccagctcgaagcgcatgccgataaaatcagacagatacgcgatgccaggaaggtggaagacgccttttcaggaggacgtgttgccgcgatgctcacggtcgagaatgcctcgccgctcgaagacgggcttgccgtcctcgacgagatgcatgccgacggcgtgaagatgattacgctgacctggaatggccagaactgcataggctctggcaacctcacagcagaaggcctcacgggctatggcatcaaggcgctacaccgcatggaagagttccatatcgtggccgacgtctcgcatctgaacgatgccggcttcaaggatgtggtcgcacatgccgcaaggcccttcgtggcatcccattccaacagccgtgccatctgcggacatccccgcaacctcacggactgggagttcgaggccatccgagaccttggtggccttgtcggcatcaactactaccgttctttcattgcggaccgcttcaacgagggcaatggtgcagacgatagccaggctgatgtcacattcgacgagctgagctaccatatcgaccatttcctggagctgggcggggaacgcatcatcgcgcttggcagcaatttcgatggatcggctacgccgtcctggctctcgggtgcctctgacatgcccgccttccgcaccatggtggccaagcgcttcggagaagacatcgcagagggcatgttcttccgcaacgctgccgatttcttcgcacgcaacgaggagagctagctcgagcggagcagcatgaaccggcctcatccacatccatctctgcgcttgcttgccaagacgccgccgaggagcaggctgtcgatgcccaagcacgatggagcagatgcctttcacacgcaggacaggatgccgtcgggcgatatgccatcaatggaacggatctgctcgacgcttcgcgcctacacttatgccagttgagcgtatggcacgctcattcatgctgctcgtcgaaaggggttctcatgaagattgcaatggcaaatgaccatgcaggaacagacctcaagaatcagatcaagaagtggctcgagtccgaaggacatgaggtggtggatttcggtacctatgaccatgagtcatgcgacctctccgacttcgtccttcctgccgcgctcagcgtcgcgaagggcgaatgcaaccgtggcatctttgtcgacggcgtcggctatggatctgccatgatagcgaacaaggtacgtggcatattcgcctgtgtctgccaggatcctgtctgcgccgagctggcacgccagcacaacgatgcgaatgttctctgcctgggcggcaagatcatcggaccggtgctggcaatggcaatagcgaagacatggatggcaactgagccgctggctgccgagaagtatgtccgcaggcgtgacaaggtagccaagatcgacgaggactataccaagcctctggaatagcagctctccagaaagacgctgatgtgagagaagaagtggagctgatgatggagagcaggagcgcttatgtgccaggcacggcagaatgcgccttctttaaaggccatgaagaggctctgcctctctatgcagcattcatgcagcagacacaggcagcgcttcctgagttcggcatccgtgtccagaagacccagatcacgctctgcaaccggcatgtcttcagctgcgtctcgtttctccgcgttcgtccaaaagcgctaatgcccgcgtcattcttcacgctgacattcggcctcgaacatccgctcgaatcggcgcgcatcgatgcgaaagtcgaagcatatcgaaacagatggacccaccatgtagttctgagcgatgcaggacagatcgacgaagagctgctttcatggctgagagaggcatacgatttcgctcagcagaagaggtaggggctgcatcttgcttcgctcttcccagttcagcaaggaaatctcgcagtgtgccagtcactattcgttcaaagagagacagcggccgcgaaggcgccgccgtctcctgtgttcctgtgttaatcgtccatatcgagcagaaccttgatgttatggtaggacttcaccgctgcatgctccatagcggtcgggaactcatcgagcgggaactttacggtgacaatctcacgtctcgctgttagaccataattgacctgacgcccctgtccttccaatagctccagaagggctgctctatgtctatgagcgcacgcctggtatggacatacctgccttctgcaagcttgcctgagagcgtatccttcttcttccgctgcgaatgccttacctgctctatccacaaaaagcaggcaagacaagtgccccagccacttcgtagaagaccccatggaagaaaagcaggaactcgcgcagccttcgctgcatcgcattgacgaggctaagctcgccgtgtgcttgaagaccccaagcgaggagagccacgcgcgcatatcctgcatggtcgtcgctggcgacccataagctgtcgacgatacctgaaagggcatctgtgagcttttcgtccgtaggcctgcccctgccgcagaggatggcatattcgtctcctaggtcatacgcgcagcactccacgcagaccttcttgttcgatatgccacagcaatgcactacatggccgtgcgtgtgcgcctccctcagcatctggatgttgggccttgccctgttgcctgtaagcgactcgtcgatgtagatcccaatcttttggcaggagacggtgggtccatacctgaaggtgccaagcactgcctgcatcacctcgaagagcctcatgtgcatgaaaccacaatgtccttaaggctcacatggcagctcttcgcaagctcccttaagggacatgcctacaagcgtgccctttgcatatgcggcccatgtggcggctgtgggcttggacatggccaggacagatcttgtctttacaaagaaggtcttgccgcacgagcaacacttccatctcttaaggccacacgcgtcgtggcccttgcaatagaaactgagtgatttgcacctcgggcacctcttgggtgttcccgcaagtgcagagcctgccatcttcttggctatgagcgccttcagtctctctccaggagctcgcgcttctcggcgatccccatctttttgatctgctgcagtatcattggatccatccgggccctttgatcctcgatgtctttgtttgacgacatgcattgtaggcaaaggcccggacacttttgggcccttcttaggtcaattatggtctaacagcgagtttcaaaaagaaagcagggccagaatgcggagaaggcgctgcagcctgaagctgcagtgcctttagtgaacaggtataggagacccttactcgttatctccaccagttgccttccgtagccgataagggcagcaccgtgtcttcgtgcatttcggccacaccacgctccgtgaaggcagggtggtccgttagccccctattaccacagcgaactgcaatgccatcctgacggaattctaccatctgcccgaatctgggttgcccacttctcggcatccaggatcatcagcgactgccggcaagagcccagccggtccatgtggttcaaggcggaagcctatcaagatagggtgtcgtgcgtggagccgtactctcatagccatgcacgctagaattctgtcatggttcggacggtgataccagatcccaggcgatgaatcgtgtcaggataggcatggaaggcaaagagcaactgggacggtccgtgtgaaagctctgcgaaatcgtcgtcggagagtgcctcgcctgcgtgtccactgttcgcccttgcgaccgttcggatcttacagaaaaaaggggggccctcggacgacgtcacgctccgacacgaaccttcacgcggaggcaatcggaagctcggttgcagcaagtatctactgccccgctccccgccaacatccctcgcaagcaacacccccgaggacgatctcaggctcgggccccggcttggccgtggatgcccaattccactcggcagccacccttcttgagctcctcgcgtgcatcttgcgagcgagagccacgttagcctaggtgttttgccgcgaagatgccattgatgcagttcgtggactggttagcagcgctctgccatcaggatgcgcagacaatgttagcatctgccgagatagtagatttctttttgttcacaacatggtcgttggtcccgcataccttgttgagcaggccacaccacgaagcccggatcctggtgggagaagccattgtggtcctggcgccacccctgacatggctcgaaagcagcatgtgaggccggcagatcggctttctccatgggaccctgtgcgcgcacggttgcccgagccacttgtgtgcatgttggttcaccatggagtgcgacgatgtgtaacgaaggtttagtaggaagaccagaggccatgggcgcccggtcaggaggatagccctcgagcaggccttcgcactggtgctcggagagatgctcgataacattgacgacaggagcgaggtggtcgtacgtttgcacggatccgtccgttgagggtcgcccgttgaaccactgtgtccgtcacctggtaactcggatgcaggcggttcgaagccccgtctcgtccggaccgaagatacggaagcgatacggttgttatggataagctcggcggtgtactcgcccatgcactgtgggtcgactcggtcgccctgcaccatgccttcttgcttcacgtcgaaggcgtagtcctttccttcggaaggacaagcggcttacctgatgacgtccgccatggcattgggttcgcgccgatcctgagttgccttctggcaatgaactcctgacctcggtaacggttgaacctttccggcgttgaagaggccagagggatcataggattcgagcaagcccttgaggaccggaagttgtttgcctcggtatcgcgggcagatgcagcgggcacctgattcatgcctcatt

SEQ ID NO: 374 - DNA, 8030 bp, Unknown
  Metagenome-assembled genome
gatcagctccaccgcatgctggacctcctcgtccgtaaccttgccgaagtcggtgcccttagggaaacgatgattaatgccccataacgtgttagaggggaccggccacatgacttttttgggccggtatgcgggaaaggcagaaaaggttgcccatccagcacgtgcagaagtcgctatccttacatctgtcctgccccatgcaccgcaagaaggctccaagacggatcaagcgactctgggagccgggaggtgcagcctgccggcaaaagatgcacatgggtaaggtttgcaaggacgagaaagactcgagtgtgcaggcatcttctctatccttctgtagcgcttccttaaggggtcgaagcgccgcttcacgataaagaagggtgcttctgcctttgagcagccggatgccttcctggactctatgcccttctcggacaagagtgcacaggtaagaccctctctagtcgaaggcttccttgcaacgctttagcgcatagatgagaggtgtgggtctttatgcgtcggcagattgtcaagctgagtgcaacatctccctaaagacctcgctgactgtcctgtatccaaggaccttccttggcctgtcacagatcagctccaccgcatgctgcacctcctcgtttgtgaccttgctgaagtctgtgcccttaggggaagaacttgcgcaggagcccgttggtgttcttaaccgttggcttttgccatagatggtgggggtcgcagaagtagaactgcacgcctcaaagggcatctgtgacatctgcatgccctgcgaactgcttgcccctatccggaagtgagcgtcttaaggggacgtccctgtagcagtccgacctcggccttagagacgctgccgctgtcgtggtggctcttttcgcggcaagcagcctcgatgccctgtcggcaagcacgagcaggcacacgggtcccgctgccacgagtgtgtcgtctacccactctccgagatgagacctctcatcggcctgctttggcctctcatccacggtgtgtaagatctcgatcttgcctttggtcttaggcctcttgctgcggatctgcttccccttcctgcgcaggtggcgccacacctggccttcggggccggcttccggcagctcgagcgtggcggctacggacctgccggtaagaatagtcggcaggctcaacggtgcacctgccgccaccctcgagcctgagatatagtctatctcctccagggaccagtgtctgtccatgatgagtaagcgcaccttctgcgtaagcgcagggtctgaaagccgccttttcgccctgcatctcctgcggcgctcatccgccctccttttgggcagcgcatgccctaaagcggccgtgccgtgcgttcctcttgagcttgtggcagacgctggagctatccctgccgatctctgccgcgatataggcaattggccttcccttgtgccacacagcttggctatgcagtttctctcctgtgggcttgagatgcttgtagtggcacattccttctagcttgcgacgttgattgagacaaccaacatcgtagccttccggagtgtgccacgcttgcatgcagcgggccatcctgttgcactcagaatgctaatccaccgtccttaagggcgcttcgctatacctctatagcctaaagtctgcgcagcagaacctgtcatcttcccttacgagtgtatgtgccacaggatatgtcgaatacattctaggcgatcgtctccacaccatgcacaaggctacctccgacgtctacgccgatatgcgccttgtatcagatacgccaggctccccctttcttggactggtgcgctttaagggttacgcgcatggtccttgttctttgtggagcttaaggcccaggtgaaggtcgcatccactatggagccaccgcgcgccgtgatccctgccgctttaaggctatggcgcatcttcgcaagtgtcgtcgcatctggtacctgcgcttgcatgaggtctgcgtgcacagaagcgctgataggaccgacaatccaggatagcatccttaggtttcctcgtctgagagcccaaacatgacctgcagcagatacatcctaaagctttgtctttgcagcgcgcacatgcctgacaggagcctgtccgtggtagctggtatctaccagtgcaatccagctgtgccacacaacgattgcatccatccgctccaggaatgcctcccgcccagtctttctccttagaccttaggatttaaggtcctaaaagctcatctatctgcccatatctgccttttggatatgctggaatgtgtggatgtagctataccatatccagaagacagataggcatctatgtgggtatgggcactgtgtggttcgagacattttgagccgatgtcatacagcgtgtggccccagtgacctcatcgaggcgaattaatcatcgtttccctataggagcgtccatttttggcaactaagggagatatcggtttcagaggacttgaaacaaccttttgcatcctgtcgatgctgcaacatgaaatgtttctggcttgtacaaaaatctctcattgatctttcatcacccttggatgtgagacagggcccagagtatgggggctgcccatacgacggaggcgtccctatactcattccatctgtgccatactgaactctgtattctgaaaatctctgagaaagggagcatatggcagatacagagaataaagtcccttcgtattcctcgagagatgagatccccgagcaatacacctggaacctcacgggactctataaaaccgacgacgacttcaaacaggcgctcaaggatgtacaatcaatcccagaagcgtacgccgcttggaaggacaaagccttcacctctggagcgaacctcctcgcctacatgaagttcgacgatgaggaaacggttaagctcactaagctctggaactatggcacctgcaaagctgaccaggatacccgcaacagccagtggcagactgtgttggcacagatgaacgacctcgaagccaaaatcgaagctgccaacgcctggttccagcccgctcttctcgctgtcagcgacgaacaactcgacacctggtacaacgagactgagggtctcaagctctacaagctcgcactggatcgcatgagagcactcaaagctcacaccctagagccggacgaggagcagttgctcgcacaggcaggcgttctggagtcacagccgaacacgatcttctcgatgctcaacgacgcagacctctccttcccggatgtcaaagacagcgagggcaacacccaccatgtaacacacggtagctttgtgccgttgcttgaaaagtcaccggatagaacactgcgtgagaacgctttccactcggtgtatggcgtctacggtagcgtgaaaaacaccgcggctgcggtcctcaccgcacagatgcaaaccttgaaattcttcgcgcaggctcgccactacagcaactctctggaggcctccctcacccccaccgaagtgccggtcgaggtctacgacaatctgatcaactccgtccacaaccacattcagcccctgcatgactatgttgagctgagaaagcgcgttatgggcgtcgatcacctgcactactgggatatctacaccccactagtgccggatatcaaccacagatactcctatgaggaggcttgtgagctcatgtataaggcgctcactcctttgggtgaggattacgtcaacaccgttaagcacggtgtcgcaagccgctggatcgacgtctttgagacccccggcaagcacagcggcgcttactctgcaggcggctcaggcgccaacccactgatcctgctgaacttccaaggcacactggaagacgtttccaccctctgccatgagatgggccactcgatgcagacctggctctcccacaagaaccagcctgctcgctatcggaactacgcgatgttcgtcgctgaggtagcttccacgaccaacgaatgcctccttacgcattacctgctgaatcagacagatgacaaagcagagcgtacctatctgatcaacgagttctgtgagaacttcaagagctccctctatcgtcagaccctcttcgccgagtttgagcgtgacatcaacaaagcctgcgcaaacaacgagggtaccggtgcagaggatatgaaccgcctctacgccaaactcaacgagttctactacggtccagcctttgaggacagctcagagatcgagctcgagtgggcacgcatcccacacttctactacaactactacgtctacgtttatgcgacgagcttcgccgctgcggtggcactctccaaccgtatcctgaccgaaggtaagccggcagtcgacgactacctgaacttcctctccggtggctgctccaaaaccccgatcgaactgctccgtggagcgggtgttgacatggcctcaggcgaggctgtggattccgcgcttgaagagttcgacaaacttgtcaaggaactcaacaagctgctctaagcgaaacacctcacacgtctgacacgagggctgcgggagtgttcctgcagccctcgttttggttactgatctgttgttttaaggctactgcttatcccgacatctcaccgacggtactacggtcttgatctggtgcgccagtttgagatacttctcgttctcctctgtgctcataaacttcggcatacgctgttcctgtgctgcctgcgcaatgtcctcaaaggcagttgccactgcgtcatcctctgcgaacccgatgtgccagcgcgcggtatcgatgatctcgtcgaaggcgttggctacagcaaccgagttggggactttcttgatcatctgatagtcattgcctgcatccccgaaggctgcgatctcggcgtcggcaataccgagatagtgggcaagccagagcgccgcttcccctttgtcccaaccgtgtgcggtgatatcgataatgccgccgactggacaggagaaagagagctcaggacacgcctgttgcagcgcctccatcagctcattttgatcttccagcggtccgtcgaattgcacgttggctttgaccagcgagaaggtatcgggattgtaccgatcgacaccggaacaatttctcaggtgccccatgtggtgctcaaccatctcatcgaccgtcgtgccggaagcccaggagcggttgtccgcctgatacgccagaatgcaggcgcgttcgtcctggctcaccacatcatccgccttgcgcataccttcacggtcaagctctttggtgaggaccccttccccgttgtagtacacacgcatcccgttagcgacaatggccgtctgatagcaggctttatcgaaccgatacaggtagcccacatgggaaatatcccgccccgttgccggtccgcaaaccacccctgcattgagcatctgatggatcgagtgtaagcaccgttttgaggcgatgagcttattccgggccactaaagtgtcgtcgagatccgttacaacgagttcgatcattgcctgttccctaacagtcgtcagtcgcgcataaagtcaggtagggttccatgggcggtagccttagcaagcttatggaaggcctttcccaccgcactgtcctctgcacgccctatatgatagcgggtatgggctttcactgtggaagattgcattgacaaccgcaaccgatctacccaccgcttggagcatcgtgaggccattctcggtgtccccgaataccactgcctcatctggattcacgcccagctgctccatcagcatgcgggttccggaatccttgtcgatgcctttgataatcacatcggcccatccgggaggctgtggtaccaaatcgaagtgcgggaccgcaggtactactgctttgaggatctcatcacgctgtacatccgtgttgagcaaaatccccgacttggaatagacagtatcgagaaaggcctcgacgatgctcgtgtcctgccctaccctttgtccgttcagagatagccgccctgcctgatagagccatgatagtcctcactgaaggcgatcagatatgtgtgggagctaggtggctctaacgcctccgagagtgcctgcacatcagggagcggaatggttctgttgaagatcagctgtccttgaagccagatctgctgtctgtcgatacggacagcaccgctcggtgcagctgagccgtcgaaaaactgccgcagttctcccatgcctctgtcggtatctgcgacagaggcaatgccttcccgctgcagggcccggatgccctccatcgctaagggagagagtgtgttctgcccgatcggcagcagcgtgtcatctatatcactcactacaagcttgatcctgagatacagcctcactgattgttgtaacgatattcatcacagtaaagaaaaggttcgcgccacctcagcgcgaaccctgtcagaggttttctgttgttcagtgtagcagcgctaccaggcccaagcaccgaggatctgcagcacatcgtctctgtcgatcgtgcctaggatctggtcaatatcgatcgcattccacagtgaggctacttccttgtctcctacaaagatgtgaaggttgcgatctctgagaagcgaatgggaggcggtccatctgagcgccgtgatgtctttgtacgggatcatcacggtcttacccacgaacggtataacccgcatgtagtcgctataggtcgcgaccgcatagcgacggataccaaaccagaaggcgaagaggacgatctcaaacaccataaagaacatcatgaccgactcatagtagctcagcgagttcaattacgagaccttcaacgcttctgaagcctcttgtcgatatcaccggtgtgatggtccatccgggttccgctaagacgtaatggtcaacgcaatcacagtggccggtgagtttgatgcgctgtgccacaggcggagcgtccggagcacaccgaggggcatgaggcttctaccatccgctggcggtaatggcactgcggcacatgtccttctcacatatattgtgcgtgaccacacggcgggagtttgcggtgcgtgagcagaccttatggatatcgcagccttcctgaataaacgctacggtgcggatacggtcaagatcacgatcaaagagcagtacaagaacatggcggcctacctcaaaggtaagatttcctgatcaacaatgccctcgagtctaaccgtgaggcaggcatcgatcctcaggtcgttgcggtgcgcggcggcactgacggctcacagctctcggcgcgaggacttccgtgcccaatacgcgacgggcggctacaatggtcactcggtgagggagttatcccattgaagtcgctggagaagactgtcgacgtattgacaaacctggtagcaaagtttgctaagccgcagcattaatatatctgtccagacattgttgtgatcgaatcctgcgaagagcatcggaaaggcagccgattgcggttgccttttgcctaatcagggaaaatgccagtagagagtaatcaaatagacgctttatgcacccgaatgtgacgattacgcttatatggacgcctaaccatgtatacacgcactttttggccgtttacggaaatatttgttgcgggtacagcctgtttgtgcataatggttacttaattgagcttctcaaaagcaaaaaaggctatttacggggcattttgcgtgctcgacagtgtcgagcaccttgtcgagtagagctcaacggggaaagatatattcacgacatagagttaagaagttgatttttgtgggctttggttatcaatttctgattgttgcgggattcctgtggccgcggtattggtggactgccttgcatctgctgctgctctgagcgtcaccatacgcaccatgatacctatcaggctcctgccagtctctttcacagtcttgttgtcattatggtcgctatgggcatcctgggtattgcggttagcatcatgctcggtggtatgaattgatgagcta

SEQ ID NO: 375 - DNA, 13899 bp, Unknown
  Metagenome-assembled genome
ggaagaacccgtggttttctttgaaaaccagctcgtgccgaccgaagtttgcgctgaaggatccccgtccaacggtacgccgctctcggggtagctttgttatcattcggggcgatgcaaccaaagcggagagcgaatttactcgccccgatacctccgggcgaccgcgggcaatctgggcattacattcgcttccgctttggttgcatcgcccccttaatgtaaccaaacgatccccgagatgcggcgtaccgttgttgtgccgggtatccttcggctcaaacttccgttctcaagagctggttttcaaatacaccacggtttcttacctttcaaaccgatctgtggtagtggaacccagcaaacacattgttgttgctgccatgtatctaaaacctggcttactcttgcttcgtgattgcgttatcgagtctctttgccatagcggagcgtactttcgattctcctccattgcacaggacgtgtccttacggacccgccggtggtgattcgtcaagtcacggatctcattcacacttcgtgtcccccgcacatgcggcttggatcatattgtttgatgtcacaggcacgcttgacgcgagctaaacagaacgggttgtgctcagtttttcacatactacactctcaggttttactaactgacatgtatcacttgcctcccgcatctcataccgctcaatggtatcagatatttcccgtatgcgcggtcgggacgggtaggcatgcacgatgcggacatcgtagtcatccgcaacttcatctcgtgtttagcgttctgagccgaagctcaatcgattgctcgcctagtacccggccacgcagcgcccgttccagctcctcaagcgacgtcgtcgcgagagcgaatgaagccgggcatccagccaaaacctttttacattggtgcaccctgtatttcgatttcaagatcagggatttgccttggatcgagaagctctctacgtccttcacgagggtggccgactgtgcccatgtactatgcccattcgccaaactcacctgcagccaccctgcgcttgaattctcctcgcgtaagaataagtcttttccgtcaacctcgccgtccgggactttcttgtaagcgccgaaaccgcctgctcatcccacccccccaagagcccgctccgatgctctttgcgcagctgcgctacgagcgttcctttgcctgcacctgacgtcccgagattacacagtcgtgagtgtctcgtcactactttgatacgttcgatgactgctcacgctggcggcccaagcccttcacgcggcgctcgaagagatgccgactcatcccataattcttcgcgcctttgccttgccgtacctggacgagattcatgagcgcgctcacctttaacgattgggcgtaggacatcggagtcgagaaccgccgcagcgtaacctcgccctttttaatcttttcacgcactcacgcgtgcgtgccgtgctgccggctgctttctctcgagtggctgctttgcggtgcttcatcagactttgtggagagcatacacccccaaacatgagatagcttatacggaatgttcctataagcttatcaggccaacagtagacagttcaaaggttggcatctacctgcgttttttcaagaccgttcgcaatcaaagccaacagattctatacgatatgcccacattgccgcgtctattcgtcccactggttggagggggtgctcggaagggggggccattactccctgttagcgaccactgccccgatagccgcatagcctagcgcgatcaggggctgggtgaggggcgcccgctcaccaaccttcgaggcgaccgccgcgatcgcctgctgcgagtcgcgacacgctgctgtctcccttggccgcacccttcgtctggacccgcggtgacgagcagcacatcctcgccagaactcacgcagcatgtggacttccttgggtgagcagccatcccgtcggccgccggccccagtagccagttttcgctagcgccgcacgcgtcgggtcatctcatggtacatccgattgaggatcgggtcctgatcctgctcgttgaggacgaaattgcaggatcgtggtgcgccctcccacagtgggccgccgcctcgacgccgggccgtgctgccttcacccatctctgtggccgccacgcgtggatggagacgatctgccccgcttcagaggcagcctgcgctggccaggcggtaccggtgcgggatatcgagagcttgaggtcgagaaagacctggagcccatctgttgcagcttcgtgcacgatggaggaccagcgaatagtagagtgtcatacccccctgacccactggcacgtccgcgcagctttcggcagaccttacctttcaaaccgatctcgtggtagtgaaccaagcaaacacgttttgttgtagccatgtatctaaaaacctggcttactcttgcttcttgattgcgttatcgaagtcctctttgacatagctgagcgtaccgttgtcgatctcctccattgcacaggagacggtgtccttaccggacacgccggtggtgatatcgtcaaagtcacggatctcattcacacgcacatgctggctgtggatcatattgttgatgtcacaggcacgctttgaagcgacagagcataacaggaacgggttgtgctcagttttctcaagcagactatcaatctcaggttttataactgacatgtatcacttgcctccctcagtctcataccgctcaatggtatcagaaagttcccgtactgcgcggtcgacggtgtcattcacgatgcggacatcgtagtcatccgcaagcgtcatctcgtgtttagcgttcttgagccgaagctcaatcgattgctcgtcctcagtaccccgtccacgcaggcgccgttccagctcctcaagcgacggcggctcgataaagatgaggaccgcatccggccagacctttttgacattgagtgcaccctgtatatcgatttcaagaatcagggatttgccttgagcgagaagccgctctacttccttcacgagggtgccgtacatgtgcccatgtacatatgcccattcgacaaactcacctgcagcaaccctgcgcttgaattcaccctcgcttaagaaataatagtcttttccgtcaacctcgccgggccgtggacttcttgtagtcgccgaaaccgccaggcccagctccggatgctctttgcgcagctgcgctacgagcgttcctttgcctgcacctgacggtcccgagattacaaacagtcgtgattgtctcgtcactactttgatagcgtctcgatgagctgctcacgctgacgggctcccaaacccttcacgcgacgcgtcgaagagatgccgagctcatccataatcttctgcgcctttgctttgccgtagcctggaagagattcaatgagcgcgctcacctttaagcgattggcgataggatcatcggagtcgagaacctcctgcagcgtaacctcgccctttttaatcttttcacgcaactcagcgcgtgcgtgccgtgctgccgctgctttctcgagtgctgctttgcgttgctcatcggtaagttgtgggagagccatacatcctccaaacatgagagagcttatacaggaatgtacctataagctatcaagtccaacagtagacagttcaagtttggcaatctacctgcgttttttcaagaccgttcgcaatcaatccataaagatacatacgatatgcccacaattggcgcgcctattcgtccaactgggctatactccctgttagcggaccacattgcccacgatatcctcatacgcctgcgccggatcaggggcctgggtgattgggcgcccgatcaccaacttcgaggcaccgtccgcgatcgcctgctgcggagtcgcgacacgcttctggtctcccttggccgcacccttcggtctgacaccgggcgtgacgagcagcacatcctcgcccagaagctcacgcagcatgtggacttccttgggtgagcagaccatcccgtcggcgccggcaccagtagccagtttcgctaagcgccgcacctcgtcggtcagctcatggtcaattccgattgaggatagggtgtcctgatccatgctcgtgaggatcgaaattgcgaggatcttggtgcgctcaccaccgtgggccgccgcctcgacgccggcacgtgctgccttcaccatctctgtgccgcccaacgcgtggatggagagcagatctgccccggcttcagaggcagcctgcgctgccaggcgtacctggtgcgggatatcgaagagcttgaggtcgagaaagaccttgagccccatctggtgcagctcgtgcacgatggaaggaccagccgaatagtagagtgtcatacccaccttgacccactgggcacgtccgcgcagcttttcggcgagcctaaccgcctctttcggttccatatcgagggcgataattatggaatttcgagcttgtgcttcgttcatgcctgtacagctcctatcaattctgtgatatcggtgacgccttggcgctgcgcccactgcgtaagctcggtaagtacccgctgggcagccaacggatcaactaggcttgcagagccaaccgaaactgcggtcgctcccgcaaggatcatctctgcggcatctgcacctgaagacactccaccaaccccgttgatcgcaatatcgaccgcctgggcggcttcccacaccatacgcactgcgatcgggtggatcgccgggccggaaagtccggcagtcgcacgggagagtttgcccttatgagtattgacgtcgattgccattgccgggatcgcattgatcagggtgagggcgtctgcgcctgcatcctcacaggcgcgcgcgatctttgctacattgtgcggggcaagcttcacgagcagcggacgctttgtgcgtggccggcaggctttcacaacctctgcggcgctctcgggagtcgcccccaccgaggcgccaccctttgagacgttggggcagctgatgttgagctcaaagcccgcggcaaagggtgccagggactcaaagagatcaagggcttcctcatactcctcaatcgagtggcctaccacctgacagatcacgcggcagccgcgcttatcgagatcggtgaggtagtctccatactccttcacaaaggcttcgacgccagggttctggagtcccaccgagttcatgatgccggaggtcgtctctgtcatcctcggctgagcattgccgcgccagggtttcgcagaggcacccttgcaggtgattgcacccagggtactcacgtcgaagaagctctcgaactgtttgccggcgccgaaagtgcctgaagcggtgcagatcgggttttgcatagctataccgcccagattgacggccatattcacgcgtggcatcaccactccacctcctcggcgtcaaagaccggaccatcctggcagcaggaggccaccgagccgtccttcatcgcgaccgagcaggtattgcaggccccgaacccgcatgccatcaccctctccagcgacacctggcacgggatgtgctcacgggcagcgattgtcgcgacgccctccatcagggagttcgggccgcagcacagaaccgacccgtagatcttcttttcgaccagacgctccatcaactgggtcgggaacccgtggaagccgtagctcccgtcatcagtcgccgggaacacctgtacatcagcgctgctatcgagtgtcgtcagctgtgcggcaccctcatgccagaagcgggtgccgctctgcgcgcccatcacgacatcgcagtcgatgcctcctgctgcaaacattcgcgcagcagcgtagatcggagccgcgccggagccaccggcgacaagaagcgcgggatgctctgtatcctttggcagttcccacccgtggcccagagggccgatcagggtggcgccagagccgaccttctggtggcagaagcgcttggtaccttcacccacattcactacatagagcttgaggtagctgcggtgcaggtccatatcgtagtaggacaaggggatcctcaccaagtgacgggggtcgcccggcaccgcgacatcgacgaacatacctggctttaaggcggcgaggatcgcctcgtcggtgctgatccagatctcccacacgtgctcccctacatggtggcgctcgcgcacggtatagggggcaaggtgaggcatatcctgggtactcattttgtcaccaccccatcggtcagtgtccgtttgcctgagcagaagacatctgaggctgcgccagtcagcttctggcccaggaaggcggaatttttcgccttaccctgcaggtagtccggggtgacctcgatctcctttctcgggtcgatcagggtgaggtcggctttgccgcctgcctggatcttgacttctgaaagcgtcaggatctctctcggattcaccgccatgacctcaaccatccgattccagctcatcttgcctggcagcacgaggtgcgtgaggatcaagggcaggctcgtttcgagacccacagtacccggataggcgatctcccactcacagtccttctcgtggggcgcgtgcggggcgtgatcggtgacgacgcagtcgatggagccatcgatcagcccttcctgcatggcttgcatatcgctctttggcctcagcggcgggttcattttgaggttggtattgtaggcatcggtgatatcgtcctcgttgaggaacagatggtgcggcgtgacctcacaggtgaccggcatcccctgcagcttcgcgtggcgcacgaggttcaggcccttacgggtggagatgtggcacacgtggtagcggcaattggtgaggcggacgagctcgatgtcgcggtagatctcaagctcttcgcccagagccggaataccgaacatgccgaggcgggtggaagctttgccctcattgataacgccgttggcggtcaaggactcaatctcgcagtgtgcaagcaccgtgcggttgaactgcgagacgtactccatgcatgtcctcattatccccgcactctgcacgccatgtccatcgtcggagaaggcgcaggccccctccatcaccatgtccccgatctctgccaaggctttgcctttctcgtcacgggtaagtgcgccgatcgggcggatgtggaccaagccagcgtggcggccacggtcgatctgatagcggatctctgcgccggtgtccgtcaccgggtccgtgttcggcatcgtcgccacatcggtgaagccaccgtgcgccgcggcacggctgccagtgtcgattgtctctttgtactcgaagcccggatcacggaagtgcacgtgcatgtccacaaggcccgggaccagatacttgccggttgcatcgatgatctcggcgtccgcaggaggctcgaggttctcccccacctccgcgattgtcgtgccgtcgatcagcacgtccacaacatcgtcgagacccacctgcgggtcgaccacatgagcacctttaagcagataggccatctttgtctcctcctagaagtaagtacatctcggccatacgggtcagcacaccggcgttgacctggttcaggatgcgcgaacggctgcactccacgacatccgcattgatctccataccgcggttcacgggacccgggtggcagatgattgcgttgttcttcatccggttgacgcgggtcatatcgaggccatagaggcggttgtattcacgccgtgacggaatgaccgcgccttccatacgctccagctgtacgcggagcatgtagatcacatccatgtcctcgatcacgtcgtcgaagtgggcggtctgggggcagccgaaccagtccgggtcatcgacctggaaggtcgggggtccgacgagtgtcacctttgcgcccatcgtcttgagtgccggcgccaaagatccgcacacgcgagagtgcgctaggtcaccgacgatagcgaccttgaggccgtccaaatgcccaaagtgctttctgatcgtgtagaggtcgagcagcgcctgcgtcgggtgctgatgcttgccatcgccggcgttgattacgacagcgtcggtgttctcagtgatgcgctgcggagtgccggctaggcgggctcggcagacgaacatatcgacgttcattgcggagatcgtctgaatcgtatccgcaagtgactcacctttgacgactgaggaggtggagccaccggcagacagcgagtctgcggagaggcgcttctcagcgagctcaaaggagctcttggtcctggtagagggctccaggaagaggttgacgatcgtgcggccgcgcagtgcagggaccttcttgatcatgcgggcattgttgacagactcaaaggcttgagcggtatccaagatctgggtgatatcgtcggccgtgaggctgtaggtatcaatcaaattttttactgataacatgggtgactcctccggcctactcgtccttcttgttccaaatctccacggcggtgtgatcgtcgagcggctcgatgctcatccgtacgtcttcctcgtgggaggaggggacattcttcccgacatagtctgcgcggatcggaagctcgcggtggccgcggtcaaccatcacggcgagctgtacggtcttagggcgaccgtagtccatcagcgcgttgagcgcggaacggaccgtgcgcccggtgtagagcacgtcgtcgacgaggatcacattgaccccctcaattgaaaatgggatattggtcgcgtgcacgaccggtgagttgttgataccgaaatcatcgcggtagaagctgatatcgagcgagccgattgggagcttaaccccctcaatctcatcgatcttttgtgccagttccttggccaggatctcaccgcgccggatgatcccgactacaaccagattttgagcgccctcattgtgctcaataatctcatgggcgatacgcgtgagtgcacgctctattgcctgcgcgtccataatgaccgctttgggttgcttcatgggtctccccttcctaaaaaataaggtgccgaaccacgcaaacgcggcacagggcacccgagagggttttcgtgagagactcactcaaacttgagcatattcacctttcgggtatctcgtactacgctttaaaggctggcctaactgtacgacacgaaatcaaaaatctcaatgatagaatcgattatttcagaaaaatttcgacggaggatctgcggagcgatagcggacgtgaacaggcaatatgtaagtgtacagataatatttgaagctgctagagcaccctcgccggttccccagctccgtcgtatcgaggacatgcgccaagggctttggagactgttgtgaagccctgactcattcagtaagtttattttgtttgatcctgcccctcgagccccagatagtgctcccagaacacccggctcgtgaggtgggccttggcatccagataggactgcacgactgcagcgttacggatctggaagtccttcaccaagttgtggtaacggtcattgagcgcctgccagcgtcgtttgttcatccgccgcacgtgtgcctgggtggcgtcctggttataggcgaccaacaccgagtggcctgcggtgagggaagcgggataggcgccgcgtgcatagttcaccgccaccggctgccggtcgaggagccaattcgggatcagatgccggtcatacggcacgatttcaaagagccgtgccggcaggctgctgcgcttacctgacgtgcggacccagggattctgtgaggccggagcctttcggcacatctcctgatcttccggactgagctcatttaaaggcaggagcttctcgttctccttgcccttctccttcatcaggcgctcaccggagacgctctccaggaacttcggacccttgaggtagtcctcaagaccgtcgagtatcagatcgcagacgtcgtagttcatcgccctcaggtagatgtggaaggtccgctcgagccagagcatgaactgcccattgtccccagtgtcatccatcgcattcatgatcaagaaattgcggacgtactgatagcggtcaaccgtgccacggaatctcccttcgaagggctcgtgccacacgcaaattccgtccatgcacatgtaggtcggcttgcagcgcatgccgtattccacgtcgtcacaccgcacaaagaagggcagcggcaagccgtacttgtggatcgccgtgaccgggatgcaggagtaccaccaggcgccataggcgtgcggcacctccacgctgaccgattcattctcctcaatacccttataggtatcgacccgaaggttgttgtccttgatcccgttgtagtgcccgttgcgcaccaccgcgacgtcctcaaactggcggttcggctcttcacgggagagcatcgccccattgataaacgcatccttgtagcgatcattcgtaagtgaaagtagtgcaaaggtacgtttgaagctttcaggcagcacccgcacgtcgtcatccatcagaaggacgtgggtcgcttcccaatcgagcgcctccatcatgccgcgtgcaaagccgccagagcctcctacgttggcattcgggatcacgctgatcccagggctcgaaagcttctccgcatcgagcgttctgccgttgtcgatcacaaacatgtggaagtttttggcaattgggtcgtctgagcccagtacgtgctcctggatcacctcaatgttgcgggtgatgtactcctcttttttaaaggtcgtagtggctatcgctaacttgatggggcggatccggttctcgtcgaccatagtgtggtaagcgccacccaagagctttgtggtgcccgaggagatgatcacaaaaccttcgatctccgcggtgctctttgggagcgggatgcggatcttctgcggcatatcggatttaccacagctcataaggggctgtttggtgaaaaccggatactctgagtccgcaaaaagggaagtcgcatagatctggcaggcatcacctgaaagcgtgagttccaggatgatatcgtcgacggacgcgtaatgacgccacttctcgattgaaaggccattgaagtaggtcgtaaagtccacgattccggtgagtactaattcattgtctgtggcatcgtagcgggcagaaccctccttatcgtgccaatacagtcctgtatagtgagctacaagctcgtcgggggcaatcagaatattcgcaagtttgtaattaaccatacagtcagtcccttaaaaagcgccatacctatcacttgtcagcgagctcactgtaggccttgcatacttccctgcagggtcccagcatccgctgttttcctttttcgatccacagaacgcgcgagcagacccgccttaccaactcgatactgtgggagaccaaaaggaccgtcgtgttgtcgttctcgaccaattcctgaatacgcttctcacacttcttctggaagaggaagtcgccgacggacagcgtctcatcgacgatcaggatatcaggttcggtgatcgtcgcgattgcgaacgcgatacgcgcgaccataccggaggagtagttcttaagcggcatctccatgaagtcctggagctctgcgaagtccacgatcttttggaagttctgatcgatgaactccttggagtagccgagcaacgctccgttcagatagatgttctcctctgcggtgagctccatatcgaagccggcgcccaactcgatcagcggggcgatcgtgccctgcacggtgcaggtgccttcagaggcttcgagcacgccggcgatgatcttgagcatcgtcgatttgccggagccgttggtgcccacaagcccaaaggcttcgcccttatggacatcgaatgagatgtggtccaaagccctgaattccttgaaggcgatctcatggtgcattgccgcgatgaagtactccttcagggaattgaacttctcgttggctacattgaagatcatcgatacatcgtcgacgcggatacacacatcatccggcaacgtcactcttttagccatatgccccacaatgctttctgattgcttatcgtcaggcaaccgtcgttagcagaaatcaaacaaaatcagatacaccaggctctctccactagatgtagaggataaagttatgctcgtgcttgtgaaaggccgcatagccgataacgcaggcaagcaccgcgaagataaggcagcgcagaaacaggctgagcgtcggcatgcgcgcccagagcatcgtgtcacgaagccactccacgtagcaatacatcggattggcagcctcaaagatcttcatgcccggcggcaaaatggactcaggatagaacaacggggtcgcgtaggtccaggcagtcaggacaacaccccacaggtgaatgacatcgcggaagaatgtcgctaaggtgcacaggagcagggacatcccaatgcagaagaccaccagaaacgcgacgcccaccggcatcaacagcagcagcggggtgaacggaatgtggaaccagagcataacgcagaagacggcgatcaacgagaacaggtaattcaccgtcgcggagagcaccttctggattgggaagatataacggttgatctttaccttcttgagtaagcctgccgcatcgataatcgagcgcagaccggtgctcgtggcatcgctcatcagctggaaggcggtgttaccgatgatcaagtacagcgggtagcagctgatggagtcgtccgcgtagcgcatgaacgtcgagaagaccgcggacataacgatcatcatcagcagcgggttcaagacagaccaggccacgcccagaaccgaacggcggtaccggagcttaaaatctttggagaccagctgttgaataataaaacgatctcgtttgcgtggtggataccaggcatctttcgcagaaatgacagcttcgccagagcttttaccagcgctcttactcaaagggacctccgtaccatgtatgtatcagattcttaaaattataactggctgcgctttatgctaacacagcgcaaaaaggttgatacgtatgtccaaagactcaacaggaaagcctgaatgtttccaacacataaattcatacccctcaaatcacttctccccaactttttccttgcaacctccaggacttttcgtatactaagtgatgcattgcattccccagtggcgcagtggtagcgcaactgactgttaatcagtgtgtcgtaggttcgaaccctacctggggagccattaaacatctgggaacttaaagcagcaggctttgagttccttttttatgccttggcaaaggagatcacatgggtaccactgacaatcaggatctcaaacaggccatccagattctgcacagcgccggcgtcagctgtgtcctggtaaagggcgacgacgtcgtcaaatccgatagagcgggcgtcgctccccttctgcagctcttatacagcgggaagagctatgagggatattccgctgctgacaagatcgccggcaaggcggcctcgatgctctatatcgacctcaaggtcaaagcgatccacagcgatgtaatgggcgaaggcggcaagcagatcctggctgactaccaggtcgatgcgacctatgacacactcgtagaggagatccgaaaccgtgacggcaccgacgtgtgcccgatggacaaagcggtgcgtgacctcagggatcctgcacaggcacccgcggtgctcaaagcgaccattcaggcgctcaaggcgaaaaagaattgattagccgttttgtgcctgtagtactacaagaaccctcctgacggtggattcttgtatcgctaaacacgataagcatgtgttcaattctactgcactgtccgaacagcaacctgaaatacg

SEQ ID NO: 376 - DNA, 45145 bp, Unknown
  Metagenome-assembled genome
gacacgccggcggagtggtacaggagcggtatctgcgaggctgcataggcctacaatgctgctgtccggttagcaagggttttcggaagtatcgggctttccctgtctcacgagttcggccacttcatccttcctgaccttacagatcaccttctcgttgaagttcttcacgatatggaagtagtcgtagacgatgtccaggtgcgaaaatctcttaaggaatgcacactcgaagtctgcgttcatgtcgcaggcgatggcctccaccttcgacatccactcagcgagcacaaagtcacagaattcatgcacgacctgcttcctcttagaatatgcgagccacagctcatatcccatcttaaggtcgatgatcacggtggcatatctgtgcccgccgtaaagcttgaacgtatctgcgcccagatagcgcgcctgccgctcgggcttccggagtctggtctcgccgtcctcgctcttctccgtatagagcgcagcgagcctcttcttgtcgatctttttcacgacgtttctgttaaggcctgccatgagcgatatcgccttgagcgtctggcccagggcgagcaggtcacacacgaatgcgagcagcaacagcgtgatgcgctggcctggggccctgaagggtacctcttccatgagggtgctcccgcattgcctgcatgcccatcttgaccgggacacctctatccttgcctctccatcccgagagggaggtgccgaagcacaatgggggccctgccgttcccttccatcggctgtccgcagcaggggcatgaaggagcctccttcgctgccagcctgccggggaccgtgaggatctgcaccggcctgctgcatcttttgcccgatgtgccaaactccttggtgcgcacgctctccttaggctctcccgtctgcacgaagccctcgagatgggaggggttccagaagaagacagagtcttctccggcatgggaaatggcgggcagctgggctgccgtggatgctacacttgtcatcgcactccatccttcttcggagtctacatgttgcgatgtaagattctagaggatgaccgcttttctgtctctttgagcatcaagccacgggcatctgcccacaggaattaggattgaaccaaaaaagagctacatgtgatattgaatcacttgtagctttcttgttctacttcgctccttatttcagatcgtcttttgtgattatctcttgtggaatcaaagcgcaatcttcgaggacctcacgtacatagttgctttccttcttgttaagtgctgagcacaacaaggtggggtcaacctcttcgatgttaatctgtttagtccgctcgttatcttccggcttagggaaacgctctatagccttatctaccatcagtgtataggccgacgcaaagggcttcaccttatacgagtcgcccaagacgtcctggagacgggccataaggttgacgcctgctcggtcaatgtcgccccaataaagtagatcaatcttttcggctccaagcgtatcaagcaacaactgtagtcggttgtgttccaataccggtgagccaccacccagaacaactgcatggatgtgttcgcccaagatggtcgtcttaccttcctcgtacatcagatcgcgcacgtcgaggtaaggatccaggttttcggtcacgagcactcgcatgtgcttgcgacgtctcggtgcatgatagattagatcggtcttcggaagtggcctatgttggattaggtcttccatccctaatgctcgaagaaggcggaatccgtcagaattgtattcaaagaatttctcgtccccatcaagcttatatgctaactgtctgcggctgagatggcttggaatctcccctgctttaagggcgacatcaatcgccataatttccttttcaaataaggtgtaagcctttggatgggctaagagccacccattcatccagaagcgtttatcgagctggataatctttttgcgaatctcatcttctgtctccccaccacgacgaacgcgaggaatttttcgcaaatcacgcggttcaggcagcggcggtaaatcctgttttatttccggtgatttcttctcagatactttaggcgccttctgagcgtttcttgtcgtgatagttcgttgagtagcccatttgtgctgctgcgtatgagaagatttagtcttagtttcatgctcttttacagatgcctctgatttctggtgctcaatcacgtgatgcacgcgtttggggccttcatgcaccagtggagtcttcaccttctctgcagaaactgcgagagtattgtccttcatctttccttgcgcattttgaggagcatcagactttttgtctttttccgatgcatctacagcactctgtatcgacttcgaaggatctgccttgtcagttttctcagtctcaggatgggcttcagtcttcttttgaggcttcgcatcctgagagatagctttctgtggaatctttggtttgtcagtcgtcttcgacttgctatcctttgatttcttaggatctttctgaacatcctctgacatatctttcagagcataagaactgtttgatgtcttttttaatgcgatgttgatcacacatgatttgagctcaggtacattggcttcatacttatcaaggatttcttcaagctctttcttagagatcgtctgtccagcgagtcgaactagagcgcttgcaagacctggtgccgcactgcgcttcgcgggtggaaaatgcgatgtcaaggcatcgcgtagccaaacgatgtgttgtcgttccgcctcgttgagcttgtgtgccatagtatccaatcctttctgttgcctataccaaaataggcttttactgtttcacctgcataagtgctctaaaggttcatttgcgtttcagatagtttgttatctgtgttttccgtctcagtgaagtggtcgaacctgtgagacagggaaagcccaatcttttctgattcctttcccgtccggacagcaccattgtaggacatgcagcctcgcagacgatgctcctgtaccattgtgctggcgtgtcgcagctaagcgcatagtagattcgctcttcgttgtaccatgtgacgagcttctcgatggtcgcccttaagctctgcaggtgtgctatactcctcatgccgcaggcatttgcccttgagcgtcttgagccatctttgcatgagggcgttgtctctccatctgaccctttctgtccaggctctgctctacaaacgcttcccttcccaaagttcatggtggaagagcaacccgtgctttgtgtgatgcccttctaattgtcaagtcggaatttcgccttgagggtggtaacgtaaatccgtaccatttccatcgataatcctaagctgccagggccaagcccaaagccttcctgaactccattgggctcacacctttaagcgagcacttgtgccttgtcgtgttgtacctgacgatacagtgatcgatgcactcctttcaaactcgtctaaggtggtgtcgtcccacttacacttgcaaaacatctctgtcttgaacacttcgaagaaggccttaacccttctggttgtggcaagggcagcccttaggtggcatcgatgtggtgatacccgcctcggaaaagatctatatccactctgctcagcagcagtggtgcctcctgtcgctgctggatcgcgagatacttttcgcttacctttgcttatcgcagcgatagcggcgcgcagcactaagttttctatctgaggttgggaggcattaagacagtttaaggataaagcttaaagtagggcttgtcggtgggtatctcaaactgcaagacgctagtgagtcacaaggaagttgggcagggctgctctgaagtcttgcttcacaaaactgtcagggttgtctgatatcttgcctgcacagaagttgcaagacttgttcttcctcggcttcttacagcttaaggccaccttgccctcctcttttaaagatgtgagatatcctgtgcttgccgaccaccatgttgatctttaaggtcggctgctatcttatcgcgtatgtagagcctgccgtagggtcttctattcgcatcaaatatacctgcgagcagctccctgacatctttatccctgtcggctaccaaggcgacaatctggcaaaagtagctagacttcttcagacaggcggcgcgccacaggctggcaaaggagcctccttccttttctgagcgtgccgatccgccaggagctcgtccagcgcatcgagcgagatgagataggcgcgctcttctttcgttaacttcccatcgatcatatacgaaaccccgttctatccatgactcgccgccgagcggaatcgaactatttcacaattccgttttcggtgtgtggaatacggggtccagatcagcaggtgcaggtagccttctccactcacggcttcaggaagggctcacgccagatcaccgacaaccttgttccgagcagaaggtcaggataaggtgcaagaaggtgcagagcatcatgggcaagttcagcatcgtgtggagcaggaagcgcaggaggccctaccacccgatcgggcaggacagcaagccccaggtagcacccagtgccgtggacagaaacttcaggagcgaagatcccttgaaggtcgcctctaccgacaaacacctacctcctatacagggacgagagctccctctacatgtccgacatccttaactgtaagagcgatcgttcttcttgcctacaagtgcttaacctcgatggaggagaagctggtgttcgatacataccgatcaactcaaaaggttcgagcttcccgacgacatctgggcatactcaaaccagggcgtccactataccgcaagggcctacagcgacaagctcaggcagcttggggcccgccagtcgatatcgaggcggacattgctgggacagttcctgcatcgagagcttctgggagcagatgggagagacagcccatctcctgacagagaagatcatggaaagggccgacgaatacgtcagctaccacaacaatctcgggagacagggacgcctgggctggctgacccctttagagtatgcaggcagacttgccgactatctgtgcggagttcagggtccacctcactgatacataacagagtcattggagtgatgggcgttatatggatatgacaccactccaagaagcgtaagaaacgctcaataatgcctaacggataatggataggctatctgaaagtgcgcaagactatcaacagcactggacctctctcgatgcgcatgccctgaagcgtactggtcttgcctactgacagggcctcgattacgtgacctaccccaactgggaatacttcgtggacgcaaaccctgtcatccaggctgaccttgccgccaatacggaagagtgcacagggacttcatccgacctgcatgtacatctgctcacgaaggcaagacaaagaagcatcggcgaggacgtctaccatggcggcgactatttcatcttcgggaaagagagcgcaggcctctcgcgcgaactcatctcgacacatccttccctcgccaagcacatccccatgaagaccgatgcagcgctttcgaatgccgacacgtgggcataagagcttcaacgcactccattccgagctcgagtgcgacgcatacggcaacttcgtcgatccaagggcatctgtcgtgacatcgctgaacctctcgaacgcctgcgctatcgtactcttcgaagcgctgaggggcagcgcggctatcccgacctcagctgactgtgcgccccggacagcattggagcgcacatctttttcagaggagccttccgaaacgggcgatatagcgcctgcgctgagccagcacgcagacggcatagcctgcgactatccagggcaggagcgccaggaagcttcccggcagtacggcaaagccaagcgcctcgccgactaccccttcgggaatcaggagagcaaggaccgctgcgatgaggcccaggaccgtgaggcggacatctgccctcgactcgatgagcggctttttctccgtcctcacgagatggacgaagagcacctgtgtgagcatggactcggcaaaccacgccgcctggaatgtcccggcaaagagcgcctgggccgaggcattgccagaaagcgcctcccagtttcctcctgccgtggccgggcagatccagaagtagagcgccgcaaacgtcaggatatcgaaggcagagctcaccgggccgaagagacgcatgaagcccgagatcgagcctggttgccacgcgatcggacgcatgagagcatcgtcgtccacccggtcccacggcacggctgtgcaggcacagtcatagatgaagttcaggagcagcagctgcacggctgtcatgggcagaaatggcaggcagatgctcgccacgagcacggagaagatgttgccgaagttcgagcttgctgtcatcttcacgtacttgttcatgttgacagaagtccgccgtccgctcacaatgcccccctcgaggacaccaaggtccttcttcgtgaggatgatgtccgccgcttccttcgacacatcggcagccgtatcgaccgagatgccgcagtcgctggcccgcatggcaccagcatcgttcacgccgtcgcccatgaagccgacgatatggccccggcggcggagtgccgagacgacgcgcaccttctgatcgggcgtgagcttcgcaaagatcgtcgtacgttctgccctctcttcgagctctttgtctgtcatccccgagatctctgccccctcaagcacatgctcggcagggataccgatcgtctcggcgacggtcacggcaacacccgccgcatcccccgtgagcacctttgtcactacgccatgctcgaagagcgccttcacagcagaggccgcactcttcttgggaggatccagaaaggcaagatagccgaccagcctcatgccagcctcgtcttccggcgcaaatgcccccacatgtcccgtgcagtccttcacggcgacagcgagcacgcgcataccgcgccgttcgagatcgctcacctcacttgcgataaggtccctgacattatccgtgaggggccgcacctccccttcgagctcagccgcagagcaagttgcaagcacctcttcgacagcccctttcgagaccatgaggagtgtaccatcgctcttgccgacaacgacgctcacgcgcctgcgcacgaagtcgaaggggatctcgtctacatgccgccactcgttcgcgagcccgtctgcatcaaaggtacgcggggatctcttcgtctcctgaacggcacgctcgatgatggcagagtctataaggtttctgacgccggtcccgaagaagctgttgaggtaggcatagcccaaaactttcgcatcctcctcgccggaaagatcgagatggcgctcgagaatcacatggtcctccgtgagcgttccggtcttgtccgtgcagagtacatcgagagcacccaaggtctgcaccgcatcgagatgcttcacgatcacttcgtgctccgcaaggtcgcgtgcccccttcgcaaggcaggtcgtgacgatcattggcagcatctcgggcgttagtcccactgctaccgaaagcgcaaacaggagcgcctggagccagttgcccttcgtgatgccggagattacgaagacgagaggtgccatcacggccatgaagcgcagaagcaggctactcgtctgtgtgatgccctcgtcgtaggccgtcttcctacgttccccatcgaggttttctgccatggaaccgatcagcgtatgagagcccgtcgcaaagacgatggcacgccctgtgccggagacaacagaggagcccataaaaacgatatcggaaaggtcagtcacgggaatatcgtctaccgccttgatggggccagccatgcgctcgaccggcaggctctcgcccgtaagcgaggacatgccgacaaaaagatctctggcagagatgaggcaggcatctgccggtacgatatctcctgccgtgaggtgcacgatgtctcctgcgacgatctcggaaagcgggaccgagacggcaccctcgtctgcacgctcgactgtcgccattgtttctatggagctggcaagcgcctctgccgcatcgccgctcttgccttcctgcacgaaacgcaggatgccggagacgaatatcatagcgaggatgatgagaagtgagtacggatttctatcttcgggcgccgcaaacagcacatcactcatgagggtcacgaccgcaaggatcgcaagtacacctgtgaacggatctgcgaatgacttgatgaaacgcagccatgccggatcgcggtggctcttcctgagctcgtttgcgccgtaggcagcacgggcaagctcgacctcctcaggcgtcaggccacccggatgcgtattgaattccttaaggagctcctcggtaccaacagacgctatcgttctcgcgaagcgcccgtcataccccgacgctctctttgcctgcttctggaagggatggaagatcttctgtgcacagagcatgaatccagccccaatcccggggacccgccggagggggcatgcccctcatgagcctctctcaggcaagatgcctcaaaaaggagatgcctcgctccccgatacgcgagcatctggcatgtatatcatttcgttttccgaaacatgtcgaagagccatcgctcataaggaagcacctcccaagggtcagggcacacggccggcctggaatgcacgcatcggctcacaggacagaaggcatctgtccgatccaaatgcatcctccttataccctgaatccaaatgctaatttcaaactcgccatgcagatatcatgcttcatcctggctccctactatctaagtctttaagtcgggggtggcaacgggaatccgtacctgtcttccctaagccgcaagccccaggctgcgcctgtattggagcgagctcatgctcccaagcgacctcttctggcgcttctcgttgtgccagacgatatatccgtccatctttgcctccagctcattcagcgtggtattcgtacagtcccttccatagaatatctcgttcttcatggtcccgaagatgccctccatgcgtaagctgtccgggctgtagcccttacgcgactaggagcgtgtcatgcccgcctgtctgcagatggctcgccacttctagccagcgctagtggcaactacagtccgagtggatcaccagatgcccgcgctcttgcttggtggtggtaagcgctgctctgggcatggagttggctatctcggcgctcggagacctttaaggacgtccagcttacagttgtcccatcgaagcagtcgaggatagggctcaggcagagcttgccggcaggtatctcaaactgcgtgacgcccgagagccacaatgaagttgggaaggctgccgtaaagtcgtgccccacgagatttccgggatgcgccgatatctcaccctcctgcgagctgtagccgcacttcttcttgggcgtaccacggggcaccaggtcttcctcgcgcatgatgcgcaccgccttgcactccccgatgcgagctcgtccttcatgcgtcttttgccatacacgctatcattggtatcgaacacggcacagatgctctcacgcagcttggcatcctttcttgttgcaatggcgctggcctggtagtggcagctcaaccttaggcagaaagagtacgaacagaagctcaaaagagcttccacttcgggcgcaggctatcgatcagcagcatcttctccctgttcgtcagctcgttttccgaggcggcgcccttcccttttcccaaaagctcgcctgtaccctgcatgatatctgagcctgagctccggcgaccgtatcggattggctacacttagctggatgctttcatgagggacatgagatacgagagaaaggcatccccgatccccgcaatggcaaacccccaagcatccaagaaagttccacgagaagttcaagcaccagatggttaagctctacgacaacggcaagccgacgtcttaagatacctgaggaatatgagctgcgccgctcgactctgcaccttcgggtgaaggcgatccataagagcggctctaccagagccgccgcaagcaggacccctgaagagcaagagctcatcgagcttgcaaggggaaacagacagcgctgatatacgcactaagatagccgtgatagaggaaagctccgatcactacctgatatctgtgcaatgttaagatcctaggcgtgaagaagctgccctactgctcgattgtgctgccgtaagaaggtcgtccccaagtcagatcccttaagtggaaacgtagtcgctgcgcagacacgacagccacaggcgctgtggcgccaggaagggcaagctcgcctcctgaaggcgcaccaaccaggatagcgaagaagaactcttcggtcagagcatacgcgaagctaaagtacagggcgcatgcctacgtgtgcgtgctttgcgcctggcacctgagtctgtctgcaccttgagctggacatctgccatatcggcgatcacatatccggcgcaaggaaacttatgaagtcagcctttgtaagcgtggcgttttcgctcttcgacaaagacgtgtcccacaccaagtgcggctttaagttcgacagtgcggcgataggcgagctctttaggatcatgcagtcgaggtacaagaagggctctcctgtgacagcgctatcgtcgagtccaccaacacaatacaaaaagccgagtttgtctaccacaagagcttcgagagcctctatgagctgcaagctgagcgcttaggtgtggtggtacagctacgagcggatgcacttaaagctaagttagatgagcccgatcgagttcagggaagaagtccctcacgattccgttcaaatagatgttgccaatccactcgcctgagctccagcaaccacatctcggcctttcggaccttaagctccccgatcgtggcgccctccatagcggcgctccttccacactccagctcctgcttccatctgtacagcgaggcacaactcgatccgaccgcttcggctgccttcttcccgtacctgacatagagctcttcagctctcgtcctctccccgagggtatacatctgtccttcagaccagttgcttggtacggatttccgttatcacccccgtctcttattgacaaaaattttcttctttctcatgtataaaactatttgcgccggttacatatataagaaatcggaggaggttcagaggggcctccggaacacttgaaggagtggtaacgatggcaggaatggttccctatagtgactatgagaaggctctccgcagggcatggccgttcggcgcgatcgatgacttcttcgcacctgttctctccgtggatgcgtctgacgcattcccgatggacgtcgaagatgcaggcgatcactacgcggtaacggcacatctcccgggcgtcaagaaagacgaggtcgatgtcgagctcaatgagggtaggctctccatctccgtggatcacaaggagtccgacgagaacaggggtaagaactacttgcagaaggaaacctcggagtggcaggcaagccgcggtgtgtatctgaaggatgctaccaacgagggcatcactgcgaagctcgtggacggcgtgctcaccgtcacgatccctaagattgccgagcagaagaacaacgcgaccaaggtcgagatccagtaatctcgcgcatgatgatgcaaagagggacagcgttcgtgcacgttgtccctctttttgtactcttcgacgtttctagtgggtagtacaggccagctgcctctgggccgagaatttgagtttcccagtctgagcaagatcatcgcctcgaagtaggacatgttcctgaagcccctagcagcgctttctgctgactagacgagggagttgagcccttcgagaaatgaattggttaaactcctcttccaccagttgaggatgccttcccgctccttcctgagggtcctcgccaccctcttcatcttagccacggcagagtgcatcatctacaagcagaggcggtttggggctgcagcagccgattccctgtcggtacacgagtacacgtcgcacatcgcctctgccatctggcaggcgcgcgcctccctgagatgtgtcttcgcaggatcgagcttctctcttcgcaatcgcgcctcttcgcgcacctcacaaggtctgtcgcctttgtgaaaagctgccactacatggacgctgtccaggatctgggcggcctggggcatcgctgtggtgacttccaaggagttatgtctttgccatgtcgcgtatgacctctaagactcccgtcttgtccccctgtgtgttccttaagctcatctcacttgctgcccttgtcctttgccttccgtgatagcgcgggcgcactggcagtcgaggtcggccatgatgctgatacagctttggttgcaccttttggcggtgtcgcctgtacccacacgcacgactctggaatagtctgctgcatccctcaccttcgatgtcgccttcccaagcagcctctatatgcgcgtgggctgtctcgtgcagaggccatggccacaacgctcatgacaaacgatcagctgggcctcaaagagcgccgcgatgcgtcttcggctggacccccagggtatccttgcagcatgcacgctgtccttaggggtactcggtaccgcgcagtgcacgatggtctcgtgctgccagatgtcgagatgccacaaggtcctctcgcgtctgccacaggtgctacagcgcctgtggaaggcagggctcaccacttacctggccctgacgtgtaccacctcacatgcaggatgtcctgcacccatttgagctccttaaaccagacatcgaagagctccattcgtccctaagccctataggacctcttaaagagccttgccagcatacctcaccttaagcatccatatcgcaacctttgaatcgcatccgtcgccaaaatcttggctgtccgggtaccacattctcaaggaggtgcaaggagtgctgcccaccataagtagagaagagcctgtaaaagtagtaccaagcgccatcgatatatctccagtctgttgctatggtatccgagcctcccaggtaataccaaatggcatccgtcttctgccagtccgtcagcatggtgccgccatccgcaaagagataccaagagccaccgatgaagcgccagcccgttgtcatagcgccagaaccatttagccaatactaggtgccgccttcctggagttaccccctctgcatgacgccaggaccagaaagataataccaggttccatcgaccttgacccagccagtttacatagctcccgattagaaaagataaggccaagcgccaccataaatccagccggtctgtatgcgaccttcgttgtcaaagaaataccaggagtctgaaatctcctgccagcccgtagggaatatccttcattatcgaatagatacgcatcatcgccgatctgcacaagctcattcttcagcggcttgctatctgccaagacataggcacgcttagctccagaaccgttccagtgaccttggggaatgtctgcggatgtgagagtcatttgcagtattcgtctcatcggctaccgccgctgcagcaccggatgccgtagcggccttctctgccgaagagacatctgagggcacagatacacttgcagaaggcacttcttcttggatcccctgcgttgcctctactgcagtgacggtgtctgtcccttcattctctgcagccatacaggtacgtgcaagacaagactgacaacaagcaatgccattatttctgtttcttgaaactatagaagaacgatgcaagaaacatgatgcagaggagcgccatcgagagatcatatgtcataacagcacccatgagctggtatgaggggatgagccatcccgatacggcatgggcaaagacatcagctccgagatagcagatgacaacgagtatctgtgcacgcatcgtaaccaacgaatagtagagaatgacgctcaatgcattgaacgcaccaccgaggatgatgacgaggagcgccgagagatatgcatcgagattcacaccatagagcaaggacagtatcggaatgcctatcagataagctgtcagctctcccgcgatagacacgccggcaataattgcgacacacttcagaagaagacgaataaactcattcaacttgcgaagctcgagcatctcagcaagcgatgtcaggagcggcttgaagacaaatccgaccaggaggtttatgacaagtgccggcatatagatgatggcatagacggtctggtcggtattgctgagcatctccgctattccatagcggggcacattgatgaggtcgctctgtaggaaggatccgaggaagagcggaaggcacgctgcgaagaggagtcccagcggcttgagggcgaaagatggccggatactaccaaaactccgtgccgctgggatattgagccagacaagagcgataagtgagacaagagcagtgatagtgcaggtagccagaagatttctcgtgacgataagtaccaccgtgaatgtcacagtcgaagttagagaacgaagaaacagggctcttcctgcaatatcgagtctccccttctgctgaaacatgccgtggaatacatcctccgccgcatcaaagaacctaagacctgcaatggagaatgccagaccagcttcgtaagagatgccgtaggtccagagtgcatagcagcagattgcaagaagcatggctagacatgtgatgtagcgtgagccaaggtaagttccgaacctgaaccgtcccttgatatcggtcgcctgatagggcctcatctcgaaggcgccaagaatctgatactgctgccctaccgcaaaagccagagagaagatgccgccaagctcggcgccaagcgtgcgcgtcacaactatgagaagcaagacgctcgagagggaagtcatgaggcttcccagtgtattccagaaatagttcttcttgagctgctgtgtttccgcgctattcacctgcacacctctctcggactattcggtgcatatctctacaccatatagaggatgacctcttcggcttgtgaaactatagcagctgaaggcattctacaatcgacattcatacgaccggaatctctagaattttggtctcatcgagaaaaggttgtcgttgtcgggcgaaaatgtcaccccctcgttgcgcgaaaatgtcaccaccttcgccttggaataagctcggtccatcacggaacggaaggagccggcgatggacagggtgacgaaagagagggcgctttggctgctcgggcagaaggccgatagcgcagggatcacatattcggagatagcgctcgagacgggatacagcaagcaacagctcatccggctctcgcacagcctggaggagtccggcgaggctgcggccctcgcgcacggcaattccgtatcgaggccccacaatgcggcgaggccggaggagatcgcctatctccggaagctcaaggagccatatccgaatgtgacgatcgcccatttcagggacatctacatcgaggatgtcctggagagccccgagaaggcaaacgacgtggagcgctacgggctctgcatgcggggcccacatggttcagggagctcttcgcgaaggagggctggaggtcccctgccttcagagggaagaggagggatgcggacggcaggcagcatcccatgagggagcccctgccccggatgggcatgatggctcaggtggacgccacaccctacgactggctcagcaccggcgagagctggtgccgagcatctcggagtggacgatgcgacgacgtccgtcctcggcggatagttcatggagaccgaatgcatgcgaggatgatgatcgagaccgtgagcaggcacggcatcctaagatctatgtattcggacaaggactccgtcttcagggcgctgaaggacggatccccgacccagttcgccttcatgatgcgcgacctgggcatccgcatgatcttcgcgagatcgccccaggccaaggagagggtggagagatacaattcgacagcccagatgcgcctgcccaccgacgccgtgaggttcgggatagacagctacgacaagctcaattctcgtatcctccgcgcgaccccgtgagcgacttcatcccgctgcccgaagggaccgacctgagccgcatcttccgtacgagggagacgagggtgtcccatggatgcacggtctcgtacggaggtgcccggtacatgatggcagatgccgacggagtggtgctcgaggtgccggacggcactgtgttggatgtccatgtggatgcggtgacggaagagatgtatgtcgagcgctccggcaggagatggggatgcaggcccatctccccgagagagcccgtagacatatctgagctgtaatcttttggtggacagtgggattcagggactggcagcagatatgctctgtccagatacccacccagcacagtcaacagattgaagagatgagatgtcgctaagcgcaagcgagatagagaaggcaaagtcccgcacgaagccggaaacacccaaacactacactgaggaagtattgcctcgaggctatcgactactgcaggaaggcacgtaaggccaaccctaagaagagcatcagagaatgcgccgcgaagcttgaggccaacgacaagaccttaaacgactggatcatcaagcactcaaagaccaaaagggtgacccaggtaaggaccgaggagcacaagcagctcgacagggccaacaggcgcatacacgagctcgagagaaagaacaagttcctaaaaaagaggcagccttcttcgccggaagcctctgttgaaggacaggttttagctcatgctggagaagagggcaacctacagcgtctcgatgatggagcgcgtactggaggtgagcagggctcacttctacagatggctcaaggccggaggcggtgaggacctatggggtcctatcaaggaagccatcatctagatatgggaggaaagcgacaggcgctttagcttttgctaggtctgatccaagctcacaggagatccgaagttacgcaaaatttacaggcacgacccgctaccgtgtgcgcaggtgcatggctaagcttgggcatctgtggcatctgatccaatgcatcgaagaggacgacgctgcccgcacctgatacccccgagcgccccgacctcacccggcgcggcttttcgtgtcccgtgccgacagccaagctcgtgggcgatataacctatcgcaggaccacggcaggctttatatatcttaccgtcgcacaccatctgtgcacacacatggtggtgggctgaagcatacaggacaacatgagggcaggccttgtcgtctttgccctgaagatggcatattcgcgcggatacgtggccggaggggccatattctaagcagcccaggcagccagtacataagctcaaagctggccgcctgctcagccgtacacgacgtgaggctctccgtcgggagaaccggaagctgccacgacaacgcgctcgccgaatcgcttttcgccacgctcaagaacgaatggtactaccataagcgcctcttagatgcatccacgaccaagcacaaggcacacgagtttaatcgagtcatactacaaccgcttccgcccgcataagtccataggagatcgcgtaccggcagaggtgatgcaggagttcttcgagcgcctcgagagaggccttgcatacgatccaaaggcgatgcaggtcgcatagaatctgagattcctctgtccattatattgacagggctcaatcgtcggcaccggaccgcagggggctgcagcatctcctgtcgcagatgtcaggagagaatgcagctaggagagggtgacattttcgcccgacgacgacactcatcgagaaaaggtttcaatcccatcttcagaattacaagagcatgtacaataagcataaagtttttttgaaagatctaacagtctagataacaggtgatagtgtacctgcgttgggctgtgaaaacttgtatcgaccatcatcatatggcgaaccactcttgcagtttcaggccaccgaccacgggcttggttgacctggaagaggtagacctaccagttgaggtagcttttgcatgttggctatggatatgcctgtgaagcaccagattcacccgttatctaggctgttagattgaaagatttagcagccagccacaccagacccaacccgtcagaaagcgtgaatacggccgtgaagttcgtagattattccgatccagaagagctcaagcatgtgcagagccttctcctcaagctcatcaaggagctcaggcgggtatgcgatgagcttggcatacagtttttcgcatatggcggaacggcaataggtgccatccgccattatggattcattccttgggacgacgatgccgatgtagggctcttgcgtagtgactacgaactcctgctcagagagggcccgaagcttctcggtgacgaatttgagcttgtaaactacaagacgaacccggactatccggccaacatctccattctggccctcaaggatacacttatgattccggataccttcaagcactgccgttatcaatatcccatccgcatcgatatctttgcattcgacaatcgcgtgatggacgatgctcttttccgcaagcagtgccggagctcctgggtttggggtaggctcaccttccttcgcggcactgctcgcccatacatcagcttcaatggtccgaaagagaaagtggtgctcgccttgtgtggtctggcacatggattgcttgtccttttccatgtaccacagaagtggatctgccagaaatgggaagagaatgcaacaaagtatgatgatcagccgtcagataccttcatagatttcaccgatcgcttcccagagaaatgggaaatgagcagagatgaactgctgccgcttcatgaagtttcattcgaagatacgaccatattcgtacccggcaaatatgatgccgttttgacccgaggctatggcaactacatggagctgccgcccaaagaggggcggaaaaaccatcaccctgctgtgcttgatttcggacgttactgaagaacatattctccgatttcaaggcaagctaacgcataatctcagatgaggagtggcttcttacgagagctcctctccgtcttacgccaacgctgcatggctcacagaagatcggctacaggaagcggcgtaggcatcctgaatctgctggccatattttatataggcatcctgcagctttccggctcacgctccatatgtactatgagagtctcccaccacgaaatgatgttttgccatttcgcctatgtcatcgttgtaaatcttcgccaacttgccaacctctccattgcagagttttgccctgccctcgatcgtagaataaaccgaatactcggcattgtattcagcaatgagccccggcgtggctacagcaataccggtggaataatccgcaagaatcgattcatggctgctgtcactaccagctggaatccacctgccatcgctgcctacatagtatccgtccgacatccaggcattcgtcagcatcgctgaggctgcatcgagatagtagtcttcgcaccagcagtttgcatacatcgccccgccaccatcgaagtagtactaggatccaccgatatactgccatcttgtcaccatagctccaggaccggcgaggtagtaccaggtgcctttgagattgagtcagccggtctgcatggtaccaaaagaggcgaagaagcaccgagatccatccaacagctgccgtccggtctgcacatcgctccagaaccagcgaggtagtaccacgtcccaccatcattcagccagccggtctgcatccatccctcggtatcgaagcgataccaggggccaccaattttctgccagcagcttgtgggatatgagccgtccgcattgcggtaccaccatccgccattcgaagcgacccatccaacgctctgctgctggccgctgttgccgccagacctctcgtacctcgcttcgcagacattgcagacatccctgcttccatgatttccaaatgcaatgctcgtgacaacgtggccgctcaatgtcggacagtctctgtagatgtgataggcatacccgtagcgggtgacatataccgcagcactggcaccgagcgtgaatgcccgtgcttgcaccggcatcatgctgaatgcgagcgtgacagcagcgattgctgcgaacatcatcgacaatgatgtgttcttcgacataacatcttcctttgcacgcagctgaacatatgtttgaaacgcctcaaccctatgttcgttcttgcttctacatattgattctgcaggcgctaagaaaacagggcaggcatcccctctggatggatgcctgccctgcagcatagatagacagatatcttcgatgccaatgcatcagcgtgagggggaaaggattgctttccagtcaggcgtggcggaaagaaccgtaccgcagatgatcacgatgcagcagacaatctcgagaggccccggaatggctcctgtcaaagccccgaatatcacagcccaagccgaatatgagatgttcagcgccatggcctttgcaggaccgatagcgtcgatccccttgtaatagaagagataggaggtagtgccagcgagcgcggagacaatcagtaccaggttggaggctgtgggaagcgcccggaataccaggccatagctgcccgcaagaggcacgatggcaattgcatacatcagagcagacgaggtttcacgtatctggagcgctgtctcgttatcgacagagtcatccttcatgccccatgccagtatgactgcttctgagccccagccgatgacacagacaagggctcccaggatgccaagaagcgggttccctgggacatcggcagaagcagagctccagcccatcaccatgatgcccagaagcgcaacgaacagggcagcaatctgcttgggcgtcatacgctccttcagaaagatataggagagaaatgctccgaaagccggatagaaggcagatatcgctgcggtatagcccgcaccgatattaccgatggccagaagatagccgctcatgccaaggggtccgcccataagtgcaccgaggacgacaactttgccgcttctggtcttgagtgctgctgccgtatccctcaacctgccgcggacacccatgaagatgaaaagcagaatcgcgcaggtcgcgtcatgcatgaaggcactcgcaaccgttgcctctgctgcgccgacaaagggcaccatgcccagagcaatgccgaggatgaccgtatcgataccccagagaatgccactcataagtccatacttcatggctattcctccgatctgctttcttccttcacgccataccaggaaaggacctcgtcgatatagtcggcagcatagctgtaatagatgtagaaccactcgcccacattctcaccgtcggcttccttcacgagcgaccagacataccagcaccagccagcaaggaccatctgtccccagaaatggcggcgctcttccagcgccggcttgtggccgaggtagtaggaaagcgctaggtctaccctcttgcggtcgagctggcagcagacacagaacgtaccgaagtcatttgccacatctgacatgcctgcatactcccaatcaatcaggctgtagtgcccttcctggtcgatcaggaagttgagggagaagaagtcgttatggttcacgcacttcggatagccatccttctccagaagatcgtggagcctttcagccttgcgcccaagctcatcatagccaggaacatctattggcccacgctctttgagctgcgactcatagcgcttgccttcttcgaagaagtcgaacttcctgtccagatgcgctccgctctcgtggagcttgcggcacatctccatggccgtcttcagctgctcgtcgtccatagggtcgagactcttcgcattcgggatgaagcgggagatcttccagccgacatcgggatcctcgtagatgaaagtctcgtcgaggcccagcttctgcgcaagcctgagccctgcttcctcggaatgcctgtccaccagcttctcagtgccgacaccgggatggcgatagacgtattcgccttcatcagtgctgaagtggcaagaaaggttcgtgaggccctgcttcagaggatagaaatcgcgaatctcgtttttgctgcaatgtaggaccgacacgatgttgtccaggatatccgagtccacgttctccatgaaggcaggatcgaaatccctgagctcgtctatcgaatcgaattcgttgatgacaccggcaggatacttcctgatgcgcatgtcgagctctttgacatgatcgaggtagatactctcccagagctttccggcagtctccggcttgctgtattccgcctcgaggatggagacaaatctcttcgagaactcccggtcgaagtagacttggccgagcatgatccagcaatcatgtccgccgaccgtaacacctgtgatcctgccgcttgcagcggtctcgatacaccattcgtcggtctcacccgccgcatagatggcggaatattcagccttgtagacatggtcccgaaagacattctcagtgaagtagtcatcagaggaacagatataggtattgccaaggatagtgcgcacacgccagagcgtagcgttgttgttgcgcgtggcatattcggggttcacgacaatgcgtacgccgaacttctccttgagatagaagaaatattccttcttgtagccaaccactaccgtgatatcgtcgatacccgcttccttgagctggcgtatctggcgctctatgaggatctctcctctgaccttcagaaggccctttggcttttcgtaggagatgggcgcaaagcgcgaagagagtcccgctgccatgatgacagcattgtccacgcggtatggatcgagcgcgacaaggcctctcgaagagatgcccccctcttccacgagctgcttctcggagagctcgttgagtgtcttgttgacagtgcccaaagacagtccggtcttttctgctatccgcctctggctcggcctggatgcatccctgctcaactcatagagcacttcgaattccttttgctttagtgccatggcagcccctctgtctgcgttcgtttttaactgtttcatcatactattgaacgttcattttttcttgcaattttgaaaatttgtacaataagggttgcagagcacacctgcccagcaatcccggctccgtacaatgtttctcttccctatgtctctaccagataagcgatccgttcgaggagaagtaatgggtcgtaccgtctatggtctggtaccccgtgaccatcgcagcgcctgcgctcagatagtaggccgtgtcattcatttctatccagccggtgccatacgccctgacggcgtgaaccagtaccaggcgccattaatataaccccagcctgttgccattgctcccgaaccgtagaagtaataccgaatatcgccgatcttctgccagccgaccttcatgatgccattggttccggagtaacatctgcttccacccacatcggatcagccggttgccatgtgcccatcgtctgcaaagtaatagtgcgatccatcgagcacctgccagcctgtctcgagctcgccgtccaacgagaagtaacacttctgtccatctgcacagctcagccaaccggtatgcttcacatcctttgcgtcgtaatagtgaagcgccccatcttcgagcttccagccggtatccgtgttctactgcgccgcatatttcatccatgcttcttttgtgccgtagaacttatcgacatccagcgctccatcccagccggaaagataggtcgtattcgagtactggaagagggcaggaccgctcttccaggaaccataatcgctgctactcacccatggatcttcctgatatccgtcgtggcgggacatatcggcatactgcgcaacccagagcccatagtcggatgcgatgttcgagaagtcatgcgtcagcacagaattcttgctcatgtagatgatcggacgcacacccgtcatctcatagactgcatcgagccactgcttgcaccaacctgtgccttctgcctcgatgtcgctggaggacgtattctcccagtccaggaagagcacagccttgccgagatagtccttgatgtacttgacgaaatactccgcttgttcgagagccgtgcttcctgtacgtgcaaagtgatagatgccgagaagcttcccggaggagagcacggcatctgcctgtgtcttgaactggggcgagagatacgtcgtgccttccgtggccttcacgataacgaaatcggcagagatattcgcgatatcgatgccgcgctggtaattagagatgtctatgccgtcgaggacggtcttctcttccgtttcagtcgaggcaaggagtgctgcatggcgaacggccgtggctgagttggaagatgcagcagcctcagaagaactctgcgcagaaacatccatcgcttcctcttcagtagcagcagagtgagaagattcagcgatcctgtccttcttctccatctcttctgctgcctgctggtctgagccgaacgtggccgtggaagcagcagaagacttggatgtggggattgcagaagcgggagctttgtcgccgcccatctcattctcggaagaggctgttgaatccttggtcgtttcagctgtggtagaggcagtgctcttcgtctcttcctgcaccgttccgctggcagaggtggattctacgccgacactatcggattctgccgatgccgcttttgtggtggtctgactgctagagacggcaggttcggcagccagagccgggcacacaaaggcaagggtcgaggccacgacagcagcaacgcttatgcggagcatgagctcacgtttgggcgagtaggtcatatgctcgggaatgtagtgcatcacaatgtccaatcagatattgacaatcataggcaatgcctccatgctagcaggcagatatgcccattcagtcccataccatgggatatacagcaaggctcactgcctagctgtgcggagctcagggtccacctcactcttctgccggctggaagacaaggcagacgggacgctcgatagcagcattctgctcgatcaggcgggcagcggcggcaagcgctgccgtatgcccgtcatgactgcatttgtgcgcgacaccaggcaccacggagccatagggaagctcaatcgtctcgtctatcggcaaggcatccatatcggcatggaatgcgataggcgctgcaacttccgccccttcaggacagaagcgcgccgagagccagctgccgtagtcagcgagtgctgcagaggtatggaaagagagggaggacctgatccgctccttcgtcgtcatctctctgcccgagagctcggtatgggcatgaagcgcgtggcagagagagacgatctcgtcccagaatgcgctgtccatggctgccccttctctcctgctgtctctgaatctggagcgctccaggcatgccgaaccatgttgtcgctatcccgaaatggagggctctgtcctatggtggggtgaccgaagatctggaggaggaaggggcagccatggcagagatcaggtgcgccacggcaggagaaggccgctttgcgctcgaggcattcgctgcccccataccccgcggcatcgcagccgtaacctgggtcaatatttcgggtggcagactgtcaagctgagtgcaccatctccctaaagacctcgttggctgtctcgtagcctgataccttcctcgccctgtcgcagatcagctccgctgcatgctggacttcctcgtctgctaccctgctaaagtctgtcccccctcaagaggaactcgcggatgaggccgtcagtgctcataaccgccggcttctgtcaggggtggtgcagctcgcagaagtagaactgcacgcctcaaagagctttgtgaccttcaccataccttgcgaactgcttgccccgctcgggggtgattgtcttaaaggaacggtccagcaaaagttcgatctcggccttcaagacatcggcgctgtcgtggtggcatcttctcgcgacaaggagcctggacgctctgttagcaagcgcaagcaggcatacaggccccactcctataagcgtgtcgtctacccagtcatcgaggtgcgagcctacatctgcctgcttgggtctatcctttaggctgtgtgagatctcgaccttgccttgggtcttaggcctcttgctgcagattcgcttccctctcctgcgcagatggtgacacacctggcaactcgagggtggcggctacgggcctgcctgcagaatagtcgagaggctcaacgacgcagctgacaccatactcgagcctgagatgtcgcctgtctgcttggggaaccaacgctcgtcttacgataagcgagtgcagggtctgagtgcccccttttcggcttttccctgccgtgggcgggcagctgccctcctttggggccgcgcaggcgctaaagcgtttgtgccgctcgtttttcgcgatcttgtggcagacgctggatctgtccctgccgatcttgcgcgcgatgaatccgatgaagcttcccttgtgccacgcagctcggctatgcagttcctctcctgtgggcttgagatgcttgtagtggtgtattccttccagctttcgacgttgatgtagacaaccaacatcgtagccttccgaggtgcgccacgtctctgtggagcgggactatcctgttgcactcagaatgctaatctgccgacacaaacttcttaacctacgttatcatgaatgacagagatagaagaatggaggtatgtgcaatggacacagacagcaaggatctgctcgatatactcacgctcacctatctggctctgacatcgaagacagagggcaaaggtagcaaggcaaagcaggttacgacagataggcttgccgacgaggcactcgccgatcttgcccacaacggctatatccatgtgtccaagggtcctggcgagcgcatagagctcacgccggcaggagcaaccacaggagcgttcatgaaggagctcttcagcgctttccagcaggacatctatgcgacagtagctgcagactcggaaaagcagcagaaaccccagaactctgccttcaagttccacatcgagctcgacctcgggcatgacctgacgtgctggcgcgacatcgccgtgccgcaacacatcacgttcggccagttccatgaaatcatacagtctgctttcctctgggaggactcccatctcttcgaatttcggctcacgacccacggcaagaagatcgtgatcgaggaagatgccaacgagccaggagaggccttcacgaccttaaagaacgatacggtcgatgcagaagctataatgatagacgaagtattcccacggacgaagaatgctgtctacgaatacgacttcggcgactcctggatgcactctatccacctggaagagacgatccgttcctatcccggcacgcttccccgctgcacggcaggagaaggagcagctcctcccgaggatgtcggcggcgtcttcggcttcagggaattcctgtcagcgctctccgatgtcacgaaccccgaccacgacgatgccgtggaatgggccgacaccgaaaactatggtcccttcgacctcgacgaagtcaacgaccgcatgcagcgctggttcaacaccggaggaagagacgacgcagatggagaggatagcttggaagcagacaatacaggagaaaccgatgtcctgaccttcccacagaagtagagacccgtttcctctctgcagatatgcatgcatatgggcggtctgcatcgaccataatcgatgcagaccgccctttcaatcgactatggtcgattgcctgtcagcagcctctcaatgccaggcgaccgaagaaggctctctgattagactctctttctgaagagcctctcaagcccttccttattgagcatgagatgcacgacagcacagatgggaaaaggacttccaagcacatatgcacgatgcctgctaccgtgcctgtcacctcatcgaaactcatgccttgcgccatgcgcatcttcatgaggaaggcgccgctcacaagtgctgtgatcagaaagactgccatcgcaaaccccgtgcaacagtcgagcctcgtatacaaatccacgcatctgtttgcaaggttttgtgtcatgccggcaatcttcttatgagctcgcatcgcatgcaccatgaccgcaacaatcagcagcatgcccaggagtgcatgtacataggggtctgcgtgtcccatcaggtaggtgcagagaaggaacatggcacagatgatatcggttgtaagtcgtaccttaggcgtgagcttcttcatggcttccttcttcctctctattagacaaaagaatgttagcctattgatacttcttgcaataggtcatattcggccgcttgtagactcaaccagtccgattggatagagcggcgattcttcgaacttcaggacaaggacagccagtaccgtacgttcaatgcccgtgtcgtcgcgatggcaaaccctgcaacgatgctcggcgtccgcgtgtcacacctccgccatcttgtgaaggagatcttgcgctcgggcggcaaaggcgatttcctttcggagcttccccactgctattaagagggatacctcctccataccttcgtactgaacgaggagaaagatcccaatcgcacgatagacaagctcgaacgtctccttcccttcgtcgacagctgggccgtctcagactcccctgcgccgaagtcgttcagaaagctttcccctgagcgcctcaaggagctgagcaggaagtacatggcatcatggcatgaatacacgaaacgcttcggcatcttccttctcatgcactatcccctgcctgaccatttcaggcccgggcatctcgtgtggacaaaggatgcagacgacggacgctactatgtcgagatgatggtcggctggtatgtggcagaggctcttgtcacgcaggagcaggctgccctgcccttcaccgaaaagaaagagcttccccagaagacgaagcgcatagcaatacagaaggcactcgacagcaggcggatctctgccgccatgaagaagcatctgcgacacatccgcaccgagctctgattttcgacaagaaaatgctccggtgtgcaaggagacaaaagcaccggagtatataggattcccaagatgtgatgtggatctaagagtcctttgggggacttgttgggggagcatctcacgccgacatcagttatacccaataccacattatccctgttcaaaggctacatcaggcagtgtcttctccacagctcgaacacgttacttccgtcacacatgtgcgcggggtgtggagatattcagtcccttaaccaggaccgctctcaaaatgtgcgcgtgaaggccagtcgttcgtctcccgaatgcgcaagatggatgatgccacaatagacaaagccgcagctcttgatgagacgtcacatcggcatattgttcctgtgggtgtcgacccgaatggctacatcctcgctctgtgccctctcgagtgcccagcgcatcatggcagagctgaggcctcttccctgctcggctgtcgtgaagcggtgcacgacgtcgtatcttccatcgtcgtgccatacgccctcgcggatctttgcatagtcaggctcggagccagcgaggaaggcgaaggcaccctgcgacacatctagctcgtcagtccagaccataaggtgctgtcctgcgatatcgcgcgttatctgctcttcaggcggaaagcccggctcccactgatgcaggtttcctgccttcaccatgaactcctgcgccacacggtagatctccatcgcccgcggcagatctgccatcgtggctggacgcacagaacccataggtcatcccctgaaacgaaagctttctcgtctctagcgcgccatagcgtccgcgaaggccttgacttccttcaggcgttcagacgtcggcttgttcttcgcatagaacgtcttctctgcaaccacgacgccgcgtgcctcgagctccttcttcataaggtcgaaggagtgcttcgagagccaggtcgtggagaagagaactgcacgtcccaccgtatcgccgtcaagcgtttggatgaaggagacaagcttcttgtcaaggccatagacgtagagggcacctcctatgaagaggacatcggtgcgtcctgtgagcttcgcatcagggctgtcaacagacactgccggcacaccgagctcgtctgcgatggcttctgcgagaagacgggtattgccggaacgggaatagtagcggactgcgcacttcatgagatcctccttgcactgtgactgctatatgttgtgtacatatattaactctctgttagaccacgattgatctgagaagggcccaatgttgtccgggcctttgcctacaatgcatgtcgccaaacaaagacatcgagaaacggaagggccggactcaatgatactgcagcagatcgagaagatgggcatcgctaagaagatagcaggatccgctctcgcaggtaaacccaagagatgcttaaggtgcacatctgcagacctcttctgtaaggggcactctgcacaaggccatcatggaagtgttgctcctgcggcaagaccttctcggcgaagataggatcggtcacagcgatatcgaagcttttcgccaccacaggggcaaagtatgcaaaagacacgcttgtgggcatgtcacttaaaccagcttacgaagagctgccatgtgagccttaagggcctcatgggttccatgcacatgaggctctttgaggtagtgggatctgccctgcagtctcccaggagcgcccatgtcgtctgctgtcaggcagacgggctctccctcgacgagtcgcttgtgggcagcagggcaaggtcggatgtgcagatgcgcgatagcacacaggccacagccatactgtgcactcaagcggtatatcaagtctcaaggtttgcaaagagtgctaagcgagccgggagagcgagtatacaacacttcgcggaaggtccaccaattcaaagttaaaggttgccctttcaggcatcgccgacagctcttgggtcgtagccgacaaccatgcagggtatgcgcgcatcctttccttactcggcgttgttgagtacacaccaagcgtggtaaagaagtccaaggacagcgagaagcggccttgtcaatgcgatgcagtaaaggctcagggaagttcttgcttttcttctacagggtggcgacaaagtggctcggccactgtcgctcgtgcttcctgtggacaaagcgggcaaggtattcgaagcaggacagcagggcgatgctctcaggacagctggcagaaggcagctatgtgcacacgaggcgcacttgtcgacatgcctcagcctctcagggactgctggaaggcaaggaccgaggccaatggtggtctatattaacccggccaactgccagggcgaatccggacatgagccacacgtccatggacgaagcatgaaaatgctcctctgtgtataccaattcctgattccgggaacaagaagaccaataacagcgaacgaaaggtggatctcatgtcttcgaatctcgagctttacatcaagaatggctgcccctggtgccacaaggttctctccttcatggaggcaaacgacatcgagctgccgctccacaacatcgacgagtccgaagctgaccgcgagcacctgatcgaggtcggcggcaagcgccaggtgccctgcctcttcatcgacggcaaggccctctacgagtcttctgacatcatcgactacctcaaggagcacgtcgtggaaggcgaggttgcagagccaacccctgccgcagatcctgctcctgcagccggcgcgcactgcacgctcgatggccactgcagtttctaatcgattgctgaagcccttcctcatatcatccggaactcttcgcgaggtccggacgatattcttttccattcgttctgccggaagacggaggacaagcagcagcatctgctttcacccctcccgaggaatgcagaactgacctgtgacagtacatcctgcctcatgcctgaccgagaaagggtacagtccgagtcccgagaggtagaactagggaaacgatgattaattcccaatgatgtgccagaaaggaccatccacgtggcctttcgcggccggcataggcattaatcatcgtttccctgggaggaggtgctgccgcatcttctgatgtgacccgcaggagtctaaccagaaatcggagacgcagcgcaaccacaagcagctgaaggaagatattccccaaggggcatgtggacagggacgtggcactcgcctgcagccgtgtcaactcgtacccactcgcctcgataggtagctgcccgttcgacgagctgggattgcccctaccggaaggacactcacgagactcggaatcgtgcgcattcccgcatacagcgtggtgctcaagcccacactcgttccgcatgcatatctgaggtagcataggccgcatgcactgcctgcggcatgcagccgccggcagcagcagatccgtccggccccctccgttgcgcacagttgtgcagttgtgcaatcctggagagggggccgattcccaccatggtcggaaagcgcatggtccgacgtcctggatgctccggagggccgaattgcatgccttgtcgcaacgtttccggcgcactttgcagaacttggtgcaaccatcgcgcttcggcttaaagtgttgcacttacaaattcaatccacccttaagcatccatcctgcgccttagggccgaagccttccgtcggtaaaatcctgctgtccgggcaccacgtgctcaagaggatgcaagagcgttatccaccataagtagcgagagcccggaaagggtgagcttactccattctcctcatgtacctcagtagcattaggactgtagcggcacccatcgcgatggcggcacccgcaagcacatacccatgcgttccgataccgcccgtatcaggcaggacatacgatttcggcatcgagttcgtcactgtgatggagccagactgaatgccagcattattgaagtaggagacagcgtacttggagcttgcacccgcttcgtagtaggtgccatccaccgtgtaacccaactcctccacggtgtagtaatactcatggccgttcccgtcgtcctgcggcaggttgtcccagttgtggatccagttgtccgccgcagacacagtaacggagtctcccaccactgtcttggaggagccatccagaatctgcttcggatcctgccaggacttggacgaaagtgagaacgcattataattacctgacttgacatcgaccgtcacgtctgaagttagattattgagcgtaaccggcactggagtattgaatgcgtcaatcgtgcccgtatacttcgcgacaccgtcaacgtagactgtatagatctgcccgttatagccagctatttggaacgtatagtcagtaccctttttgacgtacttcacaccatcagaggttccatccagcttcgtcttctcctggccagtattcccttcgcttgtgacagtgaccttaacggcatcgcccctgtccatcgtcttcgtcgagcgatagagctgcagccgcacgctcgcaccagaaggagcggtcgccgtagttccattatcgttcgcccagttctttttcactgtaacgcgggtgtacttgtccgtaatatacatgttgccgccggcatgcgagaagaactcgatggcggaacgctggattgcgttgccggaatcgtcctttgcattcgcagccttggactcgccgtaggcggtatccgcagagacaccggatgccctccagatgaaatagcgcaccgcgtcgcaggcatagccatcaggagcctccgtctccttcaggcgatacagcgtattggccttgaggctgtcagcgttctcttcgaggtcgtaggtgatggcaccgttagcatcggtagtcagcggcatctgggtgttgatcttgttccaagagccgctagcggtatcccagtagtccagctcgaaggtagcacctttaagcgtatggtggaagtcatcctcgtccgtcttgtagacgacaagacgcgccttctcggccgtggcggaagaatcgacttccttgagcgtcacggtatggtctgcgctgaacttgccggagagcgatgcattgttggagatcgtcttgccgtctacaaagctgtcgttgagctggtagacatataccagtacgcaggctgtcttgtcaggcagctcgaccgtgatcttgtgcgtggtctcatcgtacttcacgcgatagtcggcaatctccttgccctcgtcgtagtgatggtccttcgtgatgtcatacgcatagaccttgatggagttggggtcgagcttcggttgtaacgattccgtcgtaccggtgtcgagattcaacgtatcggtgagctccagctcgtccgaattggggtcgaggtcctctgcgcccgtgttaacctccacgtagtagcgtacctcgccggaagacgtgacggtgggcttgccatctgtgccaatcttcaccggattgccatccttgtccagctgctcgccggacttggcaaccttcgtcgcattgcgcttgatggtcgtgttggatgtggcggagtggctgtcccacttcgccgtattgctataggtcttcgacctgtccttcgtccaggaaggatcgtccttcacggaaagctggtagtagatggcgatcttggaatactgatgattgccatcatcgtagtacttgtagtttgggatggtgacagtcatgaccgtcttaccatccaccgtcgaagtcgtggcctgcggcttctggtcgccgttgaagtcggtcccgttgtagttggtcgtctgctggttgttctcgtcagcaaagaagttggcgcgcaccgagccatccacgagcgtcgccccatcaggcagcgtatcggtgacgatgatggtcttgccggaatccgcctccgtcgtgctcagcagcagacggtaggtcagcacgccgttgatcttgtcgtagtgcagtgtggtatcgccgctcttgtaggtatccgtaccatactcactgcccgtcttcacctgcttgtcgagcttcttctgattgccgaagtcgaaggtggtcgtagctttcttgtcgcccacggcagcagtattcgagatcttccaagatgaaccctcagctgcgcttgcgtggtctacatgggtcgtgtagctttcgagctccatggtctgggctttgacctgtactttgtccttcagcgtgacagtgaccttgaagcccttcacatgcgtcgtggtgtcactggctgagacctcattaccattggtatcgtagtaggtgaccttgatgtctacgtcctgcgttaggccatcctggctatcatagtagctgtcatagaaggaaccagcctggttgtagccagcatagtagtacctgttgtagccatcgaccttgatgtagaggtggcccgaattcgtcttcttgccatcgactacggtgctcgcaaactccttctcgagctcggacgcgatagcgtaatggctgtccgcgcccatatcatcgccgttctcgtctctcgcattctcgatggtgtcggtaaaggtgaaggacgtgatgttaccttccggcagtgtgaccgaagagttccagtgctccgtagccttggtatcgttgtcgagttgctcggtcgtatgtttcttcgatacatcccaagagcggtgcttcacatccgtggtaccggttcctgaggtggtctcgccaaaaccgttcgtagaggtagcgctgttggtcacctgtccgtcaccattcggtgcatccgtatagacgtagatgtagaacttccccttcttttgggtgtcgctcagctgggaggcgatgctcgagaaactgaaatcgaccgaggcatcaccggcattgccgaaatactggctgaaggagccatctgcactcttcacgcagtatttctgcgtcagcttgcgtccaccggtcaggatatcgacgaccctccaattggagatatcctcaccattcgggttcactgtgattgtccagacaatctggccggtgttcacatcgtaggtaccggttttctggatatccttgtcccagccgacgatcttcgaactccactggatattgccctcatagccggcgctcgcgttgttcgggacctttaccgtgtcggtgttcgtggcattgacattggcggcatagtcgaccacatacttttcacctgcagagagcgcaggaaggttctcaatcttgaagttgggaccgccattgctgtcggtgctcgtattgtcgagcatcaacttgtagtcggaggagttcagcgccgtcgaagtgccattggcatcgatcttcctcaccgcgatggacgatacatcgtaggtggggttggcattcttagtgttgtacttgttcagcttgtcggtgatggtgacggcgccgtcagtacccttggtcgtggaagctatcacctcgtagttgatagtcctcctgtccgggctcagcgtagcagttttggcaacagcgatatcatgctcgcctgtcgacggagtctcctcatgcttcttgatcgtgatactggaagagctgccaccaaagttgacggtcttgtcgctcgacgtgctgctgtttgagacggtgcccgtaaacttgagcgtgccctcgactgccctgccgtctgctgagaaatcatcgttgaaggtcagcgtcgccttgccggaagcgtcaatcgtataggtgccggccgtcgtcttgccgccgctctcgatgttgccgcttgtggccttggcaggcttgatgccatcaggcaatgtatacgtgacaactctggagttcgaggtgagagtgttcttcggaagcttgtatgcgatggagacctttacggcatcgccgtcgttgaactctgttgcatcctggtagttcccgttcacgagcttctgcacctctgtgctcgtgatgtagttcgtcaggtcaatcgtgctgttgtcgtttgctgcaagaagcactggtgctgccttggctgcgctctttgcgccctcggcagagacatcagaggctgcaacatcctcgctggacgtctcttcgtcagaggtatcgacggacgctgcctctgctgcagtagacgtaccggaagaagagctctctgctgcagcgtcttctgtcaatgctgtctccaccttcttcgtgacttcgagcttcacaagatcggaaagcgcaagcttggccgtaccatctgcgtcacatacaagatcttcgaatgtgaggtcgatgtcagcatatccgccgagcgcctcccctgccgtcttgccgtctgcagagccagcattcttcgtgcatacgctctcatcgaatgagaaagcgacaacgttgtccttgatcgtataggtgccgatagacgttgcatccgtgcgagcagggtccttcacagttgcatccgtgtacacattccctttgacaggctccgtgcttgtgagcttgatactgtcaggaagcctatactcgaggatgcttcctgccttgagcgctccggcatcgagcttgaaggcaagacgcagacggagctttgaggtggcgtctagaggcttctgtgcatcgaccttctgccagtcggtctccgtgtcggatgcggactcccagaagagggcggaatcctgtgtcagggcgttctgcatcgtcgtgccgcccgtgagtgccactgccgtgccgacgagaagggctgcgacagcagcggcaaagacgacgcccaaggcccctgctgccccgcgccagctgcgcttgtggcggttgtcctccagcatcttctgtgccttgtcgaatatcctgctcatgatcgctccaactctgcgtgcatgttcatgtgtccgctttgctgctcaggcatcctgcctggtgtcacgttcttattctccgtttcctctcgttcaagggcgtccatgctccttcctgcttactgcgacgcctgctgcaataagagcgcagccaccaacaagaagtaaaagcatcagcaccaggctgttcgtatcgctcatgtcggcgacaccttctttgggtgtctccttaggcgacttctctgtgttcgtaatctcgaaaccggttgtctttgaggcgtcattcgaatcctgaatcctgctcacagaactcgcatagccttccggcacatcgacctcacgtacagaccagtcgcccgcgccttcccaggaaaagctccagctgttcgaggcgtcgagtgtgacttccttgtagagctctgtgccatccatgatctggatgtgcacggactcgggccttttcgtcctcgtatccttccagagtttcgtgacgcgaaagcgatcggaaggcctctcctccttcgccatctttgctgcaacactcacatctgtctgccagctaccaacagcctggccagcctctctgctctgtactgtctgcggcacgctcacgaggatcgggcttgccgtgtacgttatcccctcaaccgttatctggtcagccacgacaaggtaaagtccgcgtgtaaggccggagaagctcgcctgggtgccggatgcagtgacgtccttctcagagaagccggaagggtcctgcgccacacagccggagagcgtctctgctgccgtgcggagcgtatctgcgctcgtcgaggaatcgaacgtctcagggctcatggccgggtcatccgtgctgtagccaaggctttcgagcgccttgtcgcaggcaggcacatttgaaagcgtgccgtcttctgccatctcggccacacgataggcatggaactgctgccctgaaacagcacccatgacggtaagcgtgccagtcgtaggcggcacagctgccagagccacgcccggcacgagcgcaagcgctgcagccacagctaccaccactgcaaccagtaactgcctgagcgtgacatagcgtcccaacacttccagaccttcatttctcttcagaacttcgcgcttcatctgtccttgcccttctgcgctgccggagcagatatcttcaagccctgccgtctctgtctgatgccgtgaacaaggagagccacgagcgctgcgactgccgtgacgactgcagctgcaagcacagggttcacctgtgtggcatctccgtcgatcgctaccctacccggaacggatacgcggtgtcccctgacaaggagtctgtgcgtattcacgccgtatggcgtgcaggtcacgagcgtgcagaggtcgaggccgtcgtcgattgccaggtcatccagctcatcaggcagaacgatcctgatctggtccacctgataggaaagcgactttccacagacattgagagtgaagaggtctccctcggtcagctggtcaatgtccgtgaacaggcgcgcggacggaagtccgcggtggccggaaatgacacaatgggtcccctctcctccgaccgggagggaggagccaggaatatgtcccacgcctatctggagcgtggcatcatccgtgccgtgatagatcggaagctccacgttgatcttcggaatagagacatatcccatgatgccggtgccagtgacatcgaggagactgtcatactctgccttctcttcgtctgtcatctcgaacctgctggcatcatgcggaagccgggcgttgtatgcgacagccgcatcccacatcctctgcatcttctgggccgatgtgtcggcgactgccttctggtacgtggcaaccgcttctgactggtgcatgccgttccaccagtcagagaccgtcggatagagtatcatcgcgataccggccacaaggacacagccaagcaggatctctgccatgtgccttccatgatggggatgacggcgcggggcatgggaagcagcttctgctgcttcatcagatccactttcctctgcggcatcttctgccacatccgtcttcttctctgctatgtcccgtgccacctcctcgatacacaccagcgtttaagggatagcaggcacgtgctacctgccaccccgtaaagacttgctaggccttaggcctctttgtccttcttgtggagctggtagatgccgaaggccgctgctgcagcaagaactgcgccgccgatatagagcacagtcgtgcccatgccgcctgtggacgggagaatggagcccctcttgttcacgacatcggttgagagggagccagcattggtgtctgcagtccacgtagccgtgcctgtcttcgtgtcgccggaaagcgagaggagctttgggtcatctgcggtcgtgtcatgctgtgcggaaatcgtgaactcgatatcgctgatagtgttgtatccggtgggagtcttggtctcggagagcttgtaatcgccgtcgtcgaggcccttgaactcgaaggacgtctcgttgcctgcggtgtactgcttgacctggttccatttcccacttgcatccttcttgtacagggtgaagcctgcaccagcaagggacttcttgtcctggtcaaccttgttcacggttaccttgtaggtgaagacgatgtttttgtcctcaggggtcttaccagtcttgccgtctccgcccctgttcgggttattggagtaggtgagatcgactttgttgggattgccggctgcaccgatcttggcatcggaattcagtttggcggtgtaggttacgactatcttggactcgctggtgatgccgtcgatggccttcagaccctctttgtcattctcggtccaagtgaggacctggccgccggtgtagttggtatcagtaccagagtagtctgcaattgcctcggtgaagtgagaggtgatgtcgatacccttggtgtccacggcatccttgtacagcgtgatcttggcgttcttggcggtatacgtcaggcccttggatatggtatccgtgaagacatacttgtaggtcgaatagtcagcatagttgctgggcagcgtgccggtgatctggtaggacacgtcgtcgttaacatcagcgtcagcagagtcctgccagtcagaggtcacccccgtggagtcgttcgtgtccttgaccttcttggtcacagtcgggacaccagacttgatggccgacgtggcgtcgcctacgacctggacaatgaacttcgtgtaggcgtcggaggtgtcagtctgggtgccgtccttgtccttcacgaggtagtaacctgcatcgaggccatcgatgaccgtggagccctcagcggacgtgacggtcttagccggcgtcgtgagcgtaagcttctcttcaagctgttcaatggtcatcgtcttgttcgcaagcttctcagcaacctcggaggctgtctcggtaccagtatatgtgacaccggggccccactgcacgttggagagcgtcttggtgccatcagttcctgtcgagaggtcacctgtgaagatctggtatgcctcataggtgtggcccgtagtggtacccttgagcgtcagcgtgtaggtgtctgcagccagcgcgtttgccggcagcagcacgagcgccatggccactgccaaaatggcagatagggcgcacttgagcagatccttagtctttctcattgaagccttccttcttcgtgtttgccttgctgctatgcagagtccctcgcaaggggcttcatgccatgattgaatctccgacctgacattacgggcctggatcctacctctgttttctgtggaaattggacatatcctctcctgcctatccgacgggccgatctcaggggaacgacgtgctgcgaaaggcagctattggagaaagccgaaagttgggagcggccagatgcgcagaacgagcttacctacgatctgctctgtgggtatgcagccgacctgctgcaggcgcgaatcgacggagacgagtcttctgtcgcccataacgaagtacttgctctcgggcacctgatacggaaggctgatgtcgcactgccccaggcccttcgctccatccgaaagatagggctcctggagttcctgaccattcacgtagaccgtcccgttgtcatcgatatcgacccagtcaccaggacctgcgatgatgcgcttcgtcaggatcttgttgttgaaagagaacgccacgagatcgcctgtgctgtaggagccagggcgcgtggcaagcacgatgtccccctcttcgagcgtcggcgccatcgattcgccgtagatccgatagagcgggaacacgaaaagggacagcagcactgccgctgcgaaagcagtggcaagcacgatcgtgagcgtgcgattgcggtcatggtgatgaagctgggactcggtgcgcgcaagctctgcttcgacctcttcaagggtcggaagctcagtctttgcagccctctcgctcttggatggcatctcgctcatgcggtgctcgcctccttcttggaggcggcacagtcctttacggtagaagaagcatccgtctcggacgtctttgaggcttcctcgacagcgccttcccctttgtcttctgacaatccggattccgtcttaccatcaggagcttctggttcgtgctccttttcatggctggaaacgttaccagcccgttgcatggagacattccatccatagagatcgatagcgtgctgagcggcagtaaagacgccggcaaggcgaagcgatgcctcggcgagcgattctgaatcatcgattgcgatgcgcttgtctgcgagctgatcctttgcctctgtaagctcctgcttcaggcgctcgttctctgcaacggcgtcctccaggagctccaggagctggagccttgtcagctttgaaagatcatactcagccgagatgccagagaccgcgcttggagaacccccccccgaacgggttttgcagggttcacgagctttgtcgtcctgtcagtaaacaatctgctcatcagaacgctcaggccttccacgactgattagctaatatttatatacaccatagtaaagtatatcaggtctatctaccatgacggcaattatttaaatcatttcttagatttcaggcccgtgtttagctcttagcaccacgattcttcaggacccggacatggtccggaacccaaaaagccagccttgagctggcttttttcatgtccaaagcttgatcggctgggaatttcctggcgtcatctatatacggtgctatggtgctttcgtctgacagggagtggcagatggcctacttcctcaagcagacgcgcaacaaagaaagggctctatctccagatatacgagagccactgagaccccaagcgaagccataccgcgaacaggtcggtgaagacgctttccgccaaggagcgcacatgggcgctctcgggagatggctggacggacgtccccgacgggaagggcgagacatcgtttcgctacaagatggcggacggcgacttcgagtacacggtagagggagaggacggaaggaagaggaaggtcgagctccccgagaggcgcgtcgtcacgtacagcccctcgcttgccaggaagcagaaatacgagatagaccggcaggtggagaaggcgaggtcgctcagggcggcagccgcgaaaaggtccgagtacggcgacagcgcgaagtatgtcacgttctcccccgtcgacggcgagggcgagctcaggaaggacgcgaaggtcgcggccacgctaaaccacgaggcgatcaggaaggccagggcccttgccggctacaacatgatcgtgacctcgaagaccacgatgggtcccctggccatatatggcacctaccacaggctctggaggatcgaggagagcttcagggtgatgaagtccaagctcgatgcgaggcctgtctatcttcagaggcaaagcacaatcacgggctactttctcgtgtgctacatcgccgtgctgctcatgaggctcctgcaggtgaaggtcttgggagataagttctcctccagagacatcatgggggctctgctgcggcctcgatgtgtgccgcacctcggacaggaggtatgccaacatatccaggcgcagccccatcatcgaggagctggcgtcaaggacagggcctccgctgctgcacttcaacctcaccgaaggcgacgtgaaggcgatctcctcatgcacgctcgcccatgctgcgcggcgaagggaagggcccttctgccggcaggaagcgcggctgaagggccccatagcaccatatcggggatcgaaaaaccaaagtctgatatgatatttataatcattagcacagaagcaacttctttaagcagggcgacgtcggcgagactgcaggcaacgcaaccgacgagcggtggagcgactaccagacacagccagccggcaagcaacctactcgccgccatgcacctgcgggcaagcgacaagcagcccctcgttgctcgacgcctcacacgtagtacacgaacgagctgatcttgtcgtcgatgctggcgtccagcgcctggttttgttttggaggcgagcgcttcgggaacgcaaccgcaatgcgccgaagcaggcggaagaccgtgaactgctggggggcatggcagcttcggatgggcgccttgtgcgaggggcgcgtgggcagggcgtctggcgtaccagcccggatgcgagctcggcaaataatggggtgccggcactgatgcctggttctgaaggcctgtcgagcggcaacgttcacgctatcgcggcggtcgaaagacaaagtcttcgcttctgggtctgcctcaagtcttgctcgccctggcgtcgatgtacggaaacacgacatcatcctgcattttggaggcaagcgctgtcggggatcgagaacaccgtgtatgcacgtgaccttcgacggc

SEQ ID NO: 377 - DNA, 13932 bp, Unknown
  Metagenome-assembled genome
cagccggcaagcaacctactcgccgccatgcacctgcgggcaagcgacaagcagcccctcgttgctcgacgcctcacacgtagtacacgaacgagctgatcttgtcgtcgatgctggcgtccagcgcgccgtcgaaggtcacgtgcataacagggttctcgatccccgcagccgcttcctccaactgcaggatgatgtccgtgttctcgtacatcgacgccagggcgagcacgccttgggcgacctcagaagcgagctttgtcttcgccgcgcgatagcgtgcgtttgccgctcgcaggcttccgaccatggcatcagctgccggcacaagcgagctcgcatcgggctggtacgcagacgccctgcccagcgcctcgcacacggcagccatccgccgtgccatgccccgcagcagttcactgtcttccgcctgcttcggcgcattgcggttgcgttcccgaagcgcatcgctccacaaaaaccagaagtactcggctgccggcatacgcagcacgcatgtccccgacgcctctaagcggacaagcgcacccgcgttcaggttgtcatcccacacgagcggccattcccccacggccagaacgcgcttgcgcgcatcgttcacagccgcgtcgccgacccgctgtgcctcgcgtacgactgcatcgaacgcacacccggtctcaagcagccgtccgagcaccgcctcgcgctcacccgcgtccgcagcctgcgccacatcggccgcaagtagcgcgtcgaacagcgagtccggatccggtacccggtcgatcagtgtctccagtcgcggcgccacgatcggcgcctcgcttccgcgcgcatccaaaatgcttcttatcacgcggtcgtactgtccatcggcatcagcaccctgactcgacggcagtaacagctgcagcgccgtccgctgcgcatcgtccaccacgtcgagcgccatgcccagctcggcggagaatgtcaggtactccttcgtagtcgagtatttcttgccgcgcgcgatcgtctgctgtgtcgcagggtagcggcgcacgtcgaagccgcgccgctcaagcacggaagccaccgtgcgcgacaccgtgccgaatcccggcatggcgaccggtacgcccggatcaagcatacgctcgttctggtcgacggccttcacagtgagcggcagtgcggactcgtctttggcctggtagtggtcaaggctgttcagaaacgcctcgatgcgcgtgatgacgcccaccttcgaatagtgctcgtccacctcgatctgcaggtagggcttgccacccatctcctcggccaccaggtgcgagagcatcgtgtccggcccgcatccgtggttggtgaggtacacggcgaacaggcgcgggtcgcggcggatcagcttgatcgcagacaggatatgctgcccaaacggccagtacatattcgggtagtcatccttcaggtccaggtcgtgcgcgtgcaggtgcgatatggtgatcaccttctgcccacgctcgatgagcgcgtcggggatgcccgagttcagcaccgcgtcggagataccgtagttgcgcgtgatcatcaccagcacgcgctcgccgggcgcaagcgatgcgagcagctgctcgccggcctcctcggtcttgcgcgtgaattccttgacggcgaagctgccggccaacatcgcgcgcgccacctcgcgcggctcgcgccccagctcggcacccaggttcagcatctccttcgctatggcctgctgcccgaaatccaggtcgagcagcggcgaaagcagcttgataccgcgcctctccagcccgagctcgctggcaacgagccgcggtgccgtgtgcatgtagggacagccgtagttgtgcgcgacgctcgacttcacgtgcttgatcgtatggatcgacggcatgaagatgtagtcgacaccgcgctcagccagctgcagcatgtgcccgtgaatcagcttaaccgggaagcacgtctcgccctgcgcggtgcactgggagagtcccacgatctcctcgtcggacatgtcggagatgactacgttgaacccgagctgcgtgaagaacgcgttaaccaacgggaagagcttgaagatcatgaggcaccgcggcacgcctacagtctttttcgcggggtcgatcttgccggtgtagtcttcaagcatcagctcctctccctgatggaagaaggcgcggttgcgctcgatttcggcggcgtcgactcgcttcttcttggcacacccgcccgaaaggtcgaacccgcggaacgccgtctgatcgacgccggcctcccaggcgagcagtgccgcaccaacggcgcccgacaccgcgaaccacggtgacaccgtgacgcggtcgccgtagatctgcttgaacgcagccacgatgcccgcgttgtagttcacgccgccctgcagcacgatgtggtcccccacccgttttgtgcccacgacgcgatgcaggtagttgcgcacgatcgattggcagagcccagcagccacatcgcacttcgcggcgccggccgcaagggcggagttgatggacgtctccacgaacactgtgcagcgttcccccaggtcgacaggctgttcggacgaaagcgccagctcgccgtagtcgtcgatggctatcccgagacgcgcggcctgctcctccacgaacgacccggtgcctgccgcgcagatcttgttcatctggaagtcgaccacctggccgttcttgaggctgatatacttggagtcctgcccaccgatttcgaacacggtgtccacgcgtgggtcggccttcgtggcagcgcggccctgcgcggtgatctcgtcgcgcacgatgtcagcccccacatactctccgatcagcgaccggcccgagccggtggtcgccaccgcgtccacgcggaccttactgccgaggcgctcccccaaagatgccaggccctgctccacggccgccttcgcgtcgccgcgcgtgcgtaggtactgcgcgtccagaaggcggccccgggcatccaccagcacgaggttcgtgctggtggagccaacgtcgattcccagcgcgcatggggtgacgcccgtctcatccaccagccacggctcgggcaggaccgtgtaccccaaccccggatcgtagtccagggagggcagcgcctcaaggcgcggcagcagctcgacaggcgggtggttctcgagcacctgggtcagccgctcaagcgtgactggctcctcgcacgacgccgcatgcagcgccgcacccgccgcctggaagtacaagttcgctctctcgagcaggagctcgccttctcccagcccgaacacctcgcgcacggcgcgcaccacgccctcgttcaaaagcacgccgcccgcaagcgctaccggtgcctgcacaggcaggttgcgcacgatgagcgccttgtagctcctcaccatcgcgtagcacagacccagcaggatgtcctcggtcggcacgccctcctgctgccggtggatgatgtcggtcttggcgaacacggcgcagcgccccgaaagtcgcggaatgctcttggccgcacccaccatgcccgagtagtcctcgatcttcatccccaggcggtgcatctgatcttcgaagaacgcatccgtgcccgctgcgcagccgtcattcgcggagaaccgcggcgtgcgacccggcccgacgcctgtcacgtacagggcccgctgaccgcccacctcgatgatcgaatgggcttcgggcgcgagcagctcggcacccagtgtaacggccgggacgtcctcgagcgcagcctccggacaccccagggcctggcgcccttgtccggtgacaccccagcccgcgcattcgtcgggccgcagcgtctgagcggcatcattcagcacgtcgcgcaggcaggccacggggtcgccctcgtgggagcgcatatcactgaacagcagggggcacaccgatcgctcgatggagtcacacgagacggccgcaaccttgaccgaggacacacctatgtcgattccgaacgtgtacacggcgttcacctacagaccgcagcccgtgcaagtcggcccgctgccctcgggcagcacaccgccgtttgcgcggtacgcgtcgtattcggccagaaacgcatctttgtcgagatgctgcagctgcacgacgtcagtgaacgtgaccagctcggcgatggggttctctatcgagaacggaaatcccttgtcggcaaggaactgcccgaacatcggatcttcgatcaccacgtcgcgcatgcacttggtcatatcgatttcagccatggttgtcctttcgttgcgcgcctggtcgggcgcatttgttagccttaactaatttgttggcaccattgtccgacagcgaggtgcgctgtgctgttgctacagtcacacttcgggagaatttcccaagacattgctctcccgttgaagttgggtcgccgggatacaacgtcggggacggcataggcggcttgatccggagagcgcgagccaccacctacatgctgcgccctatcccatcaactcagccagcagcactctctgcacgcccagaagctctgcatcttcctccccatgggtggaaacgagaagcgtgccccatcgatgtagcgcagtatgaactcgatcgtcgtgcgccgtgtggcggtgtccagcccggtgaacggctcgtccatcaccaccatcttgctggggaacgccatcgcacgcacgagcgacacacgccggcgctggccaccggaaagctgtatgaccgacttgtctaggcagcgttcgggcaggatctcactcagcatgtcgcgcagacggcgacgactgacacgcccgggtatgaccagtgccaggttctccaccggcgtgagcacgttgcagagacggtcttcctggaacacgacggacacgtcccccgcgacaagcccgcgaacactgccgccgtcggcgcgctccagccccagcagcacgcgcaacagggtggtcttgccggagcccgaaggccccatgagacagtagacgcgccccttctcgaatgtgaagttcacgtcgtgcagaacgcgctgttgcccgaatgatttctcgatatggagcagctccacgctcatcgtgcgcctctctcatcgtcctcgacgcctaaaagcccgccgagcggacggcccgccagcttcagcagatgcatgaacagcttctcgaaagcctagggaaacgatgattaatgcccatgccggctgcgaaaggccacgtggctgatcctctttggcacattattgggaattaatcatcgcttccctagctcatgatcatgacgaccacggtccaggcgaacaggtcaggcgtgttcagatacgtgcgcgcctgcgccatctccttgccgatggacggcttcggcgtagccaaggcctcagccatgatgccgctcttccagctcatgcccagcgccagcttgctgctgctggataaaaatggcatgagcgttgggcggtacacgtacagaaacgtgcgccaccgcgacagtttgtacacgcgcgccatctccagcatctgcgggtccacgttctcaagacccgtgagcatgttcgtgtagatgagcggcaatacgatcagaaacgagaggtacacagtcagcgcctggttacccacccaaatcagcagcatgatgatgctgaccacgggaatggtgcgcagaagcgagacgatcggttccacgagatcgcgcacggtgcgcacccggtacgccacgagcgagagcaggatccccacgacaaatgacagcaaaaatcccgccgcgatgcgcagaagcgacgcgccgcacaccgcccagaagtcgggcttcactacctgctcggccaaagcttgcgccacacgcacgggtcctgccaataccaggcggttgttcatgaccatgtcgagcagctgccataccagcacccaaaacacgatgatggcgcccttcttcaggaagcgcctcctacccgcgcatgcctcgttgaccgcggctgccttctgcgcgcacctctcctcgtcgaggatgcgctgcgcctcccgatcgtccatgagcccctgggaccgggccacacgagtagcctgggagcgcggcacaccgagcgacgtcagcatcgccagaatcttgtcgatacccacgccgtttccggtcgccatcttcatcatggaggccatatactcgtcggccagaccgtccttgcggattatctgcgccatcatagcgagacgctcctcaggtatccccgtcgcctgtgagatctcggacaggggcacggtcggagcggttcgatcctgcgcaccgttcacatcggagcagcccgacgccgaccataccttgccgagcaggcgtttgatgctacttgaatccatctactgctgcaccgccgcttgcgcctgctctttgccgatcgcgtcatcgtcgattgtgccggtgaacggcagatagtagaagtcctcgccggggatggccccgcccaccaaatcagggttggcggcatacagctcgtcaatgaacccggaaagcgcagcgcgcatctccgtaccagtcagacacgtcagggcgatctgcggcatagcgtcggtcgccacgctgttgttcataaacgtccccagctcttcctgcagcgcggccgccttgtccatgttctcgagtgtccattcgaccgacatgcctgacatctgcaggtactccactacagcctgctcgtgctcctcgagaaaggcccggttcacgatcgtcgtcgtggtgatagcctggctgccggtatcggcgaacgccttgttccattcggcggtgatgcttacaggcacgtacagcggctccaccatcagcttcgaaagcgagacgaacggctgcggaagaatagccacacagttttcctcctgctgcatgaggttcagcacctcaaacggcgtcgctttgaactccagcgtgaagctgtcctccatcccggtcttcttcagcagcgcctcgacagtgtactcgggcgtaccgccctcgccgtagccgtacacgcggtgtccgacgagatcggaaaacgccgagatcgaagaatcggtggtcatgacatacagaacgccgaggttgttgacgctgatcacctggtagctgttctgcagctccttgttgttgtacaggatcggcccgatgttgctcggcaggatggcgatgtcgaagtcgccctggttcagcgacgcggacaggctgatgtagtccactccatccaccgtgaactcgaagttattctcggtcttgccattctgagcagccagcatgaactgggaaagccccatggaaggcggccccataatcagcccgacgcgcacgtcgcacgggtcggcgctacccatgaggtcgctctcctccggctgcgagctgaagtctgacgactgcacctgtacggtcggctctccctgcatcggcgagtagcccgccatcgtaagccccgccgacatcacggccacgccgccgagggcaaggaacgatcgcctactgaaagatctacgcattctaagccccccctcttgcggcgcttgtacgccaccaggatgcccgccaccacggctgccgcaacaagcacaaccgggatggcgaccatcgggttggcgccgccgtcaccgccctcggtcggagagcccgcgaccttgctgttgagcgatgtggagagagagccggagccgtcctttgccgcgcctatttcaccgtccagagcggcaagcgcgtcagccgctgcttcgtcggcagcctcttctccgcccgcagccgtgtcctcagagctctggcctttgatgaggttctggacggcctgggtcagaacgccgcccgtctgggtgggagcaccgttgaacaccacttcgaaggtgacggtccaggtgcggtttgccactccgccgatgatggtgctggcaagcgagcccagggtgacgttggccgtagccgtcttcgcgatcgtgcttgcatcgttgaggatacccaggtcgaccgtgatgctcgtcagtccaccctcgtcgtcgtacgacgcgtccacgatgttcagcccagagagacttcacgtgcatgatgcgcgactggatgacgatgggaactactacgtatgcgtgcccatcaggctcgacggtgagcgtggcgttcttcgacaccgacgtgctcggcgggaaggacgtattcgtgaagtggggtgaaagcggaaggcccgcttcgctcctgtcgacccagatgttggcggaaaccgtgtaggtgccggccgcgaggtgaccgtcgacagaggagatcttgtcaccgatgtcggagccggacaggccctctccgataccaccgctgaaaccgttgccggcgttgccattggagccgccggcgttcacgccgttgccagagttgttggtgccgccgttgtcggagctactggaaccgctgttgtcactggtgctattgttatcggagccgttgccgtcctgcacgaaggcaggaagctcggtgctgtcggattccttggaaagactgtcatagccgaccgtgagcacaagcgccgtgtcgccggtgggtgcaagctccttgtcaagcgggacggcgtacagcacgctgcccttgaaggtgaacgtcgccgtgccggcactctgcccggcgggcagctcggccgacatcatatggatgcgatcggtgcgctggttgtacgaaccgttccagtcgccaccgcctgcggtgggggccacgtgctcggtgtgcacgttggcgagctgatcgctcgcaccgaggtcctgcgtcgtgaagatggggttctcgatgggcagcacgagtgtccgagtcccatccgccgcgacgatgagctttgcgttcatgctgagcggcttcgaggggatctgcgccgtcaccttcgcggggtcgttctcgtcgattgtggggccgaaggggttatctgggctgttcgcatagaccgtgagccccggtacgagcggattgaactggcctggcatagcgaggttggccgtcaccgtgtacgtgcccggctcgagcttcttcgccgtcttgaccgtcagcgtgccacccacgtaagcgaattggtagttgtcggcattgccgctcctaggcgtgatctcgtaggtgccttcgtcgaaggagtccgcgacagaggcggtcggtgcctcgtagccggccgcggtgctcgcatcctcaccattgacgaacccgttcacatccacggcgagcgccggggtctggccaacggtgatcgtcctgctctgataggaagcggtcagtatcgccttgccgatgctccaggtcagcaccaccgggtcagcggttccatcggaccacacatagccttccttcagcatggcgatcgtcgtgtaggtgccggcgttggtcgcgctgttggagacgaggtcgtagcccccaccttcggcgacgccgatctgctccataccgttgtagaccagtccggtcgccgtcgtcggcttgccgaccggggtctctgccggctccaccaccacgaggtaggcgacttcggaattgtcggtgagtggttttacctccatcgtgagattatccaagcccgaagcgcctacagcggagcggtacatcagagtgacgaagttcgaaatctgtacgtcagaatcgttgagcgagacctgagcgtatccatcgacggcatgagcgctaagccttctgactgtttgcacagtgccgccatgcgttccggtgacggcatacacggccacgtcgtcgctagaaacgggaagcgacacgcctaacggattcttgcctgccgtaaacgtataatcgatacttccaaatccacagaggggagcgccgattttccatccatacgtttgcctgccacccacgattgccatggcgaaggcaccttgcacatgagacgacgcgaacgtgccatcgctcgatgcggtttctgcgactttctgtaggaaggcatcaggagcttccatcgaaaacacaccctcaacatcgggcatgaatgcatccagcaactcccctccagaaacgcccgggtagtccctgctgaatatctgttcttcgaacgatccatcagtggaatacgtcatcgacgcgccggtgggagaatccacgaccgtgcgcgtgtacaaataggcagaggcgccctcatggttccacgaaaacgaaattccccaggctgattgcggagaatgtgatggctccaaaatcgaatgttgggctagctgcgatcagctcaccattcgcaagctgatataccgtccaatcgttggcggaagcgggaaccgtcaccgatgccgaagttttgtcgtcgaactggatgctctctccgttggcgacgagattgattttgtattggtcgaacgttggagtcgaagcatagtgttgtgcgagaccgaagacggcggcatcgtgatcggcacccgactcgaccttttcaacctttagctgtgcgttttgaagccgagcgatggtcgatgcttccttatcggcagaaaccgtaacgctgataccagttgcagcatccgtgtacgttttctgaaaatcaccgctgacccgcttttttacatttgccaggtcgacgctcaggtcaagcgacgtgatagacggagagtcggcgttggggaagaacgttccgagggtgatcgcgtacactttccagttggcgaactggtagctgcccgtccagttgttcaggtttacggtcacctgcgaaatgcggctcgtgatgcctgccgaagcgagatctttgttgtactgctcgtcgtcggttttcgtctcgatcggctgtgtgacaacgtttttaacggttacgctgtcgctgctctcaacgtcttgaacggtaaagacggggttggctagatcgaccgtaagggtgtgggagccatccgcccccaacaccaaggttgcgttgtcagtcaccggcgcagacggaatgcccagttttccgccgattccctcggggttgtaagggctggttgtgtacccagggaaaccgagtggggtcaacatggacacgttcgcggagacggtgtaggttcccgcttccaactccgcgctgctcaccggaagagtgaaggagctgtccgattgggcttccggcagcatgagcttctgttcccgctgctcgctcaccaaggacgattccgggctgagcccggaatttttggctgtgtcctgggttacagaagaccccgatttttcactggatgcagccgcagcttcgggttgcacagcggtgttggaatccgtaccgttgggattcggctctgcgctgttggcgctatcgttgctaccggtggtcgccagctctgccgcttccgccgaagcctctgcacccgagctattcgcaggggtattggcggcagcctcgtcagtgctcttctcttgctggtcggaaaagttggcagcgtttgaagcgttcgcctgatcgacagccgcacccgcggtggaatccatctgctgaaccgcagcgggttcgagaagaccggttgcaccgttttggctagcggcaaaagcggagcttggcaccatggagaacgccaacacgccggaaagcacaaagcccagcaccttcgagcgcaaggccctaagacccccgtgaatcctaggccattcaatcgtattttttctcatcacttcccctactcgaaagttaagatacacaggttgcccactcgcaccgaacaggccgctcgacttcccttgcaacaattcgctctattgagcattggataaatcgaccgccagatgcaggtcccacgccttgtcgcccctatatagcgggaatgtcgcatattccgcgcaggtgctgcaatcggccaccgaagagccccggcgaagttcgtcacatcgaatgtaattgaggaaatcctcgtactatacggagtcgaggagagcggaaagctgggcgcagtccaagtcgtatcagacgtggaaagcaccaacactgttccgtccgttgaagaggaagcaatcgaacgcacgccaaacgtgttattgaccaccggcaccgtcagggtcttcttgccgtcagcgtcgaccacaagcgtagcgttatccgacactggtgatgtgagtttgtgagttgggggattcccggagtttgtaacgtatgcgtttttaccaattggagtatctgctgccgccacatacaaattcgccatgaccgtataggtgccggatgaaaaagctgctgcagcaaatgcctcctcaggcccgaaatccagcgcatcatccagacctgacgaacccagccctgttgtcaccaccgccgcagtaccaaccgcccctgcagcgaccttcagaaattcgcgccaggggaccgatattgccttggactcgttcatgagttcacctttcccgctaagctcgcctacagacgtccgagcttccaatagttttccatagctaactttacggaaacagacacctagagttgttgctgcggcagcgtatgagaaaaattttctactttttcgggatacggcgggtacgaagagggcgaccgaaacgactagttttctaagaacgagcgatcgacgatattgatcgttccgccatcgagcgacacgatgccctcgtcccgcagccgcccgagctcgcgggaaagcgcactacggtcggcacccagatagcgcgccagcgacgtgcggctttgctcggccatggtatctttggggagcatgccgctctcacgctgaaccaagtacagcttgattcgatcacgcaaacgcttctgcgaaagcagctgcagcttgcgtacgagcagggtattcttccgcgcaagcatacgtacattgttcgccatgatcacacccacgtagggtgtttcgcgcatgacgcgcccggtcatcatgcggttcatatccagccacagcacgcgcacgtcggacgcggcctggacctgcacgatgctcgggtctccagcgcacgccacagcctcagcgaacattccaccccgccccaccatggtaattgtagacgcattaccgtcatcatcgtagaaatcgatgcggacgtacccgtccaccacgacgcccattgcctccggacgcgatccgagacgcagtaaaagctccccctcgagatagctcttttcacgaaccttcagcttgaccagggtttcctcgtacaattcgcgaggaacgccatccagcaatccgctagatgcaagagattgcgctgttctttcgtccattctgtcccacctatcctgtgtgccgctaaacggaaagaaaagcagactcgcgagcgagctgttgttgccgcagtaacacggtcaccgatagcttcataattgttagcttatactaacactgttttcacaaacggcgggttgaggagtcgaatgatccgggttgggcggttctatatcgctggtttggaagttttgcaattgcccacgtgctgcagaatctgcgaggctgcgggcttctacatccccggcttgaggggcttccgcttgccggtcatctcagtgacgtcgaggcaccagacgacggtgcgtggaatagccgccgggttgtagggcgcgtcaccttcgggatggtactgagccatgatcgcgtcgagcgcgcggaccttttctttctcgtcctcgatcatgcgcactgtgcccttgcccatgaccgactcatatgcgaacgtgcagtatccgcgctcgcgggagtactgcagctgatgcccgcggtccatctcgaacgcggcccgcgcatcgcgtgcgaccaggtcaagcttgtggccctcaagcgcgctgtgaaaatacagcgtgacgtggtcgccgtccacgccgaccgcgaagttcacaggcacaatgtacggcgtgccgtccgtgtcgttcagcgcgacgcggcacacgtcgcaccccttcaagacctgcacgatctcgttgaagtcagtaatctcgcggttgctcttacgcatgcgtcctccttaggtgtcgtcgcgcacattctacggcaac

SEQ ID NO: 378 - DNA, 6990 bp, Unknown
  Metagenome-assembled genome
cccccctgatccggtgagcggaccatggggagtgcatgaagtcgcgcatcagatctgcaacaaggtccccatagctccatctggaaccttaagaacccacaaaccacaccgccgtcggcacgactggaggcgccaacatcgaagagaccgaccgcactctttgacgccctagctgatccaccaacaccgtcgtagtccatgttgccccccgccgtccataccgcctggggagagtccttaggggcttacccatgagcagacagacatccaacgcctctacaccgcgctcaaacaactcggtatcggctatgtcttcaatatcttctggagcgccgatctcaccataatggaagaggactctgagctcctcgagaagctcaggctcgaagcttcaggcaaaccgcagctgtaagctgaccggttcccgctcttcacgagctgctaccccggttggatccgctacgcgaaggcacaccaccctgagatcgtcgacaggatctcaaccgcaaagtccccccgccagatgtttgggtccgtcgctaagagctggtttgcaaagacccggggaaccgacccacacagcatctattcagtggagatcataccctgtgtcgcaaagaaggccgaagtcgaccacaagccaatgaatgatgcctgcggggatcaggacatcgacctcgcaatcatcacccgtgagttaggccgcatgaccgccgctgctcttatcgttgtggatgatctggaagaaaccctgctcaatcaacccttgggcaccttcagcggcaccggtgtgattttcggcaccaccggcggcgtgatggaagcggcattcagaactgttcaccatatcgcaaccagtgaggacgtcgacgcggacgccttcaaagaagtccgcggcatggacggctagaaagagtgcaccttcaccgtagacgataagaaactgtcagtcgctgtcgtcagcgaccttaagaacgctgagcgcctcatcactacccttaacaagagcgagatccactaccacttcgtggggtcatggcatacccgggaggcggcgccggtggcggcggacagccgatccacgacggaaaagagctcgcagacgagcgcggagatgtgctgtgagggccggaccattccatgaagttaagagagtcctatgagaatcccatcatccaggagatctataagagctatctgggagcaccgttaagtgagtgcgcgagaaactcctgcacaccggctagcacgcctgggagatgcccaatgagcaatagctcagtttgccttcccttatgggcagggcagccccgggcgcatacacacagggctgcctttccccatcgctctataggtcctctcagttctgcggtggatctgctacggggtccttcataatgaagccgccaccgaggcaggtaagcccctcgtagagtaccgcagattgtcccgcggcaacagtacggaccggttccttgaacgtgatctgcactcgtgagggtgactctcccagcgccagctcaacctcacgcagtgcgccggtgtggcgcgcccgcacgacgtagttgcccggctttggttctgccccactgatccagtggcaatcttctagttgcatctgctgggtccataagcccgggcactgtttgtcggaagtgacgtagacgacgttgttctcgatgtcggtcttcaccacatagtgggcaggtcctccaccgacgttcagtcctttgcgctggcccaccgtgaagaggaaggctccgtcgtgctttccgagtaccttaccggtctcccattcgacaatgtccccggacttcttctgtaagctgtccagcaggaaagtacggatgccgaccggcccgataaagcagataccatcggagtccggcttgttctcgataccgagaccacgcttcgcgcactcttcccgcaccgtcttcttatccgaataatccccgattgggaacagtacacggttgaagacgtgtccgtcaacgcgccacaggaaataggtctgatccttgtgctcatccgccgagcgaagcagctgggctggtcgcttcgggtccttcgcatggatcgtgcgggcatagtgaccagtggcgatcagatctgcccccgtcttgaaggcacggtctgcaaaggtaccgaacttcacggtctggttgcacatcacatccgggttcggcgtatggcccttcgcgtaggcatcgacgagatagtccgccacagtctccttatattctttttcacaatcccaggttaagaggtcgataccgagcttaaccgcgacacgctccgcatccgccaaatcctgtgcccaaggacatttgaaaccggggagatcgcgtgaccaattccgcatatagacgcccacgacgtcatacccctgctcctgtaacagtgctgcagagagcgctgaatcaacgcccccactcattcctaaatagactgtctgacccacgttacttgtgctcccctgttgctggatcgaggcctaaccgctgcgcttcttgttcgactgcctcggtaatcgcctgtgctgcagcatgaatgtcttcctcagtcgtcgatgctcccaatgtgatacgcagactgcccgtcgcaacctcttcaggcgcaccgatcgctttcaacacatggctcacccgcatgcggcttgctgcacaggcgctgccagttccgacgaacaccccccactcttccaggagaatcacaaggcgccgtgcctcgattcccgggaaggagatatggagcagtccgggcagccgcatcttatccttcttaggccctgagacaaccgcccaggggaaccgctgtgtcagtaaccgctgcaactcattgcgcagtccccgcaggcgtttcgcctccttgccgcgccgttcactggcagtctcaaaagctttggcaaagccgatgacacccgcgacattctcagtgccagagcggacacccgactcctgtcctccgccctcgatcagcggtttcagggggattccctcacgcgtccacagcatgccgacctgcttaggtccgtagatcttcgcagctgatacggtcatcatatccactttgagcgaggagatattgagtgccagggcacttgccgcctgtgaggcatccgtatgcagatagagcggccgtgtctcccctgcggcgagtctccgttcacgctctttatccaccaactccgcaacctcacgcaccggctgtatcgtgccaatctcaccgttggcaagcgagacactgaccagtcctacgtccgaggtcagtaacttttcaaaggctgccatatcgagacgaccatctgcatggaccggaataatggagcaaccatgcgcccgcgcacaggcaaggatactttcatgttcgatagcgggaaccaggatcttcccttcggtagcgtgcagcgcgatgttgtttgcctccgtcgcaccggcacagagggtgatcgtatccggcttggcgccgatcagacgtgcaagcgttgcacgcgctccctctaagtcagcgcgcacttcacgggcgacgctatacggcgctgaagggttgtaaaaccgctcggtaaaatacggttccattgcctgtaccgcttccggcagcatgggagtcgctgctgcataatctaaatagatggtgtgtggtgtgtgttcgacacgcattgcatgtgagcctcaattctttctccgctcaggcttactcaaacctctatagttaacgtgttaacgtggctattctaccaaacatggatcggattgcgtatgcctagctcatgcctccagctggtaccttcatatatatgtgatgtcctcgttatcggttcaggcctcgcaggagcatgcgcagccctcagcgcccgccaacagggcgctgaggtcatgctgctctccgaaggctccaccttctccggatcgagcttctcaggtgacacctggggactagggaccatcggcccacaagatgcagcggatgcacaggacctcgaagacaccatcttgaaggtcggtagcggcgtcgctgatccaaccctcgtgcatacccttgtctcccagatcagaccgacatgggaatggctagagcaggcaggtttccacctctgtcatccccagagtcctgagcaacaggaatacatcccctgcttcgatcacactgtaagggagtggagagggattgaacgggacagtttcaaacagggctttgccacacaatttgacaacctccatctcacctgcttgccccaccgtctccttatcgacctcatctgcgaagaccatcgtattgaaggtgctatagtcttcgacactcaccgtaagcgccttgaactcattgccgcaccggcaatcgtcttagctaccggtggggtagccggcttatatgggcatcatctcggttccgacacgcagcgtggcatcgctcatgtgcttgcccacaaggcaggagcacatttagtcaatctggaatccatccagttgatggaaggctttgtcgcaccgaagaaaaatcttgtcttcagcgagaagaccttccgctatctcagcctcgatacagaatctggcaagcagctatcccaagaacttctcgagcagcgctccacgcacggaccaatcagtgcccgtaccggagatagtgaggtggataaggtcatcgcaaaagagggaaagcacggctgccttggacactatgcaaatctacctgcccaacttcccgaactcgatacacactacttccaatggcttaaagaaacaaccggcattactacttcggatcgcttcagactcggcatctatgcccatgctgaaaacggtggtatcctgatcgattcctatgcatcaactggtgtagatggtctctatgctgccggagaatgtaccggtggcatgcacggtgtagaccggctaggcggcctctccagcgcaaactgtatggtcttcggccgtattgcaggaatgaatgcagctacctgggcacagaagcaccgtaccgataacaggctttcctatgagtccccgatgtactgctaccccaaagcgtcaaccgccctcccgctcattcaagacaatcttgatcgatatgccctactcaaccggaacagagaaggattgcagatctgtatgagtagctttacagacctctgggaccaacttaacgctaaacaagtcacaacggataacatagaggaggtagtcgagacacgcatcgcctatcttgaactcacctgtgcaatattcctggtcagtacaatggacaaacgcacgagtggctttggagcacatatcatacctgacagatagctttcgttactctgtccgaagctggagctgtaaatcagcaccctatagtctgctctattcattcttttaccgaaataggtaattatgacttgcagaaggactatacataagctattctaaacaagcatttgcgggcttggcgcagttggtagcgcgcaaccttgccaaggttgaggtcgcgggttcgaaccccgtagcccgctccattgatttttgagatcgtcttttcaaagaggggtcgatttttggctcttcaaaacttctggtgggtagcatagcctccccgcattgagcgcgtcttgtccgaaaggtaggattctcacagagggtggcaacgcgatgggcaggtttggatgggcgcacacgcgagcatgctggcacagctctttgaaaggtcccatggggcttagcgacgagtggagggtctcaaacgtctggtttaaggagcacgacggcttccccggcgagctccacgtctgcgggagggccatcgagtgcccggcgtgccagcaccactgcggtgtgtacgacacccgcgagagggtcttatggcacctcgacatctggcagcacgatacgatcgtgcactgcgccgtccccagggccgactgccccaaagacggcgtgcatgccgtgaggatgccctgggaggtgtacccgaactcccacttcacggcgctctttaaggcccaggtgctgctctagggaaacgatgattaattcggctcgatgaggccagtggagccgcacgctgtatgacatcggttcaaaatgtctcgaaccacgcagtgcccatacccacatagatgcctatctgtctttctggatatggtatagctacatccacgcattccagcatatccaaaaggaagatatggacagatagatgagctttggggaccttaaatcctaaggtttgaggaaaaagacccggcgggaggcattcctggagcggatggatgtaatcgttgtgtgggatagctggattgcgctggtagataccagctaccactgacaggctcttgtcaggcatgtgcgcgctgcaaagacgatgcttaaggatgtatctgctacaggttatgtttgctctcttaagacgggggaacttaaagatgctatcctggattgtcactcctagtggcgcttctgtgcacgcagacctcatgtctgagcaggtgccagatgcaacgacactcgcgaagatgcgccatagcctcgagcggcagggactcggtaaggcttgtgctttacgcctgaatttagagcttgaaaaggcagggatcacggggcggggtagctccatggtggatgcgaccttcacctgggccctaaagcttcacgaagaacaaggaccatgcgcgcgacccttaaggcgcaccagtccaagaaagggagagcctggcgtatcggatacaaggcgcatatcggcgtggatgccgcaggtggccttgtgcatggtgtggagacgatcgcctagaatgtatctgacatatcctgtggcacatgcactcgtaagggaagatgacaggttctgctatgcagactttaggctatataggtatagcgaagcgtccttaaggacgcataaagacccacacctctcatctgtgcgctaaagtgttgctaagaaagccttcgactagagaaggccttgcctgtgcgctcttctccgataagggcatcgagtccaggaaggcat

SEQ ID NO: 379 - DNA, 7785 bp, Unknown
  Metagenome-assembled genome
cggaaacgatgattaattcgcctcagaggtcgctgggactgcacgctgtatgacatcggctcaaaatgtctcgaaccacgcagttgcccatacccacatagatgccatctgctcgatatttataatacagcaacgtattccagatatccaaaggcagatcctatggggatagatgaagcttttaggacctaaatctaaggtcttaaggagaagggacccggcagaggcattcctggagcggatggatgcaatcgttgttgggataggctggattgcactggtgattaccagctaccacttgaaaggccgttgtcaggcatgtgcgcactgcaaagacgaaagcttttaggatgtagcctgctttaggtatgtttgctctcttaagacgagggacttaaagatgatatccggattgtcggtcctatcagcgctctgtgcacgtaggacctcatgcaagccaggtgaagatgtaacgacacttgcgaaattccgccatagccttaaagcgagagggaatcggtaaagcttgtgcttcacgacctgaacgtagagcttgaaaaggcagggatcgcggcgcggggtggctcattgtggatgcgaccttcacctgggctcttaaaagctccacgaagaacaaagacttgcacgcgaccctaaggcgcaccagtccaagaagggagagctgggcgtatctgattacaggcgcatatcgggtggatgcgcaggtggccttgtgcatggttggagcgattgctagaatgtatcgacatacctgtggcactatgcaccgtagggaagtatgacaggttctgactgcgcagacttttaggctatataggttagcgaagcgcccttaagggacacataaagacccacacctctcatctatggagaaagacgtgcctaaggagccttcgacataaaggcttgcctggtacgcgctgcattgtagcgagattgggtcgagccggtcaaggcctccgtactgctcttataagcgtcgagtcccttatttatcgtgatatgagcgtcattcgctgccctccttaaggaagcgctacaggcggattaagaaagaagatcgatactgaccaagtctctctacgaccctgcgaacctcgccatgttgatcttatgccggcagggctgacaccctcccggcccagcgtcgcctgattcctgtagtctggaggccttattgtcgggcatggcggcaggacagattgtaaggatagcggctcctgcacgtgcacccggattgagcataccttcatctgctttaccacattccaggcctgcgaaagtcgtgtggtcagcgtccccttaaaacccgttatggggcattaatcatcgtttccctagaataaggggagtctgggcctgctggcagcgacccatgctcctataaggtcatggcgggcctcgggatgcccgcggcaggggcagcggtcaaagtcattcaaggtcagtctctgcgacgacggttggtgtatgggtccagcgccctgtgttgcagctatacgatggagccatacgcctccacggtcgactttgcgcgcggtgtcggcgcagttgcaaccgcgatatcattatcagtgtgacgctcctatgctgatatagatgaaccaacgattgggatacaatcgggcatacgtcaatcaagaactcttaggctctttgttccagatgcttttcccagaaattgactggctcataatcgctgagtggagctaggaatcctttctcctgtaagcggtcctgaatcaggtcgagaatttcctcgctgtcggcctcaatcgtgtggtagtgatatccggatgttatgttaagaagctcactcgactttcctgatgaaatctctttcatatacacggccacatcatagcgcgaacaaattttcagatcagtgcggatcaggccgtagacacgatggtatacaaatacatcctggaatctaccacctaggtcgactaccagattcaattcttcctctgtttgatcctctgtgtgacgcaccttgaacactctctggtgagtggtcttttgtttctgcaggacgtagcccctgttcgttgatacaatatccaaaccgtttgcacgcaagagcgcgatgtcttgtacgatgacctgacggctgacatgaaaatgtgctgccagtctttttccggaaagcggtcccgtgctggtagacagaagtttttcaatctcttctctacgcagtttggttttcaagatatactacccccacttcctgttgtaccgagaaaccatacgttcatcgtctggctcaatacgtccccaagctttcccgtatgtccatcctcaccgctatcggcgttccctatttttttggcgaaggtgtttcagagacaggtcgaggatcggcgcggaatgagtaagcgccccgcatgatacataatcgatgtcgaggtcactatatctatccagattgtcgagtgtgacattgcccgacgcttcaatctccgcgtgcccggcaattactcttaccgcttctgccatctgtgcgtggctcatattgtcaagcatgatgatatcggccccggcatcgagcgcctcctttaccatctcgaggttttccgtctccacctcgatcttgtggacaaagggtgcgtagtttcttgccgctgccacggcctgccggattcctcctgccgcgtcgatatggttgtccttcagcatgattccatccgacaggttgtagcggtggctgtatcctccgcccaccctaaccgcatatttctcgaagatccggttgttcggcgtggtctttcgcgtgtccagcagtctgatcccggtgcccttcagcttctccaccatacgatgcgtatatgttgcgatgccgctcatgtgctgcaggtaattgagcgccgtgcgttctcccgacaacagcacacggatatctccctgtacggtggccacgtgtatgccattcgctatgtgatcgccgtcctgtttattccaggcgacatcgattgtagggtcgagcagttcgaatgtcctctggaagacctgcactccgcagaggattccgtcttcctttgcaatcaaattgaccgttcctggttctggttgtggcatgacgctgttcgtcgacatatcgtcgcttgtaatatcttctctcagcgccgatagaatcagcgggtctacgttcagtttcaaagtagctggatcaaacatgtcttatctcctctgatttggtctctgattcttcatccgtcagaccctcgacttgcatattcttgtcggccctttcaatttcctgtctcacgaggtccttggagcattccttcagggccgcctcattcttatacaaagaaaagtcgacctcctcaaagagctgcgggttgtgtttcacgttaccgtaggagatcatgaggtcgtttgcggctctgccggcaaacaccatggactcaagcagcgaattgctggcaagacggttctctccgtgaacgccgttgcaggctgtttctcctacggcatacagacggtccatcgaggtcttgctccagtgattgacccaaatgccgcccatgtaatagtgctgggcggggacgacaggaattggctccttatcggggtcgtatcccatctcgaggcagtgctctatgatgttcggaaagtgtgcgtggcgctcctctaaggggattgtgcgcagatcctcccagacgaacttggtgccgtctttcttcatctgctttttaattgcggccgtcaagaggtcacgggggagcagctcgtcggtaaaccggtgcatatgtttgtcatagagctttgccccttctcctctgactgactcagagatcagaaacgaacggtccctgggattatccgtatagagtgttgtcggatggatctgcacgtagttgacatccttcaggcgtaaaccgtggcggattgccactgcgagcccgtctcccgtaaggtggcggtaattggtcgaatgctcatacagccctccaatgccgccggttgccagaattgtgaagtctgcctggactgtgtcgagctctccgttttctttcttgataatcgcaccgtagcaggcgttgtcttgttccacgaggtccagcatcgtcgtgtgttcgaggagcgtaacgttggggcgtgcggtgaccgctttaaggaggtgactggtaatctcttttcctgtttcatcctcatggaagagaatgcgcttgtgcgagtgcgctccctctctggtgaagtcgaggtgaccgtgctcgtcgcggtgaaagtccacgccgcagtcaatgaggtcatggatgaccttctgtgaggagcggatcataatatcaacggaccttcggtcattctcataatgcccggcacgcatcgtgtcctcaaagtagctgttgtaatccgattcatctttaagcacacagataccgccctgggcgagaaaactgtcacacgactccgcatccgatttcgttatgatcaggatcttccggtctttcggaagcttcaacgccgtatacaggcctgaacagccagatccgacgattaaaatatctgtattcagcatggcatgttaaatccttccctgaataacaacaatcaaacacttacactctgtgaaaaccgtgcggttactagtaggggggcggagtacccgttaacccgctagaattatgtctggcagttttctgtagtatcgtggcgtcactgtaacatgttaaaaagtatatgacaagacacctatcaatataaatatttacaataaacttgacagctaaatttccgagttctataaataacactgtgagagaggaacagatgatgcattgtcatctatccatggggtgagaatccgtctgaggcttttaggattttgctcctcaatgcgctccttgcatagggaaggtatcactgcgtattggagatagttcagagtacttactcgggggattacatgaatacgagagaactgcaggatgcaatcatagaacttaagaaacaaaacgatgtctgcatcctggcgcatgcctaccagagccaggacatctgggacgttgccgactatattggggattcctatggactgagcgtgcaggcatcaaaggctcctcaaaagaccattctcatgtgcggtgtacgcttcatggcagaaaccgtaaaaatgctttcacctcagaaaaaagttctgctcgcaaatcccatggctggctgcccgatggccgaccagatggacagaaccgacgtccttaaactcagaaaacagtatccgaatgccacaattgttgcctacatcaacaccacgtctgacctgaaacgtgccgtcgactatgttgttacgtcttcctctgctgtcaagatactgaagcaaatccccaataaacagattgtcttcattccggactgcaacttgggatcatggtgcgaagaacaagtaccggacaaggattttgttctcgtagatggtgggtgtccggtgcatatgctcataaccgaagacgatgtgaaaagcatgaaggctgcccatcctcatgcagagctcctggttcatccggaggtcactgcggaagtccgcaagtatgcaggctacataggaagcacaaccggcatcatgaagtatgcgcaggagagcaaaaacaaggagttcattataggtactgagaatagtattgtgcagcatttgcagttcatgtgcccagacaaggctttctatccgctgtcaaaggaaacggtctgtcgcaacatgacgctgacaactctgatggatgtctactatgcggtagcgggcaaaggcggtgaagtcatagacctggatgatcaggtccgcatcgaggcacttcgtccaattgaaaagatggtagaactgggaggctaaacctgaactgaaccccaaggtgtaggcagaaataagactcttcaggccatcccgtgggtgagaatatcatttttctccagaaactaaagctacatcagctgttagaggttttcgttattaggaagtgaaaacacgaatatcagagcatgcgagaataccatatccatcagtttcggtatattcggatccaatgccctgcgaacatcagacctgatctgtgttggttgcctcaccatgccattgctcagcccccagtcggattcggtagttcagggtatgatcctatgttgcttttgatcttcttcataaaggtcgtagagtggctatcctgtgtcagctctccatctgagtaggttttgcagactcgcttcaacctgttgacatcggttgatgcaaaagcagagcaaagattccttcagacactatgctttgctacagctttctcaaatcaaaaaaatcatttgccgaaatatatcccagacggattttttgttctgcgtccggggatttggccgattgcgtcaataattttgtgtacactatatttcctgatccgtgttatatgcggccaggcaggcataaggctttgacctggtagcctgaggcagtttagggcattttgcatcttgctgtattttcgaacatcttgaggatctctgcggaagactgttggaacccgcactgcgccctgtctgcataagagcggttttcaggtcactgctagtagcgcagaacaaagcgctcccagggcagtcttcattgggaactgctccttggcctggatttatgtttcagccctttagttactccgttcaataatgtttgttagtgtagattgcccttccagatcgcttcggaaaatgattaaaacgtaaaacaggctcccgttatactgtcaaaaatacggttcaaatccattaaaagctgtgggcgaatgacccagcggcgtagcagcccactccgagaccagagagcggccatcctctaggaatctggatagcaacatgtagaactccgaacaaggatggagcgcgctgaacaattgtgcatcctgcggcagaccagctgccgccgtttcccatgcagatgagattgggggatggtgctaccggcttcctccgcattccctcccatctggacggattcatgcagaaacaggcgtggcccgagggagcgtcagcccgaggagttcggcacctcggccagacgatgcagcaggccgggggcagatcctcacggtccccaggcaggctggcgccagggaagcccctcatgcccctgctgcaaaggcaatgatgggcaacgggcaggtcccattgcgcttcggcacatccctgggatggaagagggcaagggttcgaggtcgtgcggccaagagggttctgttatttgatagcctagagttggggttctgagcgctggaaggttaaaaaaacagcttcatcacgaagattttcgggttgcgccgagcatgggaacgctgaccatcccccccaggaatgctccagaaatgtcgctgcttcggttttatcgacagaaaggggcaagaaaggcagaaaggaaaagggaggacaaatgatcggccgtggacaaatcaggatcatctactcgaggagaattgtttacggttttacaggaaggagagccaatcgcccagggatttgcgtgaggaaggtaagaaggtcggggttgtgtcggagcccaccgcgagggaaagaaggaagtcagtaaccgaagagggaggacctctcgccgggagatgccaggaagaggggagccgaggcactccttcccagagggcattcgagcgcttcatcgaccgagatgctcgaggaggaccagcgccaggttgtggcgcagcagcgccaacaccgccgtgcggatcctcgacaggatcggaaaaaacaacgggagccaccacggatttttaaggg

SEQ ID NO: 380 - DNA, 15023 bp, Unknown
  Metagenome-assembled genome
aaagtcttaaggatcaacgaccaagaccgtaaacgatggatcatcagcactcaaagaccaaaagggtggcccaggaaaagaccgacgagcaaagccgctcgaccgcattgtgaacaggcgcatacacgagctcgaaagcgaaaataagtcctaaaaagtggcagccttattcgtcgccaggagcctctgttgaaggacaggttttagctcatgctggccaagagggcaacctacagcgtctcgatgatggagcgcgtactggaggtgagcagggctcacttctacagatggctcaaggccggaggcggtgaggacctatggggtcctatcaaggaagccatcatctagatatgggaggaaagcgacaggcgctttagcttttgctaggtctgatccaagctcacaggagatccgaagttacgcaaaatttacagtgacgacccgctaccgcgtgcgaaggtgcatggctgaactgggggatctgcggcatctgatccaatgcctccaagagaacgacgctgcccgcacctgatacccccgagcgccccgccctcacccggcgcggcttttcgtgtcttgtgccgacagccaagctcgtgggcgatataacctatctcaagaccacggcaggctttatatatctcgccgtcgcacacgatctgtgcacacacatggtggtgggctgaagcatacaggacaacatgagggcagggcttgtcgtctttgccctgaagatggcatattcgcgcggatacgtggctggaggggcaatatttcggctcttcgctacttatggtgggtagcatatctacatccccttgagcacgtggcctttgaacggtaggattttccccgacaggaagctgcgttcctaaggtgcgatatggatgttcaggcaggtatgctggcaaggctcttcgagaagtcctagggaaatgatgtttaatgccccataacgtgttaaaggggaccgaccacacggcttttctgggccggcatgcgggaaaggcaaggaaggatgctcatccagcacgtgcaggagccgctatccttacatctgtcctgtcccatgcaccgcaataaggctccaagacggatcaagcgactctgggagccgagaggtgcagcctgccggcaaagatgcacatggataaggtttgcaagggcgagagagactcgagcatacaggaggtcttctctatcccctagtagcgcttccttaaggggtcgaagcgccgcttcacgataaggaagggatgctctacctttgagcggccggatgccttcctggactcgatacccttctcggagaagagcgcacaggcaaggccctctctagtcgaaggctttcttgcaacgctttagcgcatagatgagaggtgtgggtctttatgcgtccttaagggcgcttcgctatacctatatagcctaaagtctgcatagcagaacctgtcatcttcccttacgagtgcatgtgctacaggatatgtcggatacattctaggcgatcgtctccacaccatgcacaaggcacctgcggcatccacgccgatatgcgccttgtatccgatacgccaggctctccctttcttggactggtgcgctttaagggttacgcgcatggtcgtggttcttcgttaagctttagggcccaggtgaaggtcgcatccactatggagccaccccgcgccgtgatccctgccttcttaagttctaagttcaggcgcaaagcacaagccttgccgaactcctctcgctttaaggctatggcgcatcttcgcaagtgtcgtagcatctggcacctgcacttgcatgaggtctgcgtgcatagaagcgccgctaggagtggcaatccaggatagcatccttaggttctctcgtcttaagagagcaaacattacctaaagcaggatacatcctaaagcatcgtcttttgcagcgcgcacatgcctgacaagagcctgtcagtggtagctggtatctaccagaacaatccagctatcccacacaacgattgtatccattcgctccaggtgtgcctctcgtctggtctttctccttagaccttaggatttaaggtcctaaaagctcatctatctgtccatatctgtcttttggatatgctggaatgtgtggatgtagctataccatatccagaagacagataggcatctatgtgggtatgggcactgcgtggttcgagacattttgagccgatgtcatacagcgtgtggccccagctacctcatcgaggtgaattgatcatcgtttccctagggggcttaaggacgaatgggaggtcacgggcgtctggtttaagaagcgcgagggagcgcaggacgagctccatgtgagggtggcccacaggaggggccaggcgctcgagtgccccgtatcccacaggaagtgcggcacctgtgacacgcgcgagaggaccttgtggcatctcgacatctggcagtacgagaccatcgtgcactgcgcgctgcctagggccgactgccccaaggacggcgtgcatgccgcaaggatgccctgaaaggtgcggccgaagacgcacttcacagcgctcttcgaggcgcaggtgataagtgatggcgctctttggcatgagcgtctccgcgatagcgcatctggtgcacgagacagcccacgcgcatatggtgcctgctgggcaaggccgtcgacgaggcgagggatgccgccgactactcggatgtcgtgcgcgtagggatagacgacaccgcaaggaggcgcggccaaagctacatcagcatcatggccaacctcgaccaccagcgtgccatagccgtcacgcaaggcagggacaagggcgccttaggcaggctctgagacgagcttaaggagcacggaggggacaggtcaaaggtccaggaggtcacgcgcgacatggcttaaggcatactcgctggggggcggcgccaagatgccccaggccacacagagcgtgggacagcttccatgtggtgcagctcctgaacagagcgatcgaccatgtgaggtgcacagagcggcgcgagtccgcctcgaagcgccggcagcttgcccagacgaagtacgtctggctcaggaggagggagaccctcacaaagctccagcttgccaggagggaggagctcgaccctgcgaagacccatctcagggaggcacgcgcctgccagatgggagaggcgctgcaggacgtctattcatgcgcagacagggaatcggcggcagcagccctggagcgcctctgctcgtggatgatgcactctgccgtggccgagatgaagagcgtggcgagaaccctcaggaaggagcgggaggggatcttgaactggtggaagaggggatctaccaactcgttcctcgaaggcctcaattccgttgtccagtccgcccgcagcatcgccaggggcttcaggagcatcgcctacttcaggacgatgatcttcctcaggctaggccgtttggacttcacagcccagaagaagctcgcatacgctacccactagaaacagcgaagagccccgaatctcccctcctacaatgcagccaagggcggcgtcaaccttatgacccagtctgccgcgctcgcgcttgccaagtacaatatccgcgtcaacaccgtgaatcccggctacatcgagaccggcatggtgaacgaggacgtaatgggcaaggaggccatcgaccacctcgtctcgctccatccgctgggacgcctcggacgtccggaagagattgcacatggtatcgtcttcctcgtcgagaacgaattcacgaccggcatccacctctacatcgatggcggctatacagcacagtagaaagcgcgacatccatcctttcgggcgggcagcagaaatgctgtccacccttttctgtaagctgcctgtcatcctccgacactctcgccgaaaagtgtctgactctgagcaatgaaccgctgcttctcaggaagaatccctctatacgcaaccaaagaagggatggcatatgcttctgcccaagacctacctcgtccgcatgaaggaacaggaacgctaccgctggtggaagccgatcgtctgcttccttctggctggcctcctcttcgtggtgttcatggcaatagcgatgttcgcgctcgggacctcgggcgtgctctcccccttcgaggtgctcatccaggatgcggacagcatcaccacagacgagctcatggaagaggccatgaacctcatgacaggaagcggtctgggcatcgcccctctcttgggctccatcatcctgcttctgcctgctctctggattgcaatgaaggcgacacgcctcggcggcctcaggaccctgagctcagtggaggggcatctccgctggaagaggatcggacggctgatcctgcccgtgctcctcgtctttgcgctaggcaatgctgcagagcttgcgatagcctcggtcctctcaagcgagattcccgccttctcgcttcccagcctctcctacctcctcacgatcttgatcctcgtgccggtgcagtcggcaacggaggaatatgccttccgcggctttctcatgcagaccttcggcagctggatccccatagccgtgataccgcttgtgctccagaccgtcatattcatggggtcgcacacctacaacatctggggacttctctccatcctggtcttcggcctcatcgcaggagtactggccctcaagacaggaggcctcgaagcctccatcgtcttccatgccacgaacaacatctgtgccttcctcatctcggcagcggtcggtgccaatgcgatggtagctgaggcaaccatcctcgatatggcgatttcgatcgcccttgacctcgccgtcttcctggttatcctccatgtcgcaaagaagcagggctggctcgtcgatgggacagaagaagagcatgtgccttcagcaccgcgacacatgaagagctagaaactgcatatatcttattattcatgggtaatatatgcttgtaataagcttatcaagcttaagataggatggccatgaaagaagattatgaatttgaatgggatagtgagaaggcaaagacgaattcccacaaacatggcatcagtttcccagaagctgaaactatctgggatgatccacaagctcttgaagtccaccttgtctccgatcccgaagaccgatgggccattatcggacgaaccgcgaaagactgttatctgaccgctatcttcacatggcgcgatagcagaatccgaatcatttcagcgcgcaaatcgaccaaaaaggagatagatagctatgaaaagtatcagtaacgatgaacttgaacagcgcttcgacgctggtgaagacataactccatacatggatttctcaactgcaaggcaccccaataaagaacgtgcagcacgccgcatcagcatggatataccagaagatatggtacgcggccttgatcatgcagctgctcgcatgggcgtaaacagacaggcggtaatcaaggtatggctctccgagcgtcttgatgaagaagcggaccgcgaagacagacgctacaggaacgcaccagcataatagctgcagcaatacgatattgctctctcttgattgtgttcgacctcgccgtcttcttcgttatcctccgtatcacgaagaagcagggctagctcgtcggtggaacagaagaagagcatgcgccttcttcaccgcagcacatgaagcacgaatagcctgtcccggcacagagacaaagaggaggcctcccgcatctgaactacctcccatttcctatgtccaggaaatgggaggcagttcacaaaggcagaagcacccttccttatcgtgaagcggcgcttctgccccttaaggaagcgctactaggggatagagaagatgcctgcacactcaagtctttctcgcccttgcaaaccttatccatgtgcatcttttgccggcaggctgcacctcccggctcccagagtcgctcgatccgtcttggagccttattgcggtgcatggggcagaacggatgtaaggatagcggctcctgtacatgctggatgagcatccttccctgcctttcccgcataccggcctagaaaagccgtgtggtcggtcccctctgacacgttatggggcattaatcatcgtttccctagctctttaaaagcacaggcatgctttctgcttctctgaagcagaaagcatgctgcctcatatgccaacgccaagatctccgcatggaaaggatggcacttttcatctgccattcgcgggtgtacctatctcagtgtcggagcaggagaaactggacctaatccgttctgcagcacagcacaggattaggcgtttgggcacaggtacagcattgtgctatggttaaccaagttttgaaccagcatccaaaggagatggatagcatggcagaggctggaagaagtcctgaggaactcaagggcgtcacccttctgggcaacaaaggcgtgaagtatccccatgactatgaccccacgcttctcgagaccttcgtgaacaagcaccagaaccgtgactacatggtcacgttcaagtgccctgagttcacgacgctctgccccaagacaggacagcctgacttcggctgcatctacatcaactacatccctgatgtgcgcatggtcgagtccaagtcgctcaagctctatctcttcagcttccgcgagcacggagacttccatgaggacgtcgtgaacgtaatcctggaagacctggcgcatctcatggagcccaagtacatcgaggtcttcggcaggttcaatccgcgtggcggcatctcgatctatccgtttgccaactgggcaaagcccgatgcaggctatgaggacatggtcacgcgcagacagttcgagcagctctcgatgcacgagcaggactaggaagggcgcgacatccatgaaggcaatcgtcctcaacagcggcggcgtggattccaccacctgtgtcggcatagcggtagaccgctatggtgcaaagaacgtcacgaccgtctctgcctactatggccagaagaacgacaaggagctctcctgtgcagagaagatcgccaagcactacggcgtcgcacaccgcgtgatcgattttgcctccacccacatcatggacggctccgtgtgcaccctgctccagggcggcaacgatatagctcacggcacctacaccgaacagatggcagaaggagacggcaagatagcaacctacgtccccttcaggaatgggcttctccttgcagcagtagctgctgttgcccaatctgtctatccgcatgaggaatgcgagctctatatcggagcccatgcagatgatgcagcaggagatgcctatcctgactgttcgcccgagttcataaaggcaatgggtaaggctatagagcttggcacctacggtcttgtccatcttgtggctcccttcgtgaacctcgacaaggcaggcgttgttgcttggggactcaagctccatgtaccctatgagctcacctggagctgctatgagggcggagatgtacagtgcggcgtctgtggcacctgcctcgacaggaagaaggcatttgcagccaacggcgtgaaggacccggtgccctaccgccaataaggaaatgtggctgtactaggaaaccagcctcaacaaaactaggagacatacatgaatacaaggaagtaccatctgctgcagatactcacgtccctttcggtagcgacgctcatagcgtcaaacatcatcacgaacaagcagacagatcttttcggctttgccgtcacctgcggcaccttcaccattcctgtcgactacatcgtctcagatgtcttagccgaggtctttggctttgcagaagccaggcgtgtcaccattacggccttcctctgcgaccttctgtgtgtcgtcctcttccagctgacgcttgtagcaccatccttctccaccttcacagcacaatctgccttcgaagccgtgctcggctccaccccgcgcatcctggctgcaagctttacagcctatgtggtcggcagcctctccaatgccaagatcatggaactcatgcatgtgcatgacagagagaagagattggcatggcgatgcattgcatcgaccattgtgggagagacgctcgatatgaccgtcttcacgctccttgccttcacaggcgtcctgccctggcccatcatcggccagatgatcgttgccgccagtgccatcaaggtagccgtggagtgcatctgctatccactcgtgaccttccatgtcattgcctgggcaaagacactggagtagtggagcaagtgtcgcagaatcggacatgcagacggaaggcttaagtaaatgaagcggagcggcttaacagctccgcttcatcctctaatcttgaataggcaaatgcacaggaatcttatgccaccgttttgctcttagcctttccccatagcgcaaaggaacatacagcagcaataagccacgtggcaacaatacaaatcgttatggcaatgatgttccatacactgccggagggatccatatagaccggcagcgatgtgatacccggcatcacaaagccaaagcactttactccgaggataaccgtcagtgcaccacctattccgtttgcaatcattgctgagatgagcggcgttctattgggcacctgcacagtgaagagagcaggctccgagattcccatgaaagccgaaaatgcacaagtgaaagctgcggacttcaacctctcgtcctttatcctcaatgccgcgccgaatgatgctccagattcggcaagattatggcagaaggataccggaagcaggtagtcgtatccaagcgtggcaatatttgaaatctggatcggacttgttgactgatgcattccgaacagaacaataagcggcatgaataacccgagaagaaatcccgccaccggtcccagggtggagaacagccatacgatgccattagcaagcccgatgccgcaccacgctccgataggagccagtacaagcaggttcaacggaatgactatggcaagtgagagggcaggtacaacgacgagtttgaagagatcaggaactaccttgtcgatggcatgatagataaatgcaagtccggcaacgccgaagatgactggaaatacggaatccgagtagctgaagattggaagggcgattccgaacagggtgagcgggatctcaccagttccaacagcgttgacgatagtcggatacatcaggatcctgcggcgcacaatgcaagagaccgatttatcttaagcttgtcagcacagggaactgccaagaggaacggcagaaagtagaaggggatatccgaaatcatggaaaagacggcccagccgccggcagaggtatcgataccaaatgcggagatgatagcaagaatacccttgaccatgcctcctgcaacaagagcggggataatgggcgagaaaatacccgagataaagtcgaagacacgcacctttgtacctgaatctttagatacgagctcaggctgatcaggatcggcctcgacctcacctttcgccttatcgtcaccaagcatcggttcgagctcccgatagacgctttcaacatgtgggccaatgattacttgccattgaccgtcttttacctgtgcaccaagcgttccatccagcttttttaagactgcaagatccactttcgattcgtctctgagattaaagcgcagccgcgtaatgcagtgggtcgccaccgcaacgttgtcagaacctccgacgagcctgaggatttccgctgccagattgcgcttgtccgtgtctgccatgtctcctcctttggttttgcagatgcaaatagccgtgtctaagacaaatccaccccgttagtggctataacgcgcctgtaccagtcgaacgaatccttgaggtagcgatcccccgttcccttcccctcattatcaagatccacatatatgaggccatagcgcttgtccattgtgaggggaccacatgcaatgacatcgatgaatccccagatcatatacgccctcacgtcgactccgtcgacgactgcctcgcgaagggcagcaatatggtttcgcagataattgatacgatatggatcgtgcacatggccatcgggctctaaagtatcggaagtacccagcccgttttctgctatatagagaggcaggctatagcgatcccacatctggttaagggtaatgcggagacccaaaggatccatctgccatccccattcagaagtcggaagatatggattcttgttcgccataatcagattgccggaagtcttctcccatccctggtctgtcgtggatatctgtgaaaagtaatagctgaaggcaagaaagtctacggtattgctggcaatgagattgtcatcgtcagggcccttctctacagtgatgccaaggcggtcgaagtaccggtccatataggttggataggcacctcttgccataacatcagcatagaaccagttggaatactggttgtcctgaagagcctggagattgtcttcgggacggcaggtcgcaggatagctgcagaatcgagcgatcattccaccgacaggcgttccggggctcttcttatgcacaatctggaccgcacgggcgttcgcaagaaactgatgatgcaaacaatgaaatatccggcaatcgtagtcttcgccttcgacatctttgataaggcagactccatcccaaggcgagaaacgcccagcgttgaattcattgaacggaagccagaagtcgacaagatcccctagattgtcaacgagcgtttcggcatagcgcgcaaagaagtcaacggttctgcgcgatttccagccaccataccggagcacgaggttcaccgggatgtcgtagtgcaccatcgtgcagaagaccttaattccatagcggtgacattcactaaatacagagcggtaccaagaaataccttccgggttaggctcgaaatcgtcaccatcggggaaaatcctagcccagcatactgaggtacgaaacaccttaaggccgagcttcgcaaagagggctatgtcttccttgtaccgatgatagaaattgataccacgacggaacgggtaatagcgcgttccgtcatccgcaagggcagcatcgaactccgctttggagaatggactgtttcggtgcttctcctcgatctgcacgtgggtccagctgccatcaagccaacgcaagtcctgggtatctacacctttgccgccttcattccatcccccgtctgcctgagacgcagagatggctccgccccacaagaaatccggttggaatccgcttctcatgtatcctccaccttatgatgatgtggtcactttgctactcgcaattacttacgaatagcttacgtatcgctggtgaggcggtaaatgtcataatcattcatggtatatgtcagattccactatctaaggtaagagatgaccatacgcaggcatgatgcattggcagatgtcaatgaagctcttaggaccgttacaccatccgaacaatggcacctagaccattctggcaaagcgagccccatctatgacacagctccaaggattcagactccagaaggagaagcatatctcttcgattggaagggaacgctgagcgacaggagcgtaggcctcataaaggaaacgagattcacctctgttcctgctcatgtgaaccaggacatggaggtcagttacgtctatgacggcacatgcggatttgccgtgagagattcctattacgtattaggaagaggagatgccatcatcttcgatccaggagtggtgaggtcctcccccacgtacaaggaagctgatgacatcgtaatatcgatggtcttccggaaagagttcttcgatatggtatttctcagtcagcttcccggcgggggtatgctcactaccctgctcttcgaatatatctcgtcgaggaggcgccgtgacagctatctagttgtgcacggcaccggaaacggacgactggaggtgcttgttgcactcttgttcttggagtttgaaacacccgatgcattcagcgaaatcatgacgaaaagctatacatcctcgctcttcatggagctcatgcgaggactagcccatgatagcaataccagaattggtcagtctactgggggaaacgacatatccagaatgcttgatcatatcgagcacaactatcgaacatgcacgctctcgtcaactgccgcagagtttggatatagccccagcagactcggagcactactcaagcaagcaaccggccaaacattcagcgagattcgcgtagcacagcagatgatcgaagctgcctacctacttctcaacagcaacaagactattgttgaagtggcctcagaagtcggaatcagcaatatggattacttttatcgcaagtttcattccatgtatagaatgacacctcgggcgtatcgtcttacaatgagtgccgacatcaatggagaacccacacgctaagtaaaacaactaattaactaattatgaagtagcgacccccccccgcacgacctaagatggtgcttgcgaagacatggagtggctgcagtgagagggacaatcccatgggagactgaggcgcttggaaagggggccgcaatggcggaccctaagcactccaggaagctctcaggagagtacaagcgccagatcgttgagtttaacgacaacaacaagagcctgcccagagataggtgccgacaacgacatcgccagctcgacctgcgcctcaaacaaccacacgcctaagcaggagtgtaccctcaatcttacaaggaagaacaagcactttaaagatggagctcgatattttaaggacggctgcgctgatagtcgcactgaggtagccgcgatagcggaacgcgccggactctatccgcttatcagctctatgtaagctgctcgctactccgaagtcgacctactgcaggcttgcgcggcacgcccgagcctgagaagtacaaagaccctctcgccggtgccgtcaaggaaagaagtaccgggtaccacagcacccagctcacaaggcgccggccaagtgcaggatctgctccagcagcaggcacctcgccgaagccataagggagtgtggcctcgagtctgccacaccaaggcgaagttcaagcacgcacctccgacagatccagagaggccttagtcctcaccttacgtctgtgtgctgggagtgtgggtgctacatcttcctgctcgtcgatccgcacagctgaaagatagccagccacacatttggggcgaggaaggacacggggctggccaaggcagtattcgtatgtgtggtgttttcgctcttcgacaagggtgagctccacacggggtgcggctttaagatcgctggagtcgctatagacgagcctctggaggccttctagggaaacgatgattactgccccataacgtgttagaggggaccgaccacacgactttttcgcagccggaatgcgagaaaggcagggaaggatgctcatccagcacgtgcagaagccaccatccttacatccgtcctgccgcatgcaccgcaaggaggctccaagacggatcaagcgactctgggagccggaaggtgcagcctgccggcagggatgcacatgggtaaggtttgcaagggcgagagagactcgagtgtacaggcatcttctctatccccctgtagcgtgtccttaaggggccgaagcgccgcttcacgataaggaagggatgctctacctttaagcggccggatgccttcctggactcgatgcctttctcggctgaaagcgcacaggcaaggccctctctagtcgaaggtttccttagcaacgctttagcgcatagatgagaggtgtgggtctgctgtgaccttaagggcgcttcgctataccggtataaccggagtctgcatagcagaacctgtcatactcccttacgagtgtgtgtctggggtatgtcggacacattctaggcgatcgtctccacaccatgtacaaggccacctgcggcatccacgccgatatgcgccttgtatcagatacgccaggctccccttttcttggactggtgcgccctaagggttacgcgcatggtcgtggttcttcgtggagctcggagcctcgatgaaggtcgcatccacaatggagccaccccgcgccgtgatccctgccctcttcaagcttttaagtccaggcgcaaagcacaagccttaccgagtccccgccgctcgaggctatgacggaatttcgcaagtgtcgttgtatctggcacctgcgcctgcatgaggtctgcgtgcacagaagcgctaccaggagtggcaatccaggatagcatctttaagttctctcgtcttaagagagcaaacataacctaaagcaggctacatcctgttatgaagtgaccgttgtcaagaggtaatttcaggaaattttcctccccctggctagccacatttgtgtttctctgacagcatctggaaagagctctgatttaacagttcccggcatgtgaccactctgttatacgtggattggctaccaacaggctaatggttttgccgtgagccctgcgatctaaaagcgtggattactgtttccagtgccaacataggatggacgcggatggcttaaaccttacagtgatcacagcttcctccagatgctgtcaggtatttactttgtctattactgcataaatccgcagattcctgtggatttatgccttggctgcccatagacatcatggacagatggctgtcacagggcttgccgcgtaagcggtgcgtagcacccttgacagacaaatggaccagatgttactcatgctgccttcttttaggcttctctgggagcgatagtgcctgtcatcattgcccatacaaagcaggcaagttccctggcaactgcagcaaccgctacatttcttttttcccatggcggatcatccggtaatacttgctttaaagtcttgtgtttgctctgtcagcatatgcaatgacatcagctg

SEQ ID NO: 381 - DNA, 34568 bp, Unknown
  Metagenome-assembled genome
gcacccatctgcccggcccgatttcccatgcccgtgaggcctgccgctgcctggcttcatccaatccccccctcgcatctacggcttcgtgcggacggccggaaaagaaaaaaaagaaaaggaaaaaaagggccgcaaagtaagtcacaaaacgacacagaggattcgggacatccacacaggagattccaacgtgcagtgcaactacggggggtcctcactgtcccaggcagtatctggtttgccaagtggagtaatcatcacaatgctccgaaaacctgacactgtcagggagaagtggccgcggatgctacacttgtcatcgcgctccattcctcttagagtctgtatgtcgcaatgcaagattctagaggatggccgcttctctgtctttctgggcatctgcccacagcttttaggattgaaccagaaaaaggtgcgaagacgcaaggccgccaacgcggcggcgatcgagctcggaaccggcaacggccgcgtcgaggcgatcaacaacaagatcaaggtaacggtcaggatgggctatggctttcgcaacaccgacaacctcatcgaactgctcatgttgaggtgctccgacaacaggccgacgcttccgggaagggccgaggaaagtacgaagaagaaggctgcttagatgaacttctcacccatagaaactaccgaaggctcagaaaatatcctgttccactagtcattggctagcatcaattctgttgaagtattggctctattaagagcgtctttcactattccattgggatctgcatccataataattgctgaaaactcagaaagctttgcgaactggataaatccgtttgcattcacttttgatgaatccatgagtaaatagcttgtattcgcatgattcattaggttgactttaatagatgcttctggctcgtattccgtcatgaatccttgattagccaagaaagcattagtccccatgaatgctttatcaaaatgaagtgtctgaatggttgagagcgtcaactgcccatatgtatacctgtgttctcgcctaaacgtaccacccagaactaccaagtctatatctagtagatttctttcgatatattcagcaatagcaaaatcattagtaactacagtaatgtcctgtttattggctagttgcttagcgaattctaatgtcgttgaaccagtatcgatagcgattacatcaccattatggattagcttcgctgcttcaacagcaatccgtctcttttgatctatatttaccaccatacgctcacgtggaacagagacatgtctcgctaaaccaagtgaaacagcgccaccatacattctcttaagttttccttctttttcaaggatatttaggtcgctacgcgctgttactgcagatactccaaattccttagtaaggtctcctattaaaacagagtggttacgcttaaccatctccataatacgtgctctacgatcgatcgctaatattttatcggaattttcccgagttccagcctgacgagacatctctactccaattaatatttaattctttgttagatcacaattgacctgagaaaggcccaatgttgtctggacctttgcctacaatacatgtcgccaaacaaagacatcgagaaacggaagggcccagatagattcaatgatactgcagcggatcgagaagatgggcatcgagggaaagcgcgagctcctaggggaacgatgattaattcccaatgatgtgccagaaaggaccagccacgtggcctttcgcggccggcataggcattaatcatcgtttccctaggccggaatgcaggaaaggcagggaaggatgctcatccagcacgtgcaggagccgctattcttacatccgtcctgccccatgcaccgcaataaggctccaagacggatcaagcgaagctgggagccgggaggtgcagcctgccggcaaaagatgcacatgggtaaggtttgcaagggcgagaaagactcgagcatacaggaggtcttcttatcctcctgtagcgcttccttaaggggcagaagcaccgcttcacgataaggaagggatgctctacctttgagcggccggatgccttcctggactcgatgcccttctcggagaagagtgcacagttaagaccctttatggtcgaaggctttcttgcaacgctttagcgcatagatgagaggtgtgggtctttatgcgtccttaagggcgcttcgctatacctatatagcctaaagtctgcatagcagaacctgtcatcttcccttacgagtgcatgtgcctgggatatgtcagatacattctaggcgcttggtctttacaccatgcacaaggccacctgcggcatccacgccgatatgcgccttgtatccgatacgccaggctccctttttcttgggctcttcgctgtttctagtgggtagcgtatgccagctgcctctgggctgtgaagtccagacggcctagcctgaggaagatcatcgtcttgaagtagtcgatgcttctgaagcccttggcgatgctgcgggcggactggacgacggagttgagcccttccaggaacgagttggtagatcccctcttccaccagttcaagatcccctcccgctccttcctgagggtcctcgccacactcttcatctcggctacggcagagtgcatcatccacgagcagaggcgctctggggcctctgcggccgattccctgcctgcgcatgaatagacgtcctgcagcgcctctcccatctggcaggcccttgcagtcctgagatgggtcttcgcagggtcgagctcctccctcttcgtgagctggcgctttgtgagggtctccttcttcttcagccatacgtacttcgtccctgcgagctgccagctgccggcgcttctccgccgactcgcgcctctctgcgcacctcacagggtctgtcgccctcatcaggagctgcaccacatggaagctgtcccacgctctgtgcggcctggggcatcttggcggcgacctccagcgagtatgccttaagccatgtcgcgcgtgacctctaagaccttcgtgcggtcccctcccgtgctccttaagctcggcgcagagcctgcctaaggcctccttgtccctgccttgcgtgacggccacggcacgctgacagtcgaggttggccatgatgctgatgtagctctggccgcgccttttggcggtgtcgtctatgcccacgcgcacgacatccgagtagtcggcggcatcccttgcctcggcgacagccttgcccagcaggcaccatatgcgcgtgggctgtctagggctgtgaagtgcgtcttcggccgcacctttcagggcatccttgtggcatgcacgccgtctttggggcagtcggccctgggcagcgcgcagtgcacgatcgtatcgtattgccagatgctaagatgccacaaggtcctctcgtgcgtgtcacaggtgccgcacatcctgtggcatacgggacactcgactgcctggcccttcctgtgggctaccctcacatggagctcgtcttgcgctccctcgcgctccttaaaccagacatcgcagagctcccattcgtccttaagcctcatcgacctcttaaagagccttgccagcatccctgccttaagcatccatatcgcaccttaagaacgcagcctcctgtcggggaaaatcctaccgtttaaaggccacgccctcaaggggatgcagaagtgctacccaccataagtagcgaagagccattattaagtggtagctttcctttacctgttcctggtaaaggctacattgtcatcagatgctgtggagtggtcttgctcccctaccgctcgacggttttagagaggctccagccacagcctctttgctgcattgttgatcagttagataccgcatgacggtttatgtagaacgaggatacgattggcagaaagccctgtggtctgacgacagcatcagaatcaaccgcttctttgatcttaaagatgatctacgttggaatcgatgtcgccaaggacaagcacgactgctgtattcttggtccggacgctgaagaactgttcccggtctttaccatccggaacaatcgcgaaggctatgatgagctgttcagaagaatcgagacggcctcaaaagacctgtcccagataaaagtagggctcgaggctaccggccactattcctacaacatcttgggctcgcttcttgatcgaggctaccgcacctttgtaatcaacccgcttcacacaaatctttacagaaaaggtcagcgccttagaaagacgaaaacggataaagtcgatgcccgctccattgccgaaatgcttgtgactgataagaccctcaggccctacacggatacatcgtaccccagcgaagagctgaagtcattgaccagataccgctttgatctcatccagaggagagcgaagctgaagacatccatcaccaggctggtgaacatcgtattccccaaactggaaggcctcgtcccaacgcttcacatgaacaccgtctagcgcctgcttgaagaaatgcccggtgcgtcatgtgttgccgatgccaacctcacacatctgaagtccctgctctgtgatgcctcccgtggccggtatggccgagagaaggcgatcgagatccggaatgcggccagatcctctgtcggatcagagatgtctgtaaaatccatagaactcaagcagacgatccgccagatcgatgccctgactgccgacatcgaaaaagtagaagcttccattcgaaagattatggacaagagcagctctccgatcatgacgattcctggcatcaactaccggatgggagccatgatcctggccgagattggcgatttcaaccgctttgacaatgcggaccagatccttgcctatgcaggcatgtcgccatctacctaccagtccgggcagttgacatccacctatgcccatatggagaaacgaggctccaaatacctccgcttcgccctcttcaacgccgctatatacgtctccaagtgggacgagcggtttggcctgtatctggccagaaagcgtgctgaaggcaagcactactatgtcgccctgtcgcacgtggcaaagaagctagtcagaaccatctaccggatggagctgacccatagcgaataccaggcagcgtaaatcttacaacccatagccttttcttagagccctattcccgagactctgttcgtcatgcagttttcaaggcactgatctatctaaaacacgtctccgtgttttattcgaaaaatcgtaatttcatgattgacttttaatagttagtcttccttaaccaccgcagtcccaatttagtaaacagaaggctatcaaacacatctgacgcaacgagaagtgccagaaaaggtcactcgtaagcatgagcccgctccaatacaggtacagtctggggcttgcggcttaggagagaaaggtacggattctcgttaccaccctcaggtggcgattatcgtccgacgttaacaatgatattacccatccaaacttataactatttcgctaagatgagtcgcgtcgagatatcctctgtagcatcagccatgatgccaataggatcactgtcgcagatgattgcatctgcatccttagggaaaccgaaactaaagagcccgggtgcatttattttctccgcatccatcatcacgtaggtaacagcagcacacttcaagaaagcctgcttcagttgtgccatgccttcaaagtttgtagcaaagccattctgtgatgaataagccgtaggacacacaaaactaatatcagggtggagtgtagagagcgcacgtacagtagcagggccagttacgtagcgatgacctttacgcagcttgcccccaagtaggaagacatctgactctggtagcgatctatctacataatctgcaatggttaggtctgcagtaataatcataaggcctctacgttcacgcaaagcacgaacaagagcaagtcctgttgtaccggtatcaaccaaaacggacatagaatcttgtacaaattctgctgctcgttcggcaataagacgcttcgcttccacattaacattcatacgtttatcctgaacagagacagtaagtgcacgaccgagtgagacagcaccaccgtgtgtacggcgaagctttccatcctttgcaagagtatctaaatctgagcgtgcagtcactcgagacacaccgaactgctgtgcaatctctgagacctgtactgaggcattcttatccagaagcttgagaatttctgtacggcgttcctcagcgaattctgtcatgatttcccaatctctacttatgcaactatctgaccacagtgcttacaaatcaatatgtgaataaattgtgatgatagaatcttatccagtcccactataacatgtttctttttatatcttttatttgccataaaaagattttttgatctttatatatcaaaaaacaagcaaatgtatttcctcattttacactcatgagcattatttttacctatttacctgcatgtattaggctttttacacttagaatgcactcaaacaaataaaaaggccggtcaaaatcaaagtttctaaaagcaaaacagtaagtcatagaagactatggagaacagtatgcttaccacaacaaaagagatgcttttgaacgcacaagccggtcactacgcagtaggtgcttttaatgtcgagaaccttgagtttgtaatggcagtcatcaaagccgctgaagataaaaactctcctgtcataatgcaaaccactccagggacgataaagtacgcaaatctggactactttgtcgcaatggtcacaaccgcagcaaagagtgtacgtatcccgatagcgctgcatcttgatcatggtgatagctttgggcgctgtatgcaagcactccgtgcaggttatacctccattatgatcgacggttcacatgtaccctttgaagacaacataatcctcacttcctccgtcaccaaagtagcaggctctatgggagttcctgtagaagcagaactcggtaaagttggtggtaaggaagatgacagaccagcagtagagggagaagaccctttcactgatccagcagaagccgaggagttcgttgcgcgcacccactgcacctcacttgcagttggggtgggaaccgctcatggtatatacaaaggaaccccacacatcgagcaggaaatcttaaaggaaatccgcaaacatgtcgatatccccttagtcttacatggaacctctggagtacctgacaatcaagtagcagaggccatccaaaacggtatctgcaaagtcaactatgcaaccgagttgcgccaagcatttactaaaggatttatgggctatatgatccaaaatcctgcatgctttgatccgaagaagccgagcaaagaaggtatgcataacatctatcaagtagtttgttcgcatatggacaacttaggctcaaccaataaggcttaaaagctaaatggctgaggacttgcagcataagcccagcaattcctgtcggtcccgaactgcatactatgaatgaaaggttgatgtatccagaagatcggggaaagacatggccaaggggcatgcaggcggacttaagcatgaagtgaagtggccgaactcgtgagacagggaaagcccgatacttccgaaaacccttgctaaccggacagcagcattgtaggcctatgcagcctcgcagataccgctcctgtaccactccgccggcgtgtcgtagccgagcgactggtggatgcgcttctcgttgtaccacgtcacgaacttcgcgatgatcgccctgagctctgcaggcgtgctgtactcctcctgccgcaggcactccgatttcagggtcctgaaccatctttccatcagagcgttgtccctccatctggcccttgcctccatgctctgctccacatgcatggatgcgagcagcgacacatactcctccgagccgaacacgcttccctggtcggagttcatgatggagggcgtgccgtgctcctcgaaggcctgcctggcgcatgcagccacctcctgggcgcgcatggtgtcaaagagcctccaggagacgatgtagcggctgaaccagtcgattaccgccgtgaggtacatgtgccttccccctatctggacataggtgatatctgtggaccaaacctggttggggaagaggatgctcttgcccttcagcagatatgggaacctcctcgactccctgctgggcttcgagagagatggcagcgggcagcaggggcggatccccatgaggcccatgagcttccccaccctgtagcgggtggcgcgcccctcgccctgcttctgcagcatcttcgagatcttcctcgcgccgaatgcggggctctccacatggatgcggtcgatctcggcggcgagccgctcgtccttatcggaccatgcatctgcgccatccgccgctcctgcgcctgccatgtctcggtaggcgctcgccctgctcacgccgagcagctcgcatgcgcgctgcctcgtgagcccctccggaaggtcccctgccgcagcctcacgccttggggtcgtatccgttcctgtcgcaaaaccgctggaggaagtcgcgctcgacggtgagctgcccgatcgtcttcagggcttcgtcgtactttctctgcgcggcctcctcctgctcctttctctcgcgctcctccttcgtcctgccgaatatgctgtcggcgcctgcaaggagctcgtccctccatgcagcggcgagcgacgggctcacgccgtgcttggctgccacctgcgagagcgtctcctgctccttcgcgacctccagcgcgacggccatcttgaagctcgcgctgtatgtcttcctcgtcgtcttggacatctcttcctcgcaatccgtgtcccctcggacacatctttgcgggattcggaaggatggtcaaatcggtgtctcagaatcggcggccacatcaccggaagagaggggggccggcagggacatcgtccctgccggcctttcccatgttccgcagcaggtctagctgtaggacagagtataacagctgttgctatttgaaattcgacttaccctttcagtctggtatatgagtgactggtaagctcgtctggtaaccagaatcatccattcgtggtaccgcctgtcatcggtgacggtaccgcaggccccctccctgtagcatccgctgcatggcatccaataggggatgccacgacagcggaaggggctgataccctatgaccaagcacaaggcattgatgctagcagtggcgagaggagggatgagccagtcgcagatagccgcatcgctccatgcgaacaagcaagacgtattggcggcagcgaaggcagtgaaggagcacgggctcgatgccgcccagatagagggaatggatgcggcatcgatcgagaagaggtacttcccgaaggagagacacaggcctgtgcctcggtcgttgcctccttcgacggcagccaggggagatacggataccgccgcatcgcctcggagaccggcctcggcaaatggatcgtgaggaagatcattgagctgtaatcttttggtggacagtgggattcagggactggcaacagatatgctctgtccagatacccacccagcacagtcaacagattgaagagatgagatgtcgctaagcgcaagcgagatagagaaggcaaagtcccgcacgaagccggaaacacccaaacactacactgaagaagtattgcctcgaggccatcgactactacaggaaggcacgtaaggccaacccgaagaagagtatcaaaggatgcgccgcaaagcttgaggccaacgacaagaccttaaacgactggatcatcaagcactcaaagaccaaaagggtgacccaggaaaggatagacgagcacaagcagctcgacgcagtgaacaggcgcatgcacgagcttgaaagcgagaataagttcctaaaaaagaggcagccttcttcgccggaagcctctgacgaaggacaggttttagctcatgctggagaagagggcaacctacagcgtctcgatgatggagcgcgtactggaggtgagcagggctcacttctacagatggctcaaggccaaaggcggtgaggacctatggggtcccctcaaggaagccatcatctagatatgggaggaaagcgacaggcgctttagctttcgctaggtatggtccaagctcacaggagatccgaagttacgcaaaatttacaggcacgacccgctaccgcgtgcgcaggtgcatggctgaactgggataggcggcatctgatccaatgcctccaagagaacgacgctgcccgcacctgatacccccgagcgccccgccctcacccggcgcggcttttcgtgtcttgtgccgacagccaagctcgtgggcgatacaacctatcgcaggaccacggcaggtttcatatatcttaccgtcgcgcaccatctgtgcacacacatagtggtgggctgaagcatacaggacaacatgagggcaggccttgtcgtctttgccctgaagatggcatattcgcgcggatacgtggccggaggggccatattctaagcagcccaggcagccagtacataagctcaaagctggccgcctgctcagccgcacacgacgtgaggctctccgtggggagaaccggaagctgccacgacaacgctgtcgccgaatcgcttttcaccacgctcaagaacgagtggtactaccacaagcgcctcttagacgcatccacgaccaagcacaaggcacacgagtttaatcgagtcgtactacaaccgcttccgcccgcataagtccataggagatcgcgtaccggcagaggtgatgcaggagttcttcgagcgcctcgagagaggccttgcatacgatccaaaggtgatgcagaccgcataaaaaatctggttcaatcctaaaagctgtgggcgaatgccagcggcgtagcgccctcagagacagaagagcgtccatcctctagaatcttacatcgcaacatgtagactccgaacaaggatggagcgcgctgacaagtgtagcatctgcggcagcccagctgcccgccgtttcccatgccgatgagatgtgtgctcccggcttcctccgcattccctcccatctggacggattcatgcagacaggagagcctaaggagagcgtgcgcaccgaggagttcggcacctcggccagacgatgcagcaggccggtgcagatcctcacggtcccaggcaggctggctgcgagggaagccccctcatgcccctgctgcggaaaagccatggagggcaacgggcaggtccccattgcgcttcggcacctccctttgggcatggagaggccaagggtcgaggtcttgcggccaagatgggcatgcagggaatgcgggacttccagcatcgaggatgttcccttcagggcgccagggcagcgcatcacgctgttgctgctcgccttcgtccaggacctgcttgcattgggtcagacccttaaggcggtatcacccacggcaggccttaataggaacgtcgtgaaaaagatcgacagggcaaggctctctgcgctctacacggaaggcgaaggcagcaggctgaagctccgcaagcccaagcgccaggcccgctatctgggcgcagacgagttcaagctgcacaatgcccgccgctgggccaccgtgatcatagaccttaagatgggccacgtgctctggctcgcctatacgaagaggaaggatgtcgtatacggcttctgcgacttcgtgggcagcgagtggatgttgtatgtggaggccatcgcctgcgacatgaacgcagacttcgggcgcgccttccttaagcgccatccgcatctctcggtcgtctacgacaggttccaccttgtgaagaactttaacgagaaggtcatctgtaaggtcaggaaggataagcaggcaaggcttaaggaggagggagacagcgaggctgcaaggtccctcaagcactccacatacatccttaagtcctgtgccgacaccaggaagaggaaggagcgctatgcacgtgccggcaaggtcgtctcgaggggaagcgccctcttcggcaagcaggaggccctgcagaagggaggggccagggagcgctacaaggagctgatctcgcagaacgagctccttgccgcctgcgacatcgcgggtgagatgctcagcagggcgtacggctatcggcaggagaagcgcatgcgcgatgccatggagaggatagtcgaggtctgccgcggcaccggcgacaggcacttcgagtggttcgccaggctcgttgagagccacatggacggcatcgtcgcgcatgccaggcaccatatcagcagcggcaaggtcgaaggcacgaaccagatgatcaagacgctcaggagggcaggctaggaataccccgacgacgagtacttcttcctcaagatattcgatgcgagcaggcgctattcgaagccttccggggctgcggcatgataggcccgcacacaggtttcaggactgaaccaaaaatctgagattcctctgtccattatattgacagagctcgcatgaaggaggagggcctcgaggcgaaggcggcgaagaggcgcaggcgctacagctcctatgcaggcgagatatcggatgcctcggacaaccctgctcagggacgcaaacggcgcccaccatttcggcgccgatgcccccaacgaggtatggatcacgcacgtcacgaaattcaggatccctgccggcaaggcctacctctcttccatagtcgactgcttcgacggcatgcccataagctggagcgtctcctgctctcccgatgccgagatggccaactcgtcgcttctcggcacatgcagccagctcggggagggcgagcatccgatcgtccacagcgaccgcggctgccactacaggtggcccggatggatcggtatctgcagcgaatatggcctcaggagatcgatgtcgcgcaagggctcaagccccgacaatgccagggcggagggactgttcggaaggctgaaggtggagttcttctacggatgcgactggacgggagtcacgatggagaggttcatggagcttctggacgagtatctggtatggtatcgggacgagaggatcaagagtgatctcggatacaggagccccatgcagtaccggaaggatctggggctggcagcgtaggaatcaggtccaaattaaccaccgcagtcccatcgtaacaactgatctattcatacgaaatatacacctgttcaggcagttttgcatcaaggcgatgggcgacaggctccacgagatgatagacgattccgaatgcgacgatatggccttcgagaagcgcatcaagatcctgctggatgcaaagctgtccgcaaggcatgggtgcaaggtcgcgaagctcacaaggaaggcaggcttcaagctgccggcagcctgcgtggaggatatcgtctacctgccggggcgaaagctcagcagggaccgtgtcgcaaggctgatcggggtgcaggtgggtgggaagggccgaagtggtcctgctcatatcgaagacgggctgcggaaagagcttcctgtgccaggcgctgggcaacgcagcatgcagcaagctcatccccacgcgctacttgcgcctcgccgacgtgttcgacaggcttaaccgctcgagggcattcgatgccgcctcctactatagcttcatagatgacctgaagagcgtccagctcctgatcctggacgacttcctcaccactccgattaccacgcagaatgcagtcgatctcttcgagatcctggaggggcgcaacgagaaggtggccacgctcatagcctcccagctggagccccatgaatggtatctttggatagagggcgggtcgatggccgactccatcctgggtcgcgtcgcatccgcagcgaggcgctacgacctcgacggtcctgacatgcgaaggtatttcgcgaaggacatgcccgagctgtagcggtaccgccccgcattgcctgcggtaccgtccagaagatgcccgtggtaccaaattgcctgacagcggttaccacgggcgtttactagtcatatgaggctatactcaaagtctgtctatttgaatatatttcttatacttttctacatgagaaaaattaccaagtcccggactctccacaatatttgaacctacagcttggcataagactaatgcctcctcaatagcagtctgatcattaaaccataccgataaaaagctgccgagggtgccatcacctgcacaggcactggaaagaaccgaaattggcagtgtattttttgctcgccatattgactctccatttgaaaagtaggctccgctggcccctaaggtcagaagaacgttcttagcgccatgctgatgaagatattgcatcgcatattttgcacttttatcgtccttgacatcaatattgaaaatgtcccgcagctcatcatcatttggctttatgagtagaagcccttttccaatcaaagttcttagttgaagactcgatatatcaagaacaacctcacccccacgtaatttaacggtatcgatcactcgactaagaaaattattcgatgtcccaggtggtaaggatcctgataccactaggcaatctagattcttgatattttcaagaatttcgatcatttgtgattcttctgcagcatctattgttgtgcctgcattcacaaatttatattctgcacttgacgatgtagagagaaataaatttacacgtgtaatacctttgcaatgtactggaatcacatgaacgccccattgttcagcacctgaaattatgtaatctccagtaaaacctgcgaagaatcctaaaatactggtatcacaaccaaagtgcttcaaggtaaacgagacgttaagacccttcccatttggagtaaatacggcatctctagttcgtatcacagaatttggtttgacaacgccgcacgtttcatttagatcaactgcaggattagccgttaatgtataaatcatgaggcatttactcctgatcaaaattaacaactatgcgataggagcttccctcaatagccttttcaaaagcatccttaacttgactttcatgatatataccgcttacaaaaggtttaaggtttacaatacccccggaaactagtgcagccgcacgaacaaaatctctagaatttgagttagctgtacccaatgttttaattgaccaactatgcatccaacctgcatcaattggaacaagtttgctctcacctgatctcggatgaatggaactatacaagataacctttcctgcattcgagacacatgtatatgcttcttggagaacagtagggaacggagttgtgtcaaaaaccacttgacactttaatctatgtgtatattccaaaactttttctgtaaggttttcattagatggatcaatcacataatcggcgccattcttctttgctaaatcagcacgctctttatttatctcggaaacaattacaactgcaccacgctttttcgaaagctgcacatgcaattgtcccatgatcccacagccaataataagaacgaaatcgccgagttgaatgtctgctgtctccacgctatgtacgacacatgaaagaggctcaattaatgaggcttcctgtggagaagcattgtaatacttaaatagactatgagtatttacaagcatatactcagataagcctcccataccatgatatggcagaccttctagctgcaagctgtgactaaagtggctgcaagtctgctcttcaaaagtcttgcaataatagcaatcgccacaaggacaggtatttcccacaactaccttatctcctactgcccattctcttgtgtttatgtcttctccaagctcaacaatcgtacctgaggtttcatgcccaccgatgaatgggtattcaacattatttactcctgtatagacacgctgctcccacgtacaaagcgcacaacaatctattttgacgagtactttattgccatatgcgtgcggacgttcgcattcttcaagcgatatatcattaataccataaaaaactgcagttttcatcagttcactcataggttcattctccttgtgctagtaacatatctcttatttatttaatgttaaatgtttccgatagcatataagctaagcaactggtgtcaaaatacctagagcaccaagaacagcagcaatcagtacgattatcagcagaacacgagttgatttcatctgcttaactttaagcatgtaccagcatcctaaagtgaaagcaagcggaagaagaccaatcagcaaatggtcgagtacgtctgtttgaatattaagtgatgcttctcctattacaatagagaaattagctgaggcagtaacgtattgtgcagcaagtgcgcctaatactatggaacccatgatagaagctgcagtaataagattctggattcgaccgctgcccagcaaacgctcaacgccacctctgccctgtttatagcctgtcatgaacatgaaatagccaatagaagtttgaatgacaaacattgagatagcaaaaaatattgcacccgctgaagatcccccacttgcaagggagacaccaattgcaagtaaaatgggggataaggtaccttgccacaaagtatcaccaataccagccataggacccataagcccggtttttactgcagagatagcttcacctgtaatagctgggttattagctttttcttcttccatagcaagagccagtccattgaccataccaccataatgcggttccgtattgtaaaactccatatgacgcttcataaagtcaatcttggcttgcttatttctaggataaagtttatcgggtatatgggacatcgagaagagaaggccagaagcttgcatacgttcataattgtaattagcgtgactagcaaaagtccatttccagaacgttctcgtgacatcagatttagataaagatacgcgtttttctgtttgcgtattagtttgagcatttgccatcattatcatccttctcactcaaaatcagcatcagaatcatcagaagcgacatcatctgagacatttgcagccacagaagctgcttgaatccgttgtttctgttgagtagaaatattgtccataaccccagtaataagggaagctgcgataccagctaaaatagccagagggagagtgcttaaaccagaatatgctgagatgacaaaaccaaaaataaataatggaattacataggaacgatcgagagaacgtaagttcataccaatgccgatagctggtaaaatgccaccaataacctgcaatgtctcaagcggacgtccttgcaatgtattaataatgtttgttacaacaccagatccgtaatacacaccgagcattacaggaattgtaccaatcaaaaaagcaactatttgaggaggaactaaatgccagaatgtcaacgctttcatgtcgcctctgtcagctgctcgatcgcacatatgtacaaatggtacatcaaccgtcatgtgtacaacccaaactatagtcccaagcaatcctattggggttgcaattgcgattgcagtattggggtctacatttgccgcaagggcaagtgcagtgccaagtgttccagctaagcctgggtcagttggtacagatcctcctgctgaaatatacgcaatatatggcagttgaatagcagcaccaataagagctccctgcatcggattacctaaaatgaggccggtcagaagaccacctactagtggtgttctaagaattgttgagccaagtaacgtagtccaaggtgttccgttgatgcttaagtaatacacaacaccaacgagaaatgcttgaaatagtgtaatatgcataagccgtctttccttatttgagtagttttgtaatttttacttgtaggtcatcagcaagaatttgaatttcaacgtcaatccctttcgctataagttccctaaaaatctgtctttcttcgtcagtcgctgaaatgttccggtaaaacttagtgcgatttccacgtgcacccattccaccaataatgatctgagaaattgaagcacctctattaactaacgagaggaaagtctgaggatattttgcaagcacaatgactctgtcggttggtttaaaccccttgatcaaacgatccgctgccttcttctcattaaaaacaccaactcggacattggagggtacagctcctttatacacagtcttcaagaagggatttgcagcagtttcatcatcgacaatcataattttatttgcaccagttgatttaacccaagaggtcattacctgaccatgaatcagacgatcatcaatacggcaaagaactacctttcctttattggaagaggaaggatagtcttgcattgtgttagagacattcacagcaggggccgcaccaggttccatttttgcttgcttattttgcatttgttctggtgataacatgcttgtaagttttttattaagatcaactacaccctcccgttgtgctttaaatacttcacgcgataaatcctcgagccctatctgatcccgcatgaaaatagcttgaattactgcaggtaaattgacacctgcaagcgcccgtatcggacgttctttcattaatttcaacacgacatttgaaggtgtaccacctagtaaatcaacaagacataagacaccatctcctgtatcaaccccatcaattgctttagcgaatttttcctcaaatgccgcaggatcatctccatgaaaaagcccgagagtttcaacatgctcctgtggaccaaccaacagctctactgccgatttaaaaccttcggctagtgagccatgcgtggcaataacaataccgaccacgaattctcctctctccatcgtgcaatactcaaatgactactcaagtagatacttattgaatataaattgaatataaacgaaggaacaagaagaaagtcgaaaggtaatattttgtaggtgagtggatacgatttctattgctatgattaaagttttagtagatattattgttattaacaattatataaatctcgctattagactatgattggcctgagaggaggcgcaaaagtgtccggacccccgtctacaatgtatgtcgtcaaacaaggacattgtggagcaaaaggcccgggtaaacttaatggtactgcagcgcgtaaaagagatgggcatcgcaaagaagcgcgagctcttagagaggctaggggttctcattgctaagaagataacaggatctaccctcgcaggtaagcccaagaggtgttcgagatgcgaatcggccgacttctggcgtaaggggcacgtttgacctagcctccagagatggaagtgaaggacgtgtggaaggaccttctcggccaagacggggtccgccatcgcggcgtcgaagcttttcgctaccacatgggcaaagtatataaaaggcacccttgcaggcatgacacttaaggagcttcccctcgcctgccatattgtgcctcaagacatcgtggttccatgcgtgtgtttgatagcctctgagttgcgtgccgggggtggtaacgtttatccgtacttgtgtttgtaatcttctacttactgattgggggtggtaacgcaaacccgtaccaaacggtgatccttggaggacagatgtacaccctcgaggagaagacgagagcggtcgagctctacgtcaggtacggtaggaaggtggccatgacgaccccagggaaacgatgattaattcggctcgatgaggtcgttggggctgtaagctggataccgccggctcaaaatgcctcgaaccatgcgatgcccatattcacataaatgcctatctgcctgcggatatgttataattacagcaacgtattccagcatatccaaaaggaagatatgggcagccagatgagctttggggaccttaaattccggctcagtcctgaaatctgtgtgtggccccatcacgcaccagccccggatgccttcgagtagcgcctgctggcatcgaagatcttgaggaagaagtattcatcgtcggggtatccctagcctgccctcctgagcgtcttgatcatttggttggtgccttcgaccctaccgttgctgatatggtggcgcgcttgcgcgactattccctccatgtgcccctccacgaggcgggcaaccctggcgaagtgcctgtccccggtgccgcggtacatgtccacgatcctctccatggcagcgcgtatctcatccgcatcggtgcacgaataggcctgtgtgagcatctcatctacgatgtcgcaggcaaagggcagctcgttttgggatatgagctcctcgcagcgcttcctggcgcctcccttctgcagggcctcctgcttgccgaagagggcgcttcccctcgagacgagcctgccggcgcgtgcatcgcaatccttcctcttcctggtgtcggcacaggacttaaggatgtatgtggagtgcttgagggaccttgcagcctcgctgtctccctcctccttaagccttgcctgcttatccttcctgaccttacagatcaccttctcgttaaagttcttcacaaggtggaacctgtcgtagacgaccgagagatgcggatggcgcttaaggaaggcgcgcccgaagtctgcgttcatgtcgcaggcgattgtctccacattggatatccactcagcgagcacaaagtcacagaattcatgcacgacctgcttcttcttggaatgagcgagctacagcacatggcctgtcttaaggtctatgaccacggtggcatatctgtgcctgttgtgcagcttgaacgtatctgcgcccagataccttgcctgccgcttcggcttccggagcgtcttcttctcgcggttccgtcaatagtctttcgcgctttctccagccggggtcccatcccggtagtcgaagctagccttcctgtctcttgagcacctctctgtcgtcccatctgtccagcaggtcggtgtcgaggtagcgcctggagccccagccgccctcggccacgtacttgcacctcgccgccgccagcttccccgcagcgtctccggtcgggaagctgcccacggcggcggtgcgcctctcgaccaccctcgccgccgcctcgagtttcgacgccctgagctctaaggctacctcctttgcctttaccaggtacttcgcgcagctcttttgcgcgtgggatcgctctgagcaaggccgcaacggccttgtagcgggtcctgggcagcttgtcgagcacgttgcgcgtgggtggcagcgctgctacatcgcgcgcaggaacacctcccgtattgccccaatatacctgcggacttgtcggcgctgaacatgcacactcccgacagggcgcgctcgtgcaacctaagcaggaaggccctccagctctcctttgactccatatagccttccttacagccgatgacttcgcactatcccttttggttgacgcctatggccacaccctcgcaggagcctgcccagtttctcttcacgtatgtgccgtccagggaaacgatgattaattcggctcgatgaggtcgctggggctgcacgctgtatgccgccggctcaaaatgtctcgaaccacgcagtgcccatacccacatagatgcctatctgtcttctggatatggtatagcttaagtcatacattccagcatatccaaaagatagatatggacagacagatgagcttttaagaccggcggattagcattctgagtgcaacaggatagcccgctgaatgcaggagtggcacactccggaaggctacgatgttggttgtctcatcaacgtcgaaagctggaaggaatgtgccactacacacatcttagccctcaggagagggactgcatagccgtactgtgtggcacaagggaagctccatcggctatatcgcaagagagatcggcagggacagctccagcgtctgccacaagctcaagaggaacgcacggcacggacgctttagggcacgtgctgcccaaaaggagggcggatgagcgccgcaggagatgcagggcgaaaaggcggctttcagaccctgcgcttacgcagaaggtgcgctctctcatcatggacagacactggtccctggaggagatagactatatctcaggctcgagggtggcggcaggtgcgtcgttgagcctctcgactattcttaccggcaggtccgtagccacgctcgagctgccggaaaccggcccggaaggccaggtgtggcgccacctgcgtaggaagggaaagcaggtccgcaggaagaggctcaagacgaggggcaagatcgagatcttacacagcgtaaaggagaggcccaagaggccgatgcgaggtctcgtctcgaagacttggcagacgacacggtcgtcggagcgggacccgtgtgcctgctcgtacttgccgacagggcagtgaggctgcttgccgcgagaagatgccaccacgacagcgggagcgtctctaaggccgaggtcgggctgctacagggacgccctctcgagacactcactcctaagtggggcaagcagctcgcagggcatgcagatgtcacaaaggccctttgaggcgtgcagttctacttctgcgacccccaccatctatggcagaagctaacagttaagaacaccaacgggctcctgcgaaagttcttcccctaagggcagcgactttggtaaggtcacaaacgaggaggtccggcatgcggtagagctgatctgtgacaggccgaggaaggtcctgaaatacaggacagccaacgaggtctttagggagatgttgcactcagcttgacaatctgccgtccgaaatattgacacaggtcatttgcttggacaggccgcgcttgcgggcctgcccgtagccatccacggtcgcaaacacgcgctggcgccactcgtaggcaatcttgtggttcagcccacaaatctttgcgatgccccttaaaggcacgttgtagcacatcagctcgatgaaggagactaaaggtgggcaggtccttcttcgagtcgccgaatatggcccttaagaaggcggcgtagcgcttcgtgcagcttaggcatctgaagcgctggtgcccggcggtactcttcccgtcatccagggcttttcgccgcatgaggtgcacaacggcgcgggcctgtggcgtgttgcagcctcctcgaaggtctcaagcccgatcttctcctttgcatcctcgcaccgcccaggcgcccatccagtcgggatgtcgccaaacttagggccagatggacgctcgggcaaatctaagttggcgggacaatcataccaattcacgccggcccctatactcctatcaccacacttctaaactgtcagaaaatattattgcttatgtgtccgctatcgtatgtattgtcaactgtcccaggtacgtttacctaacaggtagcgcgctctaagcctcgggtggggataatgaacaagtggtattggttcttttcgaaggaggcttgttcatgctcgaagcgtacaaggaagaagttttgagaatagcgcagcgagcacagcgagacggtctctgcaagcatcgctctggcaacttctcatatagagataccgaatccggtttgatcgcgatcacgccctcaggggctgaccgggagaagctgcaggcgaaagacatcctgattatcgatggtgagggacacatacaggagaatctctcaaatctgcgccccacgagtgagaccctgatgcacttggcgatctacaagacgagaccttcaactcatgcaattgtgcacacacactcgctgtatgccacctcatttgcaattttgggcaagcagattccggctgtggtctacgaggccctcaatctagggttaagcaggggccgcattccggttgctccctatgcgcgcccgggctccgagaagttggcgcagagcatcgtcggaccttgcaaggaagcccagtgctttttgcttgaacgacacggtgtggtggcctgcgatgacagctcactggatgaggcgtacctcaaggcgagctatgtggaagaggttgcacatctctattacaacacccttgttatcaaccacaaccaggagccaccggcgctctcacagcaggagctcgatgcctggaagtaccccgatcaggttgagcactgataaccatctgaggattgatgaatgacaagcgaaaggaaggctatgtctcgtttcgaccactattttgagatggatgagcaggatgtggttgactacatcctggagaaggatatcggtatcgactgggataaggatacgattaaagcagtcatgccggctgagcacggcaatatcaactacgtgtttagagtatccgatgcaaagggccactcggtctatgtgaagcaggccggcgagcagacccgtatctccaaggatatgaagccctcaaaggaccgtaacaagttggagtctgagatcttggggattgaggacaagcttgcccctggtatggtcccgcacgtttatttctatgacactacgatgtgcgcctgtgcgatggaggactgctcggactacgaggtcatgcgtgacgctatgctcgaacacaagacctttccgcactttgctgacgatatctcgaccttcatggtcgacaccctgttgctttccagcgatgtggtgatggaccatatcgagaagaagaagctcgtgaggaagttcatcaacccggatttggaagacattactgaaaagctcgtgctgatggagccctataacgatctcaaccaccgcaacaacgtctatccgcctaaccgtgagttcgtggagaagcagctctatcaggacaaggcgttgcacctggaagtggccaagctgaagtttaagttcatgaccgatgcacaggctttgatccaaggtgacctgcacaccggctcaattttcgttaagccggactccactaaagtctttgactctgagttcggcacctatgccccaatgggctacgataccggcaacatcgtggcgaacctgatctttgcctatgataatggattggcagccgacgacacgaagttctgcgactggacgctcacgaccatccgcaacattgtcgacatgtttattgaaaagttcaataaagcctttgatgagcacgtgaccgagccgatggcaacagtaccgggcttcaaagagtggtacctgagctctatcctcgatgacaccgcaggctttgccggcaccgagctgcaccgccgtaccgtgggcatggccaacgttgtcgacgtgacctccatcaaggacgagaagaagcgcctattagccgagcgcatcaacatcctgtgcggcaaagagctcatcatgcatcagagcttcttccacgaaggtcaggattacctcgatgcaatcgcacgcgccaaggaaactgctgaagcgacgcttaagtagggaagaaggatagatcagctatgggcgataccagcaacgtagaagcgttctttgacaaggtcatcactgtcaagatgctgccggaccacaccgccgtcaacattatcgaccagaccctgttgccggagacgatcaagcgcatcaacctcacgaccaaagaggagatgtgggacgcgatcaagaagctgcgcgtcagaggggcgccggcgatcggcgtaactgcagcgtactgcattgcgcttctcgcctcggagattgaggcttctgacttcgacagcttctataaggagttcaaggcggacaaagactacctggcttcctcccgtccgaccgcagtcaatctgttctgggccctcaaccggatggaccaaaaagcgctctttgagaaggataagccgctcgatcagatcaaagaggacctctttgttgaggcggataaaatccgtgaagaggatgttcagatctcccgcaacatcggtgagatcggctacaggatcctgaaggacctgaagaaggacggccagcctgtcggtatcatgacacactgcaatgcgggtaccttggccacagccaagtacggcactgcgactgctccgatgtatatcgcgttggaacacggctgggccggcaccgatatgcacgtgtactgcgatgagacgcgacccttgctgcaaggtgcacgcctgacctcctttgagctgcacaacgcgggcatcaccacgacgttgcagtgcgataacatggcgtcaatcttgatgaagtcagggaagatccaggtggtctttgtcggctgtgaccgcgtagcgaaaaacggggacgccgccaacaagatcggtacctccggtgtcgcaatcttggcgcactactatggtatcccgttttatgtctgtgccccgagctctacgattgatatggccaccccgaccggagaccagatccccatcgagatgcgggacaaggacgaagtgactgagatgtggtacaaggagcgcatggcgccggaaggcatcgatgtcttcaacccggctttcgatgtcaccgaccactccctgattaccggcatcatcaccgaaaaaggtatgtgccacgcgccgtatgacaaggcctttgagaagctggggattgtggcgaagtagtggcgcactctctgagatttccgttctcttgcgaaccctattgatactggaccaagccatttttgatgctgatggcttgactcaccttctcactgtgttcacacttatctacagtgagaaggtggggcagatgggtttcgtcgatgagattcgacagtgcctgtgggcgataatgcatcctgtggattacagaggtgaagagatgtccgcttgtcctacgttcatcagtcggctgaagctatccggattgacgggtagacgcgcagtcggcggttgctgtatgtgcataggcaatgcgtgagacgttgtggcagccatcgctgttctatcggtactgtggttgcaatcccccgtacatcccacagatccctgggaccgctccatgcttaagcctatgcgtttggcagtgctcagttaggaaggaaatcgcagatgaatgtgacattcattacatcggcgccattcttcaggcgtttgccggcttatcgttggggtgctgacgtctatggtcaccccgataccatcacggggccgctgatcttaggcggcatcgtgaaaaaggccgggcacgacgttgaggcctatgaggagctcaacggttcctttgactatgaccgtctgatcagacgcactgacgtgctgtgcctgtatacgatgacgagcaatgcgccgcgcgcctatgagattgcggatcgtttcaagcgcgagggccatgcccgtatcattataggtggcctccatgcctctgcgctcccagaggaagctctgcagcacgccgatcaggttatgatcggcgagggtgagaactcgattctcgactgcgttgagggccgcaacactgacaagattgtccatgccaagccggtctgcaacctcgatgaggtccccttcccggattactcaatcctcaagaccccctgcgaggcagcagatgtcctgacgtcccgtggctgccccttcagatgcagcttctgcaccacgacccgtatgttccatccctatcgtcaacgcagcatcgacagcgtcatcgccgaaatccgtcactacaaggagatgggtttcgagtacatgaacttccaggacgacaacttcactgccaacaaggagcgtgcgaaggagatctgcaagcggatggtcgacgaaggtctggtcttcaaacagaccttcttcttcggccgtaccgatatcgcaaactatccggatctgcttgacgccctggcggcagcacactgcacgcgtattctgatcggcatcgagtccctcaaccaggatgccttaaacgatatcaacaagcaccagacgatcgatgatatcgagcgtgcgggcaaagcctgccgcgaccacggtatcgagctcatcgcctccatcgtgttgggcatcgatgaggacggtattgacgacctgaagcggtccactgacttcgctaagagcatcgacgcctaccagctgcagccggcggtgcttaccccgttcccgggaacaccggtctacgataggttcaagaaagagggccgtatgatcctggatggctcagagcaccaggtgagcgattgggaagccttcgatatgatgaatgccaccttccagccgaagaagatgagcccctgggggctgcagtctgcgttctgcacaatggcacgacggttctacacccgccggtctgcaatccacatcggcgtgctctatggctccgaatacggttggagaagatggggcctggcactgatggcgcagtggggcaccatagctacccagcttgctggcgtaatcggcaaaggctcgacctactggagagtcaagcacgcaccttggatgtttgagaacgatccggagaatgttgccgcacgggctaagcggcctacactgctcggtaagatgaaggatatggcgattgaggttagcaaagatctgcagcctgagaccatgcgtgagaacatccagaggacctcaaagcgagtggagcacgatctgtgggtggcccgcaggagaagagagacacagcgtaaagaggcacagcgcccggatccgtatgccaatgtgccgaagcgatcgatgccttctgagagctcactgatcccgctgaagattttgggagtcaccgaggtggcgcttccgattctactggtcggacacctgatccgtaagcatgctgagtagggtataccggcaacaggcattgatcggtccatagtgggacgacaagaggccagagaatccggtaaggattccctggcctctgcgcttatatattcgtgaacttacgtgcttcaatgcagagagggcggcgccggtacaactggtgccgccctcgtaggagaaaggggtcctacggattcaaagcgcttctcagagctgcgccttgatgtgctgctcgagctgcgcctttggcatgccaccgaccatctgatcgacgactttgccattcttgataatgaagaagctcgggatgctcatgactttgaactgagccgcaagctcctgctgctcatcggagttgactttgccgaccttgagtttgccatcgtagtcattagcgatctcttcgacgatcggcatcattgcacggcagggaccgcaccaatcagcgtagaaatctacaaggacgggctctttgctgtcgagtacctcagacttaaagttgtcttttgtgaattgatactccatgatcaattctcccttcgttcttatcttcaactaacttgctgatacccgttcctctttcttaatatccctcgtgcaaaactcggacgttcatgcatgcagtttccatattttgaacaaagggactcagaacaactggggaaatacagcgatgctgtcccggattgtgattcagagcagcacccgaatgtctctttgggctttaagttgctaagcattccaaccctgggtgagtagcaactcgcggaatactgcatgtacccgctcgatatcctttaacggcacgaactcattcggcctgtgagcgatctccaggctgcctggcccgtaggaggcgcagttgatgttgccggtctttcctgccgcaactgtggagtcgttataaccggtaaagatcgtgaggtctgccggtttgccagttaccttcttagtggcctctttgactgccgcacgcaggggagtgtcagtgtgtgaggggattgccgaccgatcgctggtcacagtgtagtttcccttcacgccgagggcctgcttctctgcagttgtacagttgtgatgccctgctctacgatcttttctgcatcgacgggcgttgtgggcggcactaagtgcacatcgacccaggtggtgcactcatcaggtatgacatagggctgatttgccacctttaatctccccgaagatgatcgttgccgagcctaattccgcgtcctttggtaatgccatgacctggtttctgatacttgtgatagcctctgcggctccggcgattgcattggtgtctttccaaggggtgctggcgtaagcggtgatgtctttgatagctagcttgaaccaggtacggcctttgtgtgccattctgacataggtattggggtcacgtcatgctcaaagacgaaattctgacttaattaaatagtaagactcggagatgccagatgcttcgccgtccgatgggatgtgcgagtctggtgggggacgtgccccccggcgccctgacccgtgacaaaaccgacccgatcggtgtcgcttctatgacctgtcggacgcctggggcgtggagccgtcaggcgtccccctactgttctgcccgagaggcaaatggcggaggcgacagcacaatcgcaggcagtcgaaggtcgcccatgcaacaagggcaggtggaaagggtcatctacgtcgccgtcgacgccggcgaggtggcccactttggtgtggagtgcacggggacttatggtaccggagctgctcaggtacctctcgcatgagcgcgtagaggtcgtcgagctgagtgccccgaccgctttatcaggcgcagcaggggcaaggacgacgccacgacgccgcgatggcgcgcaaggccgcgatcgagcagatccgctccctgatcgtctcggcctccgactccgcgctcgccgctcgctaccaggacctcgacgtggccatcggggccatcctcgaggaggtggcaccgctcctgctcgaggagaagtgtgtcagctcgcagggcactgtccagctgatgatcagagtgggggacaatccggagaggctcaagcagcgagtcgtcgttctgctgtgcggggtggcagcgtgtcctgtgtcgtcggggctcacgacactccacaggctcaacaggggcgctgacagggcagcggcgaacaacgcgatacacatcgttgcgccaggaaggctgaggatagacgagaggatccacacagacatcgcccgcaagatgtctaaggagcactccaagctcgaggcgatacgatgtgtcaagcgatacatagcgcgcgagctgtactatgacatcattgcccagaaccgcatgctcaaaacgacttgacaattagaagggcatcacacgttcattacatcttgagcacgctatgaagctgcgttgcgatgttctcgactgccggaccatagatgacatggatatgggtatcagacatcttcttgacgcccatggaacccgacttcttgagcatgtcttcgtcaatcagggacatgtccttcacatcgacgcgaagacgcgtgatgcagttgttgatgttgacgatattgtctacgccgccaaggccttcgatgatgtaggtcagctgcggcgtcatggttccctcagcaatctccgccttctcggtgacctcagcagagtcatccggtgcatcgatcacgatgtgatgagacgtgaggtacgtgtagaacacgaagtagtagatgaagaagtaggcaatgcccagagggataaccatgtaccagcgggaacccggctgcaggacaccccagatgacaaagtcaatgatgccgccgcccgtaccgccgatagagacgcccagcatatgcgtgagcatgaaggaaaggccagccatcacagagtggaaggcatagagcacaggtgccacgaagaggaacgagaactcaagcggctcggtgataccggagacgaatgccgtcacggcaccggcgacaacgagagcctttacgccgtcgcgcttgttctcgggcgtagaacgatagatggcaagagctgcagcagggagaccgaagagcatgaatgcaaacttgccttctgcaagatagcgggtgtaatcagacagcgcagcagtgcccatggtgtcgacatactggtagaagatgttgaggcagccctcggtaccattgagcacaccgccgatggaagtcgtacggaagagctggttgatgatgtggtgcaggccggtcgggatgagaccacgctcagccaggccaaagaggaagacgccgaagttgccgaggctcgcgatagccgtaccgagagccatgatggcaatcgagagcggcagccagatgaacggcgagagaatgccgagaataagcattgcaacaaacacgacgattgcgacagagcgcttgccaccgtagaaggagatggcaacagggagcttcgtatcaatgaagcggtcatgcagagcagctgtcaggcagccaacgagaatgccgccgaaggctgacatattcggtgcgccttcgactccgaggaccgtagctgtatcaagagagctgaagtcgaagagaccgctcttgaccattgcagcgccagcagcaatgaacgtgtagtagcccacaaagccagcgaaggcagcaatctccttgtccttcctggcgagaccaagagcaaggcagatggcaaacagcacaggaatctgtgcatagactgcgtttgcaaccgacttgatggtggcaaagacaaatccgaccggtgctgtcggcgcaaacgccggcacagcagcgatgactgcatccttcgtgagagcactcatgatgcccagaagcaggcctacagccgagagcgctgctatcggcagcatcagactctggcccagcttcgaaaggtagttcatcacactacccttctgtttcttctctcccatgcttcccccttggtcaaaaatccctgtcatagagatggaacccgccattttgctgtatgcgggcaatacggcctgtgccagatgcatgtcccccagacctggcgcagaccgtttcaagcacttcttgtagcgttcgatgctacttgagctctggccagtagtccttgttctcttcaatcaggatgtcgagaatctcgtgggccttcttcgtatcgttcacgagcctgttcagcgtcattgcctcaagcgccttctggtagctgtgctcgaagtacgcatcgacaagcagcttctcgcaggagacctgctggacaaggagtccgagataaaactgcgggatattgccgacgcccatcgggcgcggaccattggctgtaagctccgcgacgacttcgaccattgcatcgtcctgcatgttgttgatgaggccattgttttcggtgatgatgatgtagcggcggccggagttgtgagcaatggcagaagccacctcgatcatcatctcagcatgcgcgtcagagtggatgtcgacgatgcccttggtcgtgccggcatcgatgcagcggtggcactcgccgaacgcacgcttctcgcggccttcgatgacctcatcagcgcgggtcttgttaccggctgccatgcgctcctcgttcagatgctggaacttgtagagcggatagaggtagtactggtcgtacgtgttcggcaggaactcagggtaatcctccatcatcatctggacgttgccatacgtctcgagccaggaaggatcgcgctgctctgcatcctgcggcaggaatcccttctcatgcacaagcttgcgaatcttgggcatgagatcctcgcccgtcggcttgtagtacatgtgggtgaaccagccgtagtggttgaggccgaagtagactggctcgagatcgttccagtcgacatcaagaaggcggctcgtggaacgcacaacattctcaggctgatcgcaaatattgaggatgcgcttgtcttccgggaactcgcgacgcagagcctctgccacgatggcagcggggttggaataattgaggcaccaagcattcggcgagtactggcggatggcatggatagcatgaatcatgtcgccaatagagcgcatgccgtaggccatgccgccagcgccaaccgtctcctggccgatgatgccatgatcgaagcaggtatgctcatccgaccggcggccctcaagcccgcccgagcgcatctgcatgaagatgaagtccatgtcggtataggcagtcttctcgtcagtggtgtagctgatttctgcgttgggatacatctcacggaagaggatctccccgaactttccgaccggctcctgacgcgggccattgatatcgaagaggacgagctttgcgagcgggaaatctttctggagcctcacgaagctcttgaggaagcccggcatataggtgctgccaccgccgacgatgcacacgttgtaacgcttctctgccattgcaattcacctctcggatctggttgagcaggtacgtcattgtcctgccaatcctcatatcagcgcaggtacgatgggctttttctcttctcttccctgcgcgcaacatgaagataccgcctgcggaatcccgcaagtgacccggaggctgttacagaaactcatgtcataatctgttacatgtttcaaaatcagaaacatttccaaactgtcttgtatcccagaggagagcacaaagcatgccggaaacagcatccaggttcacttcagcagagctttctgtccttcgctatatccagtccatgccagacggtacctgacctgagtgcaagagagctggcagccaggctggatgctcggccgcaaaa

SEQ ID NO: 382 - DNA, 5456 bp, Unknown
  Metagenome-assembled genome
gaccacgaacagccttatcaactaagtttaatcccttttttgtaataccaacaagatgtaagccccattcgcatttgcgaatggggcaggggattcttatatgtaacatcacggaatcgtgtaattacgccaactactcgtagatgcgcaaatacacaaaagggggaggggtcactatggtgagagcaagcggcgtactcatgcccgtctcgtcgcttccgggctttgtggggattggcacgttcggacgtgaggcttacgaattcattgattttcttgctcgtacccatcagcgctattggcaagtcctgccactgaccacaacgagctttggtgattctccctatcaatcgttctccgccttcgcgggtaacccatacttcatcgatcttgaggatctactggattcggggtatctgacgaagaaggatctcgaagccttaccgatcggccacatgggtatggatacagtcgactacggtgagctgtttcagaagcaccgcgccatcctcgagcgtgcgctgccgcgctttatcgccgatccacctgaggactatgaggagttctgcaagcagaacgcttcctggcttgaaccctactgcgagttcatgaccatcaaagagcaatttgaactccacgcgtactatgagtggcccgaagagtaccgcaagcgcggcaaaaagagcgcaaagctctgcgccaagcatgaagacgacatgcagtatcaccgcatgactcagtacttcttctatcgggactggaagcgcctcaaaaagtacgccaacgaccacggtatcctcattatcggtgacatccccatctatgtatcccgtgactccgtcgaaatgtggtcagctcctgagatgttctgcaccgataaggacgggacgccgacctgcgttgcaggcaccccgcccgatgtcttctctgacaccggccaatactggggcaaccccatctatgactggaagcagatgaagaaggatggcttcagctggtggattgagcgcctgcaagcaagcctgtcactgtatgacatcctgcgcatcgaccacttccgcggatttgccgcctattgggcggttccgtttggctcacctgattcgagctacggtaaatgggtcaaaggccctggagaggcgatctttgacgccgcaaaagagaagctcggtgatctgccaatcattgcagaggacctgggctttatgacgccggatgttatcgcgctgcgtgagcacactgggttcccgggtatgaagatcctgcagttcgggtttgactctctggattctgacagcgattccttcgatctgccgcatcactactccgagaacaccgttgcctatgcagggacgcacgacaacgagacagtggtgggttggttcaaggattccgccacaccgaaggtccgcaaggcggctgcacactacctgcacatgagcgaggacgagaatatcgcgcaggcgatcgaccgtgcggtcgcagcctccgtcagtgatacctgcatttaccgcatgcaggacctgctcggactggacaactccgcccgcatcaatgtgccctcaaccgtcggtgccaactggcgttggcgcatgctcccgggtgcaattacaccggctatcgagcaggagctcaccgatctgacttacacctacttccggattcctgacgcgaagggccccgagcttcctcaataagattttggaagccgcgcatattggtccccatcttttagtcttcctgacacctacgactattggaggttcggtttcgcatgaagatcgatcttgaagcacgctctcaggagaagtttggccgtccgctcgccgaacttgacaatccgaccatctgtacgatgctcgaggatctcgttcgtgagcacgccgcggtgatgcctttaaatgatggcaagcgccgtctgtattacctctccgcagagtttttgattggccggctcctcaccaacaatctcttggagctcggtatctacgacgacgtgaagtcacaactcgctgcagcgggccacgacctgggcgccgtagaggaatgcgaagtcgaaccttcgcttggcaatggtggcctcggtcgccttgcagcctgcttcctcgactctatcgctacgctcggtcttccgggtgacggtatcggcctcaattggcactacggcctgttccaccagaaattcatcgacctgcagcaggcggcagagccggatacctggctcgatcgtcaggattggctcgtgaaggacgagaaattctataccgtccagttcggtggcttttctgtgaagtcctgcctgtacgatatcgacgtcctgggctatcagcgcaccaccaagaatcgtctgcgcctcttcgatttggagagcgtcgacgattccctggttccgcccaactcaatcgattttgacaagaccgcgatcaagaagaacctcacactcttcctctatccggatgactccgatgatgccggcagactcctgcgcgtctatcaggagtacttcatggtctccaacgctgcgcagctcatcatcgatgaggcgcaagagcgcggcagcaacctgcacgatctacctgactacgcagttgtccacatcaacgatacgcacccctcgatggttatcccggagctcatccgcctgctcgtcgacgagcacagctttgacttcgatgaggctgtctccatcgttaagaatatggtcgcctacacgaaccacacgattctggccgaagccctggagaaatggccgctcaagagcctgcagacggtctccccgcgcatcgctgagatcatcgaaaagctcgacgagctcgagaagaaggaatacggtgacaacccggatgtcgcaatcatccgcgacggcgctgtccacatggcacacatggcgatccactatggcttctcgatcaacggcgttgccgcactacacaccaagatcctcgaggacaccgagctgcatccgttctatgagatgtatccggagaagttctccaacaagactaacggcatcaccttccgccgctggattatggattgcaaccctgcgctctcaagcgtgctcgacgacgtgatcggcaccgactggcgcaccacctgcgacctcaccgggcttatggcctataaggacgatgactccgtcctgcagcgtctggacgatgcaaaggacaaggccaagatcagcatgcgtgacttcatctggaagaaccagggtgtccacatccctgaggacgcgatcatcgacgtccaggtgaagcgtattcacgagtacaagcgtcagcagatgctcgcgctctacatcatctggaagtaccttgacatcaagaacggcaacattccgccccatccgatcacgatcatcttcggtggcaaggcagctcctgcctacacgatcgctcaggacatcatccacctgatcctcatgctctcccgctggatcgcggcggacccggtcgtgtccccgcacctgcaggtcatcatgatcgagaactacaacgtgagcgccgcagagcgtgtgatcccggctgcggatatttccgagcagatctccctggcctccaaagaggcttccggcacctcaaacatgaaattcatgctcaacggcgccgtaacgctgtgcacccttgacggtgctaacgtcgagatcgcggaccttgtcggtgatggcaacatttacaccttcggtacctcctccaaggaggtcgagcacctatacgctgagaatgcctaccacgcgcatgactactacgagaagccgggcatcaagctgctcgttgactttatcaccaacccgtccttcatggctctcggcaatgcgggacgcctgcagcgcctgcacgacgatatggcgaacaaggactggttcatggcgctgctcgatatcgaagagtacatccagaagaaggagctggtcttgagagatttcgaagaccgtgagtcctggctcaagaaatccctggtcaacatcgcacaggccggtgccttctcctctgatcgcaccatccgccagtacaacaaggatatctggcatctctaaaacacactgtctctaattgaagcccactgtacgacgtacgggccccggagcacgaacactccagggcccgtatggtttatgctgtaatccacgccatacatcaggttatagaggcgttgtagaacttagccctgcgttctacgcacgattttcgagagcgtatcgatggcggctctgcgcattgcggtccaggtcgacggcttcgccaccgaccaatcgatcgggtggtccgcgatcatctggcgggcttgctcgataacctctttgccggtgcctgcctggaaagcgtcatcgcccagcacgggcaggttgatgtagatatccgcgatctgggcatagatacggtccagctggttggcgccgatattgatcgtctgctgtgcgattgtaagcggctgcatgtccttgatggagcggctcttgcggatcataccgactccgaccaccgcatcgacctgagagcggtcaaagagcggtgtagggaggttcatgcggcagccaccgtctataaaggtgtggcctacataggtggtgggggagatcacgagtggataggacgcggagcacatcacgcacttggcggcatcgagctgatcattgcagatcacgtgccaggagctttcctcttcgctcttgaacagctctgcgtcattagtaaagatgaagaggtctccgccgacgacgtccaccgcgcagattgcgatcgggagcttaaagtccgcaaaggtatggattcccacctcatccagaatatgcatggcgagtggctccaacgtgtctgagtcgatcatgccgtgggtaccgatgatagaggcaacgttgcgaaggccgaccttcaagacctgctgatcgaccaccatcttgtcgagttcgatcagaagctctgccacacgctctgagggaaggccggcagctacaagcgccgcgaccaaagcccccatcgaggtgcctgcgacggccccgatcggaatcttgtgcttttccatatcttcctgtgcggcaacctccgcaaacgcacgaaatccaccgccacaaaaggcgacaccgacgccgtcaattctgcccatagacactccttattaaaaggttcaaacactctcgctagtacggtactctatgccacccatcttcgctatcagttatcgtgaggagtttccatattattttgatcgagtatgcctgagaggatagtaacagacaagcataggcagttccgctgtctgtacagcggacctacatgtatcacctataagctgacggtcaaattgtggaaggcaaacatacatgaatgtcgaaaatgtataggtaataggcgcgggaacgatgggacatgcaaccgccctgtagtttgctctgtgtggctatgaggtgcaccttctgggaaggacccaagctgggcctagaccttggtgtgaaagcg

SEQ ID NO: 383 - DNA, 14956 bp, Unknown
  Metagenome-assembled genome
cgcgtactggaggtgagcagggctcacttctaccgatggctcaaggccaaaggcggtggcgaggatccgtggggtcctatcaaggaagccatctgcgcgatatgggaggaaagcgacaggcgctttagctcctgcaaggtctgatccaagctcacaggagatccaaagttacgcaaaatttacaggcacgacccgctaccgcgtacgcaggtgcatggctaagcttgggcatctgcggcatctgatccaatgcctccaagaggacgacgctgcccgcacctgatacccccgagcgccccgacctcacccggcgcggcttttcgtgtcttgtgccgacagccaagcttgtgggcgatacagcctatcttaagaccacggcaggtttcatatatctcgccgtcgcacacgatctgtgcacacacatggtggtgggctgaagcatacaggacaacatgagggcaggccttgtcgtctttgccctgaagatggcatattcgcgcggatacgtggccaaaggggccatattctaagcagcccaggcagccagtacataagctcaaagttcgccgcctgctcagccgtacccgacgtgaggctctccgtggggagaaccggaagctgccacgacaatgcggtagccgaatcgcttttcgccacgctcaagaacgagtggtactaccataagcgcctcttcgatgtatccacgaccaagcacaaggcacacgagtttaatcgagtcgtactacaaccgcttccgcccgcataagtccataggagatcgcgtacccgcagaggtgatgcaggagttcttcgagcgcttcgagagaggccttgcatacgatccaaaggtgatgcagaccgcatagaatctgagatttctctgtccattatattgacagggctcaaggatctgaccagggcgaaggcagaggccgtgcatgcgctcgcgcaggagggctacaggctcgacgacctgctggcggcagcgggcctcgcgaggtcgacgtaccactatacgctctcccatcccgccagacccaccaggccaaagctctggaagcgcgtggcggagatattctcgcgctgccccaacggatgcggccacagggagatagccatgtgcctgcgcagcgaggacggagcgcgcatagccgacaagacggtgctcaagatcatgcacgagatggggatatcctgcggcatcaggcgcgagaccgactaccacagatacaactcgtacaagggggtcgtgggcagcaccttcgagaacctgctgggacgcgacttcgcggccgaagggccatgggagaagatggggacggacgtgacggaattcaggtgctcgttcggcaaggcatacctcgcgccgctctacgacttctcgagcagggagatcgtcgcatggtccatatcggagcaccccgacatggcgcagcagatggacatgctctgcatgctcatagagaagctccccgcatggaagcatccgctgctccacagcgacatgggatggcagtaccagcatgaggcctattgctccaagctcgagggggcagggatcgtgcagagcatgtccaggaagggcaactgcctcgacaatgcctgcaccgagggcctcttcggccatatgaaggacgagttcttccgcgggaatgactgggacacgttcgaggcgttcaaggcagacctcgaggcatatataatcttctggaacacccgcaggcgccagaaggcgctcggcggcctgaccccggaggaattccggaaccaggccgtctaggttcagtctctattagggcgtccaggatttggggcgcagttcatttccagtcggtggcctttttgcgccggcacaccgtatctgcgcgtgtatggagtacagtagcatcaaccatatgcgcctgccttgcgatcggtaacccaaccacggtacgaaggccggctgataaaatcaggagtgatacatgaaatgcccgagatgcggcacggaggtgcccgatgactccgcgttttgttttgaatgcggttaccctgtgtccaaagacgccagaaggaagacgcaattgcatgttgagctgggtaagacgcagccggttgctgtcgattcgctcgacgacaaggtgcaccaggcagctgtctcacagggatcacggggtgaaacggtcaggatgtcctctccaggctctcagggtgatacacacaggataaatcccgcgaatccccccgatatgcaggatgcaccgacgagagtacagcaagataaagacaagcggcgcaaggagctcgagacctacatcaccactcctgcgacaaaggtgatgttcggtgaagaaactgaggtgggggacgtcgatgcaggctttgaccgcatcggggggagcagcgcttctggcagcgtaccacctgcagcggtagggtcctcggatacccaggcggatgatacgaacgttcaggaaaatgatgacgcgagtgctgaggagaacccgtacaacgctaaaaagaaaaaacggccttggctcattcctcttatcattgtcctcgctattgtagccggagtagggatcttcttctatgtgcggagcacccaacaggttacgatgcctgacctctcggggctttcagaggacgacgctacaaaagcagtccaggacgtcgggcttgtcgcagatgttgagcatacctatgtggacggtgacggcggctatgtcctctcacaggaggtgccggcgaaccaaaccgtgcggcggggctcacatgtccgctttacggtcggtcagggccgtgtcatgcctgacatcatcggtaagagcaaagatgacgcgatggctgccctcaataagatgggggtgggtggataccatctggcgtaccagaattcctcgaaagaaaacgatacggtgctggcggtcgaccccgatgtcggccaacccttctcctcaacagatacgatcacgctgactctggcacaggattttgtcgtgcccgatgttatcggtatggctgaagatgaagcggtcaaggagctcgaacagagcgggctcaaagccagcgtcagctatgtggacgctgacagcggcgcaggtaccgtccagtcctccgatcctcaggcggggaccaaagtggcggaggggcagacgatcaatctgtccgtcgtgaaaaaggacgacgataaggatgcggatacgggcttaaccgatgcccggcacgtctcagactacctctctgcccgtccgcagagcgtggccaccttcatgagccagcagggatataccttgaggaccggatccatcacggacagcgactatgcgcagtgtagctacaccaaggacgacgctgacacactctatttcacccctgaaccgcactcaaaaggcgcgaacagttccgacgtgcaggatgtcctgtcacgcggtgccgcgatcgcaggcgtcaggctggagctggtctcctcctacatggatggactttccggcgtcagtgaggcatcggtggagcggatcatgaaagactgcgcgcttaactctgagcaggcaagcatcacgaatgtgccggaagcggacgatagctcgtccgacacgaccgataccggcgagggcgaggatacgagcaaggatacagagacatccgccgcggcaagctcatctgagacaaaccaggcgagcgataccttgtccaaccaaccacggtttaggtgtacggtcggtacgagcggcaacaatgtctggacggtgttggtgtatcagcaagggtcctcaaccgcaggcgtcgtgacatgcgccccgagaagtgcgtacagccagcagcacggtgactataagcagattacaacctatgcagcgcagacctatctggcacagtaggagggtagcggtgaagcagaccgacaggcggcgcaaacgccgtacagctatgaaaaaccgtgacgccgaaaccgcacgtaaagagggtgtcgatgcatcctgtgcgcggccggaagacgaagacgacgacgggtatgacccctggtcggaccgcaaacccccacaggagccgctcttcgagcctgatccctgggattagtgatgctaagcgcccactcgtgaagctacgagcgaaatgatgcagatgatcgcgatcacaatgattgcgatcacgaccgcaaaggtgatcacagagcgggtgtggcgcgcacgctcctgagaagagaagatcgagcggcggccttttgggatctcaaggtactgaccgtagtgcagatccttacgcagccgtttcatgtgtgaacgggaccggcggtatggtgccccggaaagcggtccgcctccgccgaccgagatattggagtcgtgcgtatattcgcccggatacttggtattctgcccctccgtgatggtcggctgcgtcttgcgggggcgctttgggtgcacatagtgagtgccgccggactgctgggatggctgataggaagggctgtagccgcgttccgtcatgctcggcgcatagttctgggcacctgaaggtctgggattttcggtcaagtgttggggcttattcaccggtactctgggtacggcagtattttcataggagtagggactgtccctacgtggggattcctgagtatagtgagcattctgattgtacggggtttgagagtgatcctgcggagtctgaggtttgtttgagtcacagtgtgcattctcgtccacagatagcctccttgcggtgcgttcatggttttcttatccaccatcttatctcagtgcacgctctaaggtagaagcacacaaatagggcacgtgctctgtgtttagagaacacacagagtgaaaagcctcagagacctgagttgccgaagatcgctcagaatctcatataaaagcgcttagatattttgagtgagaatagcttaaaaaagttgtgtatcaatgtataaatctattcgctccgggcatatatatagacgaacaagaggaatgcctcagatgaggtgcccgagacgttacaaaggagtgacaacgatggctgaattagttccgtttgatcgttatgatcgtgctcttcatcgggcgtttgacccgttctttgactttatggatgactttcccacagtcatcaatgcagaccatgcagctttcaagatgaacgttgaggatgcagacgacaagtacgttgtgtctgctcagctcccgggcgtcaagaaaaatcagattgacgtggagctcaatgaaggtacattgacaatctccgttgataagaaagacagtgacgaagaaaagagcaagaactatttgcacagagagacctctgagtggagcgccacgcgtcaggtatatctgaaggatgcagcaacgcagggcatcactgcaaagcttgcagacggcgttttgaacatcaatgttcctaagtgcacgaacacgagcaatgcaacgcaggtagctattgactgatagatgtcttccattcgaaagcgtcttctcaggggcagggctttaagtcctgccccttttctatacctcactgttagaccataattgacctgacgcccctgtccttccaatagctccagaagggttgctctatgtctatgagcgcacgcctggtatggaacatacctgcctcctgcaagctgtcctgagagtatatccttcttctcccgctcagaatgccttacctgctctatccacaggaagcaggcaagacaagtgccccagccacttcgtagaagaccccatggaagaaaagcaggaactcgcgcagccttcgctgcatcgcattgacgaggctaagctcgccgtgcacggccttcttcgccacgctcgctgtgtgcttgaagaccccaagcgaggagagccacgtgcgcatatcctgcatggtcgtcggtggcgacccataagctgtcgacgatacctgaaagggcatctgtcagcttcccgtcctcgggcctgcccctgccacagaggattgcatattcgtcccttaggtcatacgctcagcactccacgcagaccttcttgttcgatatgccacagcaatgcacggcatggccgttgtgtgtgcgcctccctcagcatctggatggtcgaccttgccctgttgcctgcaagcgtgccctttgcatatgcggcccatgtggcggccgtaagcttggacatagccaggacagatcttgtctttacaaagaaggtcttgcctcacgagcaacacttccatctttggaggccacacgcgtcgtggcccttgcaatagaaactgagcgatttgcacctcgggcacctcttgggtgttcccgcaagggcagagcctgccatcttcttggctatgagcgccttcagtctctcccgaagctcgcgcttatcggcgatccccatcttttcgatctgctgcagtatcattggatccatccgggtcctttgatcctcgatgtttttgtttgacgacatgcattgtaggcaaagacccggacacttttgggcccttcttaggtcagtcctggtctaacagcgagatggaaaaacagactgcctgagttgaaagtttcaaaactatctgcccttctgtgagcctagcttgaagggggttcacactcgctcatgcgaaatgttagctctcatggcggtcggggagcgtgaagtttgcatctgcgatactggctagggcatcatcgtgagtcgcgacgatgactgtcatgccttggtcagccctctgccgcaggaggtctatgatcatctgtctgtttgccctgtcgagtgatgctgtcggctcgtcggcgtagagtacatcggcatgtttgaacatagcacgtgcaaagccgagccgttgcttctcgccaccggacagcacagaggctaactcctctgctcggccaccgagtccgacatgcttgagcgctgcatcaacctgatgggcgtatgtccgctgtttggccttgtttaatacgatattgaatgaaagcgtctcatcttcgaccgtgccaaaattctggtagatgaaggctgcatggtcgtgccagtattgcacccgcctcttatcaccccagagcttggtgctctctccgtcgatgaacacatcaccctgtgagggtaccaggagtaggccgagtgcattgagcagcgtgctcttcccacagccgctgggtcccgtgagggtggtgatgctccctggcccacaggtaagagatactccttggaatatggtgcgttttgccaactgtattccgagattcgtgcaggagactgtagacatttaacccttccttagtatatgtgccgtaaaggtcttgcgacaggcaatggtgtaggtaagcatggagaaaagtgcaaagcatgtctcaacgatgatggccccaagcatgacaaccaaaggagtactgtatggcgagacgaaaatacatatacctgcacctatcactaacggcattatggaaaaggcaaggtcacttctcatacggggtgcatagatacttcgatatccaattccagctgtgtgtgcaagaaacacctcttcctcatgtgcaatggcccacgaacttgcgcactgcagggcgcacgcacagatagacagtaacgatacagacgtgatagcaaggtatagaagggcattggccagaagatcttggccagtcgtgagggtgacatcggccacacgatcgaaggatgctatatatggatagactggcgaggcagcaaatgcctcctttgtgttttcggggtcagtgaacataatgttgcccgtggagatgaggggcatgacaaagccggtcatgctcatcttatcgacgggcacgttcataacgattaccagcgggtttttgcaggttgtaaaggcactgttgtagcttgcgttttgtcctaacgctatgagaccgtcaccgtgatactcgtagaaggagaatgtctccttaaaagtcatttctccttccatccatactgaaaggactccttgcagaaagtccttggtcgcgcttggcaaggaatcgaaggagacctctgtaagcacggactctcctgactccgttggtaacgtgatgcctatgaggtgcagatagcttggatcgacgatgacaaattgtgagtatccaccacgtacatcattactgatttcgatttcagaatcgatgacaagcgaagtaacgatgcagcccttttgggaaagatcatgcatgacgcgctgtgcctcctgcgcgccttcctcggtatccagatagtcaaagttgttcagggagacagcgatagtgtcaccaaagcacctggctatgctgctctgcgtatagctcttccaggctctttgcgcaaggcttatggcaggcgggatcgtttgcatagacaggataagcgcaaccgccgagatggtgcgacagagtgggagaatcttgcctactacgggtcgacggagccgcaaagactccatgcccgttcctactatgactgacaggaggtagatcagcacaagtagacatgcgaagctcaacaggcataggattgccgtggggggcaagacaagaaggacattggcaggccccagtaccacagtgacgagtattcctgacagtgctatcccgagggtccctcctatggccaacaacctggcaagtatgccaagcgtttcccgatggatttgggcactggttataccacctagcagttgtatggcccgtgtgtgcaaccgcaaaatgatccacgtcatcgcaagcgtcagtacgagtagttgcgtgctgagccacggtatgatcatacccccgctaacgacgatggaaagcacttcgtctcgtagaggcttctgcccataccaggttatcgtcaccccattttcgttggcccattggtcgagtgcctcatgcaggggttgatcggacttgagcatgtatgttcccgccagaggtgaatctcccatggtgcgggcagacaggagcttgccgcccatgccgggtgtcagccagctgatggagccgtcactcccgatgacgggcgatgaactcgacggctgaattgatgagaaatagatgagatcccttcgagatccatatgtccctgctgaggtggagggcttgacgaggcaccccccacgttcgtcgacagcttgtatgagaccatctatcagctgatcctttgggacagtcgattcgctgaccaacagttcgaagctgtcgtccgttccaagaggatagtcatattggatggcctgcatggtttgaaacaccacgaacgcagaaatcgccgttgcaaggaatgcggagaggacgaatagcttacgcatagatgctctcctgacacattaatgagggccagggtctttttcctggtcctcgtgctggtaagatgggtggagctgctagcagactcgatagtagtatcgagctgatgtcgtgggaccattgagcccatgtatctcggcaattgacctgattccagccgctgtgttagcacttctcattgtacggccgtttgcggtgacagtgctgccgtggcagcgtcccactgtgtagtacgaacggaacatggcatcccagaatccatactcccatatgccaccttcagaggggtattgtattggacatacctgcctggcactaccaagtttactacggtaccatgttcttgcacagttgtttgatctgtggatgacgttgcgacaaaggcagagatcggtgtcattaagagagcacccgtgaccgcagctaccgagatgctacgtagaagtctttctttttaatgacgatatgataaactccttctatcagaaagtaaccttagtttaaaattatagataaataatataatgtaaagagtgtaatttttaaacggtaacaagcccaatttgcatagctgtgctgcccgcataccctgctagctggtcttcttcgcatagaagtccctgcatctgagcacttttcggcagcgcatggcgcggtccagcacccatgccaccttctcgtccatgttatcgccgatgttgcgggagacccaccaaaggtcgagccatccctaaatgtctgcggccctaaatccgctgtgggacctcaggagactctttagcaggttgcattcctggttgaccatgtcctaagggttgtccctgtcagggagcgtgcagcacttcttcgcgtcgtatgccttactctcgaggcgctccacgaggacggcgtgcgacttctccttgtcgagcatgtgctcggatctccgctcaatatggcctccgaaggcatcccatgtcctcttccggctcgtcttgccgagcccttcgtccaggcaaagcgatgtctcgtggacgtccacggcaacaccgatgcagaccttgttccttgaaaggccccacatcgtactgccatcagcattgcgcagacgctcttctgggtcgagcggccactacgtctcatcgagccatatcctctcggggagagtggcgccgtcctggcagggcgcgattacgccgaagagcttcgccgtccagtacgcaggggtctcaaaggagcgctggtggccgtgggcgcatgccgcctcgctcttactgcttaaggatcttcggcaggaacatggcccattcagagacgggaagatgcctcgagtcgaagagcgtgccggtcgcagacgtgaatgtccttccgcagttgaggcagcgctatctctggataccgttgcggtcgtacccgtcgtgcttgaagcgcgccgatcctcaccataggcaggcctttggcgtatatgcatcgaagaggccggcctcgccgtcccgggacagggaaggatggcgctcggcatatgccgccctgcacgtcttttctgcgagcctcgaggcgctagccttggagctgtcggcgtatgtcatgtggtagcccccatcgtcgcggtaggccgtaccgccgggggggactaccacatcgtaagggcgcaacgccccgccgaaaagatcttgcgggtgtgtttcgccgtcaactatatcccaacaggcaccctgcaaagagcctgtcgagcacagctatgcaaattgggcttgaaagtgcaaacagacgcaccctctatagtgggcatcgtttgcacgaattatcctaggaaaaacgtgtgttatacacacattataccctatgaacaatgtgcaggaatgtatactgaatatggaaggttcagatagcgtctgagcaggaggggtttctatgcagaggaagatcgaagcgcagctcgtcgaatggaaagacagcccgcataggaagcctctgctccttcgtggtgcgcgccaaacggggaagacctggctcatcgaggatttcggcgaacgctacttcagggataccatcaagattgatttcatgcatgatgagcaggcgagaggtctcttcgaaggagatctggacccgaagcgcatcatacgtgagatcgagctgatatatggcaggggcatcaatcccgagacaacgcttctggcattcgacgagatacaggaagccccccgcgggcttacctctctcaaatatttctgcgagcaggcgcacgaataccatgttatagctgctgggtcgtatatgggtatagcgatgaggaggcagggggagtctttcccggttggaaaggtggaccagcttgtgcttcatcccatggattttgaggagtatgtacgggcgcgtgctggggctccgcttgcagacgcacttgccgaagcagacatggatatgcttgctaaagtgcagaaccgacttgtgccgctcctcaaggaataccttgtcgtcggaggtatgcctgaggcggttgagttcttcagcgaggagaaggacttcagagccgtacggtcagtacagaacggaatcctcgagggctataacgacgatttcgcgaagcatgcgcctggcaggatactcgaacgcatgtatcttgcatggaaatctctgccggggcagcttgcccatgaaaacaagcgcttcgtgtacggatcagtacgtcccggaggtcgtgcgcgcgattttgaggaagcgctgcaatggctcagcgattacggcgtggtcacaaaggtgccccgtgtagaagcgctgcgtttctcgcccctgtcctatgaagatctttcctctttcaagctgttttgcatcgatacaggactgctctgtgccctgtctggcctcaatccttcagtagtgctggagggccccagactgttcacggagttcaagggtggcctgacggagcagtatgttgcccagcagcttgtggcgcaaggtttcgatcctgtctattggtcttcatccaccggtacggccgaagtagatttcgctctgtcacagggggcgacaatagtgcccatagaggtgaaagcagcagagaacttgaggtcaaagagtctcaaagcggcttgccagaaattccagctcgagcgggcggtgcggacatccctttctccttacagagatgaggggtggctcgtgaatgtgccgctctgggaaatcgacgagatagccaggttcatctaagacatctcgttgctgttttgcatggccgaggagaactgaaggcatgtgttatggcattcggcttatgcgttcgtcttcttcggcatcgcttcgagccagacagagaactcttccatctgcgctgcaacggcaccttcagcatccccttcccggatgagatccgccatatggcggaagaaggggagggagcgctcaggatggtaataggcctgcgttgcccggaagaacgagatatagatgtccttgaacgtgttcgcgagtatcgagtacaccatgttacccgaagctatttccacctcatggtggaaatcgaaggtgagctcggggagcgtctcgtcgttggcttcctccatcttctgcacgactgcatcgatgcggtcgagctcatcctcggctgcatgttcgcaggcaccacgcacgatctggggctccagtgctttcctgaagctgatgatgggctccaggaggcttgtgtcgagtgccgtgctcgtgtagtcgagcatcgatacaagcgtctgaatgtttccgtcgcgggcaatatctgccacgtagacgccttggcggggctcgatgcgcacgaagccgcggtctgcgagattcgtgatacctgcattcacgaccgaaagagagaccttcgtctcgcgggcaagctcgcgctgggagggaagcctgtctccagccttgagctctcctgacagtatcatctgctgcaactcgtcgatgaagagctgctagcgtgtcggcgccttgatctccctgagtgccatggctatcccttctctggtgactgatattgattgtatcagaatcagataggcttgtgagctgggagaatgctgaaatatagctatcagtctgagatatctacgtgatacaatcacgtttgtgtgaaagtgagccctgtcaatataatggacagaggaatctcagatttttatgcggtctgcatcgcctttggatcgtatgcaaggcctctctcgaggcgctcgaagaactcctgcatcacctctgccggcacgcgatctcctatggacttatgcgggcggaagcggttgtagtacgactcgattaaactcgtgtgccttgtgcttggtcgtggatacatcgaagaggcgcttgtggtagtaccattcgttcttgagcgtggcgaaaagcgattcggcgaccgcgttgtcgtggcagcttccggttctccccacggagagcctcacgtcgggtacggctgagcaggcggcgaactttgagcttatgtactggctgcctgggctgcttagaatatggcccctttggccacgtatccgcgcgaatatgccatcttcagggcaaagacgacaaggcctgccctcatgttgtcctgtatgcttcagcccaccaccatgtgtgtgcacagatcgtgtgcgacggcgagatatatgaagcctgccgtggtcttaagataggttgtatcgcccacgagcttggctgtcggcacaagacacgaaaagccgcgccgggtgagggcggggcgctcgggggtatcaggtgcgggcagcgtcgtcctcttggaggcattggatcagatgccgcagatgcccaagcttagccatgcacctgcgtacgcggtagcgggtcgtgcctgtaaattttgcgtaactttggatctcctgtgagcttggatcagaccttgcaggagctaaagcgcctgtcgctttcctcccatatcgcgcagatggcttccttgataggaccccacggatcctcgccaccgcctttggccttgagccatcggtagaagtgagccctgctcacctccagtacgcgctccatcatcgagacgctgtaggttgccctcttctccagcatgagctaaaacctgtccttcaacagaggcttccggcgaagaaggctgccactttttaggaacttattttcgctttcgagctcgtgtatgcgcctgttcactgcgtcgagctgcttgtgctcgtcgatcctttcctgggtcacccttttggtctttgagtgcttgatgatccagtcgtttaaggtcttgtcgttgacctcaagcttcgcggcgcatcctctgatgctcttcttcgggttggccttacgtgccttcctgtagtagtcgatggcctcaaggcaatacttcttcagtgtagtgtttgggtgtttccggcttcgtgcgggactttgccttctctatctcgcttgcgctcaccgacatctcatctcttcaatctgttgactgtgctgggtgggtatctggacagagcatatctgttgccagtccctgaatcccactgtccaccaaaagattacagctcagggttgggacgttgggtcccttaggtgagcatcttgtagaagggcttttgcgcttccaggaaggcatgcgcagcaaggcttcctggatctaagacggaagctgggtgttcggtgatatggcagctcctgccgtgcttctggcggagatgaaggactgctgggacgagatgccagcgcccgtgattgctgatgacgggagctatgaggatggcggaccagaagcac

SEQ ID NO: 384 - DNA, 18688 bp, Unknown
  Metagenome-assembled genome
ccatagaccggaattggaatagaaaaatataataagcatcttaaagttaatacttgacagcataattattgcaaacacaaattctaagattgaagatcctagtgtaagtgtttgtgatgaaaaaacacgtcaattttgtcaatctcttctttcttgaattaataatcccaaatcattgtttgtataaaaagatagatccatatacatcagtttgtttatattgccttttgatattctttaataattcatttcaagagatatcatcttttatttgatgagtaagagcaaatagttttaggaaatatacaaagcaacaattgctaaattatcagaagtctgtcatcttatatttcaggaaggcgtcatcaataataatttgcaatattttggctggtgccattgcaagaaacgcagagaaaacatataaagaaatcgccaaaataaattttcccagtttatttcttatcagtgtatatattatttttctcaacggtctcatattcatccttcatgttccgagttttttatccataagatttaattgaaatgctgcggttgcagattcctttatcctatcattaaaaaattctggacacttttcccgtctttagcgtttagcaccacgagtcttcaggacccgggacatggcccggaaccgcaaaagccagccctgagctggcttttttcatgcctgtatgcttgatccggaaatcgctccctgatagaatatatacatggtgctatggtgctttacgttgacagggagtggcagatggcctacttcctcaagcagacgcgcaacaagaaggggctttatctccagatctacgagagccactgggaccccaagcgcggccataccgcgcacaggtccgtgaaggcgctgggctatgccgacgcgctgatggagaagggcatcgccgatcccgtctcccattacaagcgcgaggtggcccgcatgaatgccgagcgcaaggccggcatggagagggagagggtgcgggagatctccgatgtcccggcgacgaggcatctcggccacttcgcgctcaaggcggtggacacggccctcggcacggcggaggacatggcgctgctccagaccccctcgggcttgcgcttctcgctgcacgatctcctctcctcgctcgtctatgcgagggccgtcgccccctgctcgaagctcaggacattcgaggacgtgctgccccagatggagggcatcgatgcgcagttcacgctggaccagctctgagacgggctcgcctatctgggcgatgagtacgacaaggtcgtcgagatctacaatgcgcacgtggaggaggccttcggccacgacatgtccttggcctacttcgattgcacgaacttctacttcgagatcgaccgcaaggacgatttcaggaggaagggcccctccaaggagcacaggccggagccgacagtcgcgatgggccttctcctcgacgccaactgcatcccggtggcgatgagcctgtttcccggcaacgagagcgacaggccgcagctggggagatgcatcgcccagatgaaggagagaagctccatatccggcaggaccgtgagggtcgccgacaaggggctgaactgcgcagccaacatcgcggaggcggtgcttgcaggggacggctacatattctcgaagtcggtgaaggcgctttccgccaaggagcgcacgtgggcgctctcgggagatggctggacggacgtcgccgacgggaagggcgagacatcgtttcgctacaagatggcggacggcgacttcgagtacacggtagagggagaggacggaaggaagaggaaggtcgagctcctagagaggcgcgtcgtcacgtacagcccctcacttgccaggaagcagaaatacgagatagaccggcaggtggagaaggcaagggcgcttaaggcggcagccgcgaaaaggtccgagtacggcgacagcgcgaagtatgtcacgttctcccccgtcgacggcgagggcgagctcagggaggacgcgaaggtcgcggccatgctcaaccacgaggcgatcaggaaggccagggcccttgccggctacaacatgatcgtgacctcgaagaccacgatggaccccctggccatatacagcacctaccacaggctctggaggatcgaggagagcttcagggtgatgaagtccgagctcgatgcgaggcctgtctaccttcagaggcaaagcacgatatcgggccacttcctcgtgtgctacatcgccgtgctgctcatgaggctcctgcaggtgaaggtgctgggagatagcttctcctccaaggacattatggggctctgtcgcggcctcgatgtgtgccgcacctcggagaggaggtatgccaacatatccaggagaagccccatcatcgaggagctggcgtcaaggacagggctgccgctgcttcacttcaacctcaccgagggcgacgtgaaggcgatctcctcctgcacgctctccatgctccgcggcgaagggaaaggcccctctgccggcaggaagcgcggctgaggggcctcatagcaccatatcggggatcgaaaaaccaaagtccggcttttgtaatattttttgcatcacttcaattttatgtctgaaattatattttctatgttcgctagtgtccgcggaaatgcctagtttgtcccatgaaatgcaatgagagtaacatatggaacaagctgtaaatgagtatttgcgcgtgtaggcaccagtgattattgcggctgagcaccggctgcgtcgcgaatcggcaccgggggacggcgccgcgcagcaccgccccatggcccctggctcctacatcactgcctcgatccagaggatgctgccgtcctggcggcggcacgcatgttcatctctcccatgtcgacccacgccgtcttgtggacgatgcggtccatgatcgcctcagccgtgacatcggcgccgagccgggcatgccagtccttctggcgctactgcgtgcaaaaagatcgtcgacctctcgtcgtagcggagaccgaagatctcgagcaggaagcggcaaaagccgtcgtccggcctgctgagcagccattcgtcgagcacgagcacctggaaggtccctgagccctgtccattatattgacagggctcacctcaggattgactgtgaccgtggagaagatgaagacagcgctgttgctgaagccatctttgaccggattattcacaacaagtattcgatcgatgttcaaggcagagtattcatgcgcaaacgccatgccttctcagagtcataataaagcggtggtcaatgcctatcatagttaagtaagattatggttgttctgcttgggtcgacaagaaatgcttactcaggcagaactgccgctactgatctcttgtccgtgacaagtgatctaaatctccgctaaaggtgatctattcggtcgtgcaaagtgatcttctcaagcggaatatacagttcgtccggctcatgtgctacaacgcccagctcggcctcgctgctaaaggctggatagacgagatgtacatagaggagtcgaccctcaaggacaccgccggataccacgcgatgcgggagggctgtcgcgcaacctcatatgcgtctccgtggtgatcgacgcccacaagaactctgttggatcgtatgcgggcacggcaagccgaacaaaaagagggccacatagccgaggggaccacgatcatacctgacaagcagcgcgcccacagcttcctcgtcagggcgctggaggggaccagcgtcgcatacaaggccgacaccaaagatccggactatatcttgatggtcaacagcctgtgcgcctggataaggcgcttcgtggagggctacgtgggcatgaagcctccaggagtatctcaactgaaacgtctatctcttccgggtcaagcaggctgacgaaagatggctaaagactgcaagggtcttccgctatctgatgcttaccgaagcgcattaccgcagttcaaggaagcgcaagcatccgcactctggttgactattcaaatagcattcatcatactcgtctacttcttcaatacctaaacagccaactttctctaacaatatttctgtgtctgtaatatactcacaatccaccatgtcagttgctcctacaagtcctgtatctttgttttatctagttcttccttgtacatctgtctccggcttttcagatgattcttacggatgagtgctttcacgatctcctaaagcatcgtctttgcagcgcgcacatgcctgacaagagcctgtcaatggtagctggtatctaccagtgcaatccagctatcccatggcacgatcgcatccatccgctccaggaatgcctctcgccgggtcttcttcctcagaccttaggatttaaggtcttaaaagctcatctgtctgtccatatcttccttttggatatgcaggaatacgttgctgtaattataacatatccgcaggcagataggcatttatgtggatatgggcactgtgtggttcgagacattttgagccgatgtcatacagcgtgtggctccagctacctcatcgaggcgaattaatcatcgtttccctaggatatagactcggacctgccagagggccatgctgtttagtcgccgtttatatagcgctgcttatgcagcgctagccgaaaaggccatgggacacatactgcatcccatggcccctatctcagcgactctttcactaactttcctatttgttcagcgcacctttggtgatccaggcacatgcctcatagggcttcaacgctattgtatcatccccctggatctgcggtgcttccttgtaattgaagactaacggctccagctcacctacgttgagcttagaggcatcaaccgtgcatggcttctggtcgaatgaagtggtcactacaacgcgtatatcgccgatttgacgctcaaagagcagcaccttcggagcctcatctcctggctcatagcaggtaaccttaccggttgccaacacttcgagttcgtgacgtaaatggacgaggttacggtagtactcaaagattgagccaggtttatcgacctcagcttcggcattgatgctcgtgtagttcgcaggtgaagcaagccagggctttccggtagtgaagcctgcggcatgcccatctgaccactgcatcggcgtacgcccgttatcacgggagcgctctgagagaacgtgaagagcttcgtcctcagtttcacctttcttgagcaagatctgatagaagttaagtgactcgacgtcgttgtattggtcaatcttcgcgtagtgtgcgttcgtcattcccaactcgtcgccctcatagatatagggcgtgccttccaggaagaaggacgtagtagccaacatcttacccacgtgctcccaatcagagttgggctctccttcaccggcgcggccgccgaagcgggtgaccgcccgtggctggtcatggttgtcccagaagagggcattccaaccgccgccttcctgcataccccgctgccaggtgtagaggatctcgcgcaactttgcgatgtcagcctctttcaacgcccacttgtccccgttggcatagtccaccttcagatggtggaagctgaaggtctcagccagctcatggttgtcagggttagaatacttgatgcagttgtcgagcgtcgttgacgccatctcccccaccgtgagcataccgtcaataccggtggtggaaacgagctcctgcaggtactcgtggatgtgcgggccatcggcaaagagcggccgtcctgccccttcggtgtcgtccacgaacttcgcgggtttggaaacgaagttgatcacgtcgaaacggaagccggcgacgccgcgcttcttccagaacagcacgacattctcaacttctttgcggaccttggagttatcccagttcaagtccggctgtgatacatcgtgcaggtgcaggtaccacttgccgatgtgcggctcccactcccaggcactgccaccgaaggcagccttccagttggtgggcggctctcccggatcccccgggcctttggagttacagccgtctttcaggaagtagtactgctgatactccttgtcacccgcaatcgctttctggaaccagggatgatcacgggaagtgtggcataagaccatatcgagcatgatgccgatatggcgttttttggcttcagccaccagttcatcgaagtcatccatcgtcccataggtgggatcgaccgcggtgtagtcagagatatcgtagccgttgtccctcatgggtgaaggatagaacggggtgatccagaggtagtcgatcccgagcttagccaagtaatcaagcttggaggtaatacccggaaggtctccgataccgtccccattagagtcgcagaagctgcggatatagatctgatacacgacggcatgtttcttgtcgcgtggaacaaagtccgccattgctctcccctttcgtctcgttagtgtgccaaatacgttacgatctcagtctcaccggccagggcgtgggcgcccaagaagtatgcgatatctttggcgtcgtccggctcagtcaggatcactgcggtctgtgcggagtgccccgccgccttgatctttgcctggtcgaaggtgagcagcagatcgcctgccttcacgtgctgctcctgtttcacggggcaggtaaaaccgtcgccgttcatatcgacggtgtcaataccgacatggatgaggacttcgataccgttatcgagcgtgaggcctatagcgtggtaggtacccggcatgatagcggagacggttgcatcagccggagcaactacacgggaaacagccggagctggctcgatcatgacgccgtcgcccatagttttgctagcaaagacagggtcagccatatcggagatcgggtgcacggtgccctcaattggagcaatcagcgcgtggacaatccctgcctcgtcggtcgcggcttcaggaacagtctcagacgctacggtctcagttgccgcaggcacagtttcctcagcaggagcagcttctgcggtagtggcctcagcctcgagcgcgggcttcttgtcgtaaagatccctctcagtcaggcttttcttgcccgcagcaagcgtaagcaggaacggaatcacgacggcgacgagcatactcaatgcaaagatgccccagtactgaaagcggatggagaggatgcccggcaagccaccgacaccgatggagagcgcctggacgccgttgccggtacagatcatagccgcacaggcggagccaatcataccgcagagcagcgggaacttgtatttgacgttgacaccgaagagcgccggctcagtgacgccgaggtagcaggagatgcaagctgggatgttaacctgctgagcgcgctcattgtgcttctgtagaacactcataccgaggacagcggagccctgagcgatgttggagagcgcgatcatcggccacagggtggtgtagccaagggctgcgaccatctgggtatcgatcgcgttggtcatgtggtgcaagccggtcataacgagcggggcatagatgaagccaaagcctgctgcaaagagcagtctgaagtcggaagagaggccccagttgaccgcatctgcgactgcggtaccgatagcccagccgatcggtccaacgaaagcgtgggtaataataaccgcaggcaccagcgagcagaacggcacgacaatcatggatacgacttcaggcgtgaccttcttgaagaacttctcgagttcaaccaggacaaacgcgcccatcagcgctgcaataacctggccctggtagccgatcattctgacttgcgcaaagccaaagttccataccgggatctggtcggccggggtggtcgggaccaaaaagccgttgagcagctgacttgataccatggtcaagccgaggatgatgcccaagatctcggtggtacccatcttcttggtgacggaccagcagatgccaaccggcagcatatggaagaccgcctcaccaatcaaccacaggaagctataggtgccggcccagaactgtgagaggtctgcgagtgactgtgtcccgttagcgacatcgaagttaccggcagcatcgaagaagttgatatcgccgataatgttacggaagccgagaataaggccaccacagataagggcgggaatgattggcgcaaaaatctcacccaagacaccgagtgcacgctgtagccagttttggttggcgccggcggcttccttcgcctccgatttcgagacaccttcaatgcctgagatctcagtgaagtcatcgtagaatgaggcaacatcgttaccgatgatgatctggaattgccccgcctgagtaaaggtacctttcacagaaggcagatcctcaatcgcctcaacgttagcttcatccggatcagccaagacaaagcgcatgcgcgtcatacagtgcgatacagcagagatattctccttaccacctacaaggtcaaggagtttcttcgcgtccaccgcgtactttcccatagcgccctttccttcgttctgaatcagatgaacacagttttccatcggcaccagctctgtgtggtgtcgagatataaaaaacttgagtaaccggcttaaattatgatggatttatgaatacgttggtgaagggacgtcagattcagggacgaacggcatctccttcactaccagcggctaacacatccgtaactccaaagctggaatgatctttttagcggcgaatccacacttcgagtgcaacagggagatacgagccaactgtccaggccaggcacgacctatgatgatgctcgcagagacatgcaccgttctaaacgttcgactctgttagaccactgtagatatagggaagcgaaaagatgtcacagggtcaccctacaatcgggttcgaccaagaaaccgacctaaagaaggccccgcatgctcgacatgatacgacaaccagcaaagtagctgacccgcaaggagaaggtcgcacttatcgccgacctcaagcagatgatagccgagaagctggcagcgcagaccggcaagtccgccacatgcccgcagttcaccaggcgcgagtgctcgctcacagcagggacaggcgggctgctcgcgcagtcgaagctggcagtatcccagtggatggagcttacctagtgcctagctggcaggctcacactgcacaggtgtgcaaagagatgcggcgggtgagtgtacagcgcctggttcatgtgccagcgcgcatgtgaggcgatagcgttaaggcttaagttgttgcgcgccgtcggcaaacacttcgcaaagagtctagctgacaaccatggggcaggcccagtcgagacagtgctcccttaagcaccgcagcgcccacaacatctgtgtgtggggctctttaacctgcagatctgcgttgtctacggcgtagacgagctcggtgcgactgtgagaagcgacggcaagggccagtatgcaagcggcctggccaacctcggcgcagcgcacctcacaggtcaactccatacacttgcggcttaagcatttcatggatcgcatccgtaaggtctcgaccaagtatctctaacactacccagaagtagttctgctacaaggagcagctccgaagatcggacggcgataagcgcaagcagatctacaggcacgagtgagacggcgtctaccacactacccagagagactacgtagtcatgccgattgcgttccctcagtactgggagcaggcgatatgacctcatatccacagtggtctaatagagtcaaacgtttttctctctattaggccacgattgacctgagaagggtccaatgttgtccgggcttttgcctacaatgtatgtcgccaaacaaagacatcgagaaacggaaagacccggatagactcaatgatactgcagcggatcgagaagatgggcatcgcagagaagcgcgagctcttagagaggctcaaggctctcatcgctaagaagatagcaggatctaccctcgcaggtaagcccaaaagatacccgaggcgcacatctgcagacctcttctgtaagggacactctgcacaaggctatcacagatggaagtgttgctcctgcggcaggaccttcttagcgaagatggaatctgccctgaagtctcccaggagcgcccatgccgtctgctgtcaggcagatgttctctccctcgacgagtcgcttgtgggcagcagggcaaggtcggatgtgcagatgcgcgatagcacacaggccacggccatgccgtacactcaagcggcatatcaagtcccaaggtctgcaaagagtgctaagcgagccggggagcgagtatacaacacttcgcgggaggctcactgattcgaagctaaaggttgccctttcaggcatcaccgacagctcttgggtcgcaacagacaaccatgcaagatatagcgcgtattccttccttactcggcgttgttgagtacacaccaagcgtggtaaaggagtctagggacagcgagaagtggccttgtcaatgcgatgcagcgaaggctcaggcaagttcttgcttcccttctacggggtggcgacgaagggattcggccactgcctcgcctgcttgctgtggacaaagcaggcgaagcattcgaagcaggacagcaaggcgatgctctcaggacagcccacagaaggcagctatgtacacacgaggcgcgcttgtcgacatgccccagtctctctgggactggtggaagacaagggctgaggtcaatggtggtcttaccgagagaagttttttctatgggtgagacggcctgagcagctctattgccgtttacagattcagccttggccacgctccatgtagtttctattcgattgacctcacagcatacaaaaattcccgcccgtgtcatctcgttcaatcgtgagaaaacacagagcggggcttacttgtggctgttcaacaagcgcgcatacgatgccaagccatcatccgcataccgtctctaggcaaccagcgtattgctggactactcctgatatacgggactactcaactgtgacagacttggccaggttacgcggcttatccacatcgagacccttggcacgtgctacatagagcgcgaggatctgcaggtgcacgatggagacgataggaatgatgtattcgctcatcggcgggacccacagcacatggtcagccaggttggcaacctcttcatcaccgtcagttgccaccgcaataatgtaaccgccacgggactttgcttccataatgttggagagagtcttgtcgtgtacgtggtcctgcggcacaatcgcgaccaccggaaacccggattcaaccagggcaatcgggccatgcttcatctcacctgccggataggcttctgcgtgaatgtaggagatctccttcatcttcagggcgccttcgtaggcggtcgcagaactggagccacggccgaggtagagcatgctctgcgcatgcttcaattttttgactagctgcttgtcctgccaggttcgcttaaagatcttgcggatcgcgtcaggtacggtcagaagctcacagtagaccttcttgacctcgtcgagcgtcatattaccattcgcctgtgccaagcgcagcgctacaagcgtcgcagcgaccatctgtgccgtgtaggctttggttgaagagacggagacctcaggtcctgcctggacgtaaatcgtaccgtcggattcacgcgcggcagagctgcctaacacgttggtgatggcaaagatcctgcagcccatgctcttgagtctgcgtgctgccgcaagggtatcggcggtctcaccggactgagtgatgatcaggcagagagtgtggtcggtgaccagcgcatcagaataaaggaactcagaggcatattcgatgtcaaccggaatctttgcccagtgctggatcatattccttgcgatgagtcctacatggtaggaggtgccgcagccgataatgtagacacggtcgacctgtgcgagctcctcgttactcatatcaagctcatcgagcttgatgcccttatcggtaaggcgtcccttgagcagacgctcaatcgccccaggctgctcgctgatctccttgctcataaagtcagggtagccgcccagggttgcagcggaggcatcccagtcgatatcaagcgttgcaggatccttaacctcgtcgccgttagcgtcgtagatcgtgatagtaccgtctttctggagcaaggcgatatcgtcatctgcgagctggattacgtgcttggtgatcgcagctaagggcataacgtcagaagcggcgtaggcaccctccggggtagaagcgacaaccagggggctgccatgacgagttacgacaacagagtctggctcatcggtgcacacaaccgccagggcccaggatccctcgagacgtgccacggtattgcgcagagcctcgatcaggttgcccttggcagggccgttccaggcatcttcaaacaggtgtgctacgacctcactgtcggtgtcgctcttgaactcgtgacctgcctctttaagctgtgcacgcagatcctcatagttctcgataatgccattgtggacgactgcgatcttgccggagcaatcggtatgggggtgtgcgtttctgtcggaggggacaccgtgggtagcccaacgggtgtggccgataccgcaggtaccgacaagatttgcgttctttacacgatcacgaagggttgctacacggccctgacatttgaccacatgaagattgtggtcaggggaaatcgtcgcaatgcccgccgagtcatagccacgatactcaagcgttgcgagaccattcaaaagaaagttaacagctttgtcggttccggtacatcctacaattccgcacatataagcgcctccggcttcagtagtcatttacactgttatgcttagacctatctttgtgatatctaagaagattgtcattggtatttttccgaaaataaaaaaataccacactgtctaatccagtcctaatagagtggcccagttgattgtacactgaaatcaaacccgaaagagtgcctgcctccttcgatctgaggtcttacgccgccatcagccctaagcgataccagtttgaggagcgtctcgtagtcgagcaggtggtggagccgctcgttgttgtactgcttagcgtaagcccgcgctgagccttcttgagctcggtagacgctttgtactcgttgatcctcacgcactcactcttgaggcttctagatcatctcttttacgatagcgttgtcgacccacttggacttgccatccatgctctggcagatgtttcaacaagccagcaggcccttatacgttgcagcggagaagggcgatccctggtcgaagttgacactggagggcttttccgtgggcagattagcattctgagtgcaacagaatagcgccaggcaaaggtcatggcgcacctccaaaggctacgatgttggttgtctcaatcaacgtcgcaaggcagggagcaatgcgccactacacatatcttagcgcgccgtcggctcaggcgagctcgatatctccggtgcgcccccacaggaccagctccgccgccatctgtgcgggaaggggaagtgcacgcacagggaacacaaggagaggaggggcaagatcaaggtctcctgcggcatctcagaaaggcccaagcaggcacacgagcgcttaaggctcgctgagtgggagaacgacacgctcgtcggcaagccgggagggccctgcctggtgacaatcgcagattgctgagtcgcggctactcgtaggtggcaaggctcacgcgcacacaaggtcgagctcacggctttgttaggccgtgaccgcaagaccatcacgccggagcgcggcaagtagtttgccctctgcgcgaaggtgagcgacaggctcggcgatgtctagttctacttctgccatccctgccacctatggcagaagcccactgctaagaacaccgatgtcctcatctgtgagttcttcccctaagggcacagacttctccaagctcaccgatgatgaggtacagcgcgtattcggcatgatcaacgacagcctgaggaaggtccttagatacaggatagccagcgaggtctttagggagatgttgcactcagcttgacaatccgccttctcagacacccttctgtcgagattctataaccggaagcaccggttagtgcagcctacctctgtttctgtatgcaaccgctacagaatttcacggatctcctcgaggtgcctctcagtctctcgacgtccctccaggtagagattcagcaacggcagcccctcatgctcagcggtctttacattcaccggctcgggtggcatcagaacaatcaccttgcctgtatctgcaagctctttgagctgtttccgttgggcattgatacgatccgcccgtgtagcaagatcctgttcaaagtagggatacccatcgtattggtgggtcttcagggcaaaatcttcaagcgttccctcattgacatacgttttgtctgaggtaagcaccaccacagccttctctgcaggcactctgttcggcaccttcgaggccccttcgagtcccaatgcggcagcaaaagggatttcatctgagcatccaccgtcgaggtagcgatggccgtcaacctcaaccatcgtcgagaggacgggcatcgaggccgaggcccgtgctttatcggtatccgacatctctgctttgctgcgtaagtatgccggagtcccaaatgacacatcggtggccacgaagtacatgggcgtcgtgtccttcacaaaggtatccagatcacagggatcgatctggttttggaccacattgtacatgaagtccgtaccaaaatagttgccggtctcaaagaaggtcttcatcgacatcattctcgggtcatcgcgcagcgcaagcatgatacgcatcgagcggccgatctgccgtgagcgatagctcacggacatgagggagcccgccgagacaccccaaatacttgcaaaggaatcggtatagatgttgttttccataaagacatcgaggacaccagcctcaaagatgctcttataacctccgccctcaagcacgagagcggctctcttattgctttccatcaatccacctccggacgcatgtcacaggaccctcacatacacaaacaatgaccatgaacagggtctgttcacagtcatgcctactgatatttctatgtgcatgaggccttacgccttgtgcgccatttccctcaccttaacaccgatacccaaggcctgttaacccatcaactctcattagtgaattctcattgctaggaaaacgatgattaattcgcctcgatgaggccagtggagccacacgctgtatgccgccggctcaaaatgtcttgaaccacgcagctcccatacccacatagatacctatctgtcttctggatatggtatagctatatccacacattccagcatatccatatccaaaaggcagatatggacagccagataagctttcaagaccttaaatcctaaggtctaaggagaaagacccagcgagaggcattcctggagcaaatggatgcgatcgttgtgtgggatagctggattgcactggtagataccagctaccacggacaggctcttgtcaggcatgtgcgcgctgtaaagacgatgctttaggatgtatcctgctttaggttatgtttgctctcttaagacgagggaacctaaggatgcgggagcttccccacggaggacgtcgccgcgatgctggcggcggcgaggtgcaagtacgtgaccgagggcggctggggctccagacgctacctcggcatcgccctgctgaacggatgggacgagagggaggtgctcaaaaagcagcagggctagcttcgactaccgggacgggaccccagctggagaaagtgcgaaagactattgacggaaccgacatatcccaagcacacacactcgtaagggagtatgacaggttctgctgcgcagactttaggctatataggtatagcgaagcgcccttaaggtcacataaagacccacacctctcatctatgcgctaaagcgttgtaaggaagccttcgactagagagggtcttgcctgtgcgcttttctccgagaagggcatcgagtccaggaaggcatccggccgctcaaaggtagagcatcctttccttatcgtgaagcggcgcttcgaccccttaaggaagcgctactaggggatagagaagatctcctgtatgctcgatgtctttctcgcccttgcaaaccttacccatgtgcatcttttgccggcaggctgcacctcccggctctcagcgtcgcttgatctatcttggagccttcttgcggtgcatggggcaggacagatgtaaggatagtggctcctgcacgtgctggatgagcatccttccctgcctttcccgcattccggccgcaaaagtcgtgtggtcggtccctctaacacgttatggggcattaatcatcgtttccctaggatcatggcatagatcttctgctccaagaacatcgatgggtagctggcgtccgcgttcaataagatgatgaagcggatccggccttctgtacctacttctgtgagcgcttctatctgaaaccggagagtgcgcctttatcaacgataaagaggacaacatcgtgggcgccaaagccgccggcatggctgtccaccgctacaccgatcctggatttgacgactggctgcaccaacaggatgtgcagttctgatccctaccactatccaagcgagggcaaagtgtggctttcctactatgtagatcttctttccctgcatcagttcagtgatggattgcagggttgggtctgggtccccgcccgaaaacgcgcggctacgtcacccagtggcgtagtctgggtatgtatcaatccgccacccatctccagcagatgaattaccatgtcatgtttggcatacgagaacgcgtgagtgtcacgtcgacaacctctgtcatttcgaccaacaggttatcttctcgcgcctgctcaatcgctccgagtgctgtgggcatacgcccgaacactaagcctccgatcccgagcagaatacccccgaagtaccgcgtacgacgcagcagaccgtcacgcaggcccactgtcatgcagcacctgcagtatcggcatgcctgccgtcccatgcggttcccatcgtccgaagagtgggtctgccgtccggagaggacccaggcaggcacgtgatggcgggcagcggggtgctccgattttactgacgcaataaacgcattcgcctcgtcgagtgtccgacgtgcgcgagctttgcgatgaagcgtgacttcttactctcacggtactctgcgttggatttggtaccggccttcgatgtcataaaaagttgttgagttaccacgctcgtaatccttattttcagagttgcacgaagtgggcctaggagccggttctgtcgaggacaatcatctattaggagcaccgttaccggtcgccctcaagcgcacaacccggatggccgtgcgggtcacacgatcgacatccatttgtgtttgctccagaaggggcttaccaagccgccgtgtcccacgacgcggtgcgtctctacaccacccgtttcagcttgtctctgacctcaagaggcagtgggagtcttcttttctgcggcgcctctccgtcgggtcaccccgcctggccgttagccagcttctcaaccctgtggagcccgggactttcctcataacctcacctgtaggttcgcgattgtccggcccactcgtcctatccattgtaccatgatcgcccagcctaacacagaaaatgccgagctaaaacagaagggccatacacttgtaaggccttagatcgcttatattatgtcagatgcgttagtcgaggtgtcgacgttgatgcctgcatggagggcaggctgtcagtgaggacggtcttatcggggttagcatcgtcgtctgcacccacagtgtccgcctgatcgtgtcttggatgttatctacatcagagaagccgcaggcgcgctgtagctgttgtcagctgcttcagagacgctggcgctcgaggatgcgttgatcatcatctgaagacgggaagactgcgtcggcgtcgtccaaaagtgctggatcagctctttgtaggacttacggaagtcctcgagggacttcttgagacgctcggtctcgtcgatctcgctttgccttttcattaagtgcctggcgagaatgtcgcgggcttctggtctgcctcatccttaacctgctcgccgtactccttagcgtcagcgacgatcttgtcagcgctctgctgagaccgatcatgacgcgggagatctggtcggcagagccgtcgcctgcggcaggctgtgcagacttcgctggttgagatcccgctgatgttgctgctcaggttctggaacttggactgggtagcggaggagctctatgctctgcgctgttgagtctgctcttgaggtcgggattttctgaagcatcgcatcaacttcgctggaaagctgctcaggaagagtcaacctcctcagtgtcatagccgtgcttggaggggagaatgtcaactgttgcgatgtctgcgggtgtgatgccatatcaat

SEQ ID NO: 385 - DNA, 5064 bp, Unknown
  Metagenome-assembled genome
tcatccttatagattgcagaggtgataccgaaggctacgccgaaggcgacggcgaacataatgatgtattggatcggctgcgtgatgcaaaggagaatgccgaagatgccggtgacgccggtgccggaagcgccaaggtggaagatgtagcagcacagagcaccacaagcagaaccgatcataccggcaacgaacggcttgatcttaggcaggttgacgccgaagattgcaggctcggtgatgccgaggaggcaggagacgccggagggaacagccagggacttggttttctcggacttggtgcgaagagctacagccaggcaggcgccgccctgggaaatgtttgctgcggaagcgatcggcagccaataagtcacgccgtactgagcgagcatggagacatcgattgcggtgtacatctggtgcagaccggtgacgacggacggggagtagataaggccgattgcgatatagccgataccgaacgggacagagagtaggaacatcaggagactaaggattgcgttctcaagccagacgaagattgggccgatgaagaggattgtgatgtaggcagctgcggacacggagaccaacggagtgacgaacagatcaaacatctcggggacgaccttgtggaggcgtttctcaaagaagcacagaatccagacgccgaccagaataggaatgacgtggccctgatagccgacccagtcgatggagtaaacaccggggataacgtcgagcgtgatcatcgtgccatttgcgattgccgcgcttgcatcataggagttgatgaagtcagagctgatgagcaatgcgcccagcgatgcacccaggtaagggttgccaccgaagaccgtcgcggcggagaagcctaagaggatctgcaggttgcccaatgcgcagccgttgatcagggcagcgattctccaccatacggttgtggtgtcgaggttgaacattcccgcgccgccgtctgcaacaggggtccccataaactgaatagcggacatgacgcccatcaacatgccggaagcgacgattgccggaatgatcggaacaaagacgtctgaaaggactttaattgcgcgttggaaggcgttgcctttttgagcggcctcctgtttggcctcgtctttgctgactgcggagacaccagactgcttgatgaactcgtcgtacaccttgttgacagtgccggtgccgtagatgatctgcagctggccggcgttgttgaagttgcctttggcgccgactgcattggccagtttgtccttgtccaccttggaatcatcggcaatgactaggcgtagacgtgtcgcgcagtgtgctgcggaaactacgttgtccgctccaccgatagcctcaagggcctctttggcagcttgtgcgtaatcaagagccatactttgcttctctccttatcctgctgaatagatcggtctgtacatgagagtgattgtggaatcgatctcacatcagaattaaagggcaatgaggttatttactccatagcacctccgtcttttggatgtgagcggtagaaatatattggtgaacggtagatagtggttcagggaaattgctgagatgctccattcagatgcgcgtggaggagcggatctgcagttcgtatcccatacagatctcccgggggatgtgggtattcaactgcagggcatctgacaaaagctcagcggcctgtctccccgcagtcttgtagtggtagtgcacggtcgtgagtgacggggtgaccacctgtgtgagttcagtgtctccgacgccggtgatctggatatcctcggggatacgccgtccgtattctcgtgcgcaggtcattgccccaaacgcaatcgtgtcagacgcgcacatgatggtgtctgtttctggatgggcctctaagatctcttctgcgcagaggtatcctgaatccaacgtaaaggcagatattctctgggcatccctcttgggcttgaggccgcagtctttgcaggcattaagaaacgcacggtggcggtcatgaccagcgcttttgtcctcttcgatcacgccgatataggcaggatttttcgaatgctgtagcacccggcaggccaggttatacatcgaggagtaatcgtcgttaaagacggagttgtagcctttgagatcctggcctaatacgacgatcggacaacgcagagcccgtatcgttttgcgatgctttgcatcgagtaccgtagcgatcaggatgattccatcaacccgatttttccgggaaaagaggttaaggtagatgatctcggcgttcttatcattggcagtgttgcccaacagcatctggtagtcggtcgcggagaacccttgggtgatgccggagagcatacgtgagacggaaaatgagttcaccttcggcaagatgacgccgatgaggccggtctttcccgtccgcagtgtctgagcttgctgagagggggtgtagccggtcttcgcgactgcctgagcgattgcctggcgcttttcatctgacacatatccatcattgaagtaccgcgagacggtagcccgtgacactcccgctatctttgcaaccgtattgatgtccataatccgcccgtagctttcctgtttcgtctcttacagcggacacgttgtatctaccgatttcaccgaagttcccactagaatgtgaaatcgataccacttactataagcatatcaccatatcgcgctttcgtgaaaggagtcttacggtgtccactgcactcacgaacgatctcgacagcctgcgcaaagagaaggaagcaagcgcacaacacggacggttttcccaagctttccacctgatgcctccggtaggttggctcaacgatccgaatgggctgtcccaattcaaggggctctatcacgcgtacttccaatatgcccccttcaatatcaatggtggcgtcaagatgtgggggctctatacctctgagaacctgctcgactgggagtatcagggcgtcccactcttcccggaccagccctttgatgtcagcggcgtctactcaggcagcgcgctggtcgagggtgacaagctccatatcttctatactggcaacgtgaagcgcttggacagtggacagtacgactacatccatacgggacgtgaggccaatacggttcactgcgtttcggcggatggtcgctccttcccggtcaaacgttgcgtgatgacgaacgcggattatcctgaagacgacacctgccacgtgcgtgacccgaaagtctggaaggacgacaaaggttggtggatggtacaaggtgcccgcaagaataatgacaccggtgagattttgctcttccatgcgcaggatccagaccattgggaactcttccggcgtctgaccaccgatgagccttttggctttatgtgggaatgtccggactactttgtcctgcaggagggagatagtgctaagcaggtgctctccttcagtccgcaggggcttcatggcggaaagtgggatgagcgtaatgtctatgcctcaggcttctgcatgctgaccggatcgatcgaagaggtatacagcccgattgagttctctgacttctcaatctgggatggcggttttgacttctatgccccgcagagcttcctggcagatgacggacgccgcatcctgatcggctggatggggattggtgatacgccgacgcagaccaacaagacgatcgcggacggctggcagcactgctttacgttgccacgtgagctctatctgaaggatggggcagtgtgccagcggccggtgcgtgagctcgagcagaagcggggagcgtaccatacttccgatgcaggacacctgaagcttcagggtattccctgctttgacgcactgattacccctcagggaaaaccgtttactgtaatgctcgccgatcagttcaccatcaattgggatacgaatactctatccctggagttcaacaatacggataaagaaggggccggcgcgggtcgtaccaagcggtctgaagtggtgagcgacctcgaagagctccatatagtcgccgattattcttcggttgaaatctttattaaggacagttccctgagcttcacgacccgctattatcctgatcaatactgggtagactttgtaggcgaccctacatcagtccttaaactttgggagctcaattgcacacaacctcaataatttggctcttcgctacttatggtgggtagcacgtctgcatccccttgaaggcgtggcctttgaacggtaggattttcggaaaggaaaggcttcggtcctaaggcgcgcgatggatgcttaaggcaggcatgctggcaaggctctttaagagatcccatggggcttagggacgaatgggagctctttgatgtctggtttaaggagcgcgagggggcgccgagctccccgaggtactcccgcagcttcggctcgtcgaatgatactatctcgtgtggcatggtcccgcttcctcgtctcgagtggttttgcttggtcgcttccaatcgtagcgagacggggccatgcctctttatgcggctattcgattttcaaaagtgcaaaagaaactgtacgtcatcaaacctaagttagaagaggaccagatatcaccatccactgctccgtgcggcgtgttgaccagtgtcgtccatgatgagatagtggcacctttgtcgtaagcgcatggtctgaaagccgccttttttcagtttcgccctgcatcttctcggcggcgctcatcccccctccttttgggcagcgcatgccctaaagcgtaccgtccgtgcgtttcctcttgctctgcgcagacggctggagctgcgtcttagccgatctcctcactcccgcgatatagccgatggccttccctgtgtgccacacatcttggctattggttccatcccctctcctgtggcttacaatcttgtatgtgcacattccttgttaagctttgcgacgttgattgagacaaccacatcgtagcctttcgggtgtgccacgcctgcattccacaggtgctatccggtggggtgggcaccagaatgctaatccgcccgca

SEQ ID NO: 386 - DNA, 25563 bp, Unknown
  Metagenome-assembled genome
acgacgagcgcgttatgatcacctgctgcaacgatggcacccgtcccgtcatcttcaagctggagcgtatcgacatccctgagaacgagcaggaaaaggaagggttgtcccaacagaatttcaagaacagcgccaatgacgcctatacaggctgatagccttattgccaactccatctaacatcttttttaaaagcaggtactatacgtgggggcacgacaacttcgaccaatcaacagcgcatcgactacttgcgtgaacgggatttcgtcttgcaaaactgatcggtcactttggatacatcaaggatgcatcgaccgtgatgggtttctcaacctggtcggctccactatcgagcagatgctctctaccaaagtcacaaccatgatagagaaacgactgaaaacgccctgtggcggcaaaatcacaccggaaacactcagcgcgcactcccctgaggaaattaagacaatcggggtgtctatgcgtaaggccaagaatctgaattgcttggcgatccatgtgaccaacaaggatctggacaccttggcagacaaagatgataaagaagtctacacgtggctcaccgcactgccgggcatcggtgaatggaccgcgcacatgttcatgatcttccatctgaaccgcctggacatttcgccggtaagtgaccttaccttccgcaaatcatttaaccctgttagaccactgtggatatagggaagcgaaaagatgtcacggggtcgccctacaatcgggttcgaccaagaaaccgacctgaagaaggccccgcatgcttgacacgatacgacaactagcaaagtagctgacccgcaaagagaagaccgcacttatcgccgatctcaagcagatgatagctgagaagctggcagcgcagaccgacaagtccgccacatgtccgcactgcggatgccctgagttcaccaggcgcgggcacgacagcgtctaccagaccaccagggaggctacgtgagtatgccgattgcgttccctaagtaactgggaacaggcgatatgacctcatatccacagcggtctaacagagtcaaccatttgagtggctctatggtgctttgatgaccgacggaaaggtacagcttgtcgtctgcgatctctggaatccctacagctcctacgctgcccgctatctctaccatgcccctcgacgatgggccgatcgacgcaggcgacgcgaaagagcaattgggcctttaaccacatcaggcagcagtttcccgctgcctgatttcatggatgtatttatattgacagctctctcagaaactacagctcacagacattggtgggtctccctgccagatagttctgtacattgtcgaactcgatctgggctcttctctccagcccctctttcgtgaggaacccaacgtgcggtgtgagcaccagattcggcgcatgcagcagcggatagtcagcaggcaggggtggctccacatcgaagacatcgacgccggcacccgcgagtttcccactccttagcgcgtatgccaacgcttcgttatcgacgattgcaccacgggcacagttgataaagaccgcgccatccttcatctgagcaaactgagccgcaccaaagctcttctttgtctgatcattgagcggcaggtgcagcgacacgatatcgctctgcttcaggagctcctcttctgaaacaaaagtgactcctgcatcgatcgcggtttgagaagtatggcgcgcatacccgagcactgttgcgccgaacgcggtaaagagtttggcaaccgcgctgccgatgtgaccggtcccgatcagacctaccgtcttgccggtgatctcctgcccaacaagccccgcggaggtcttccccatacgggctgcggtatctcccaacagcactttgcgcagaacatcgagcgtgagccctacggtgagctctgccacactcgtgtcagagtacccagcgcagttgctcacgacaatatgctgcttcctacaggcgttgagccccacgtgatcgatcccagcgaaagcgactgcgatgtatttcagctgtgggagctgggtgatcacagaatcaggtagcaggttgtttgcgatcattacgatctcagcaccgcgggcacgcgatgccaattcatcctcatcactagttttatccggataagcaataaattcgttgccgtcatccttcaacggttgtgccagctcattgagtttctcttctgagatgccgagcggttccaaaagtacaatacgcatgagattgtgcctccttgagtgtgcgcccttccctaaagggctccaccacctacgctattcccaccacacgtgtgtcctgactgtccccgatcaaaatccatgatcgccaagcatacggatcgcgccagatcacacgaggcgacacagccgtccatcaaacagacgagagaaagccacacgcgcatgccctctttgtcgaggtatctgtgggatcgtgatgctctccccggcagtggtcaagaccttcactccaggtatcagccgccatatcgattcgctccaccttgaagataaccgggcgtattccgtcattgcaggatacgataactataccttcaggataggacaagacttatgagcaagattgtcatcgttggcgccaaccatgcaggaacggctgcagtcaatgcgattctcgatagccatcccagagacgaggtcactattctcgatgagaacacgaacatcagcttcctcggcggcgacatggccctctggatcggcaaacagatcttgaagcctgatggcctattctaccagactgccaatgacttcagagctaagggtgctacgatccacctggagacccatgtggagtccatcgactacgacaacaaggtcgtccacgccgttgagagcgacggggactttttcggcgagtcctacgacaagctcatcctcgcaaccggatccctcccggtgctccccaagttcccaggttgcaacctcgagaatatccagaaagtgaagctattccaggatgcccaagccgccaccaacaagctcgacgaggtggcatcaagaacgctggcgtagtcgtcacggtatcaatctcgccttcggtgagaacggcaaggtcgcccttgtcgtcaccgacaagggcacttatcctgcggacatcgtgacactctgcgtcagcttcaagcccaacagcgcgctctatgaggacgccgatttcacggtgccgccgaacagggcgctcgttgtcaaccatcatcaggagacctcaaagccaggtgtctacgcgatcggcaactgctcttcctgcttcgacaacgcaaaagacggcgagcgcgcctacatcgctctggccacccacgcagtctgttccggcatggaccacagcggcggcagacaccgcgttcgagagcctaggtgagaacgactcctccggcatctgcatctacagcttcaagatggtctccaccggcttggcccagggcgggcgctcaaggcaggctacaacgcggagatctccgactacaccaaggtccagaaggctatcttcatcgagacttcgaacccggagttcacagtccgcatcgtctacgacacgacgacgagacgtcttctgggtgcgcaggtagcgtcaacgtacgacatgtccgcagacatccatatgttctcactggtgccccaggagcatctcaccatcgatagacgggcgctcacggatatcttctttctgtcgcccttcaatcagccctataactactatataggatggtatcgtatcaggcagtgttgaggggttagccctaactcgacaccttccatgtgtaccccatctgcaggcgcaggagctcttcggttcccgcgcctgttctcttgtggtggtcagggttctcttcaggtgttgcgctgagccctgaggttcacaactcagcgcaacggttggctgccctacagtgcctgcgcctgagcttcatcctctcttgcttcagcaaccacctgccaatagccttctccccacacgttgagcgcgtcgagcacggggcgcagtgcgtagcccggatcagtaagctcatactccagcccgaggaaagacctccggataacaccgtgcgggtcaacagccccccatcgcacgcaggttctgcgtcgagaccttctgggagatcttctcgaccgttttcttgagctccccgaagtgcatcttgccgttcaggagctcccggatgatcaggacgcgccaacgctttgagataagcgtaagcgtagtctcgactgagcaggccgggagcttctctggcaggaatttcggcgccggctttggcgctaaggcgaatctgtgtgtggtctgtgaagaggattttcctatacctacctcatcagtttcttttagatatctacagcactctattgtgcctacttctgtttgtatgcctttgagggcaaactatcaattagctcaaaagagcacagcaaacagagaggaggcacgttacgccgttgtagcagcaaacggcaaagcgggaagactggccgtcgaggagaccgtcaagcgtggacacgatgtgaccgcacttgtccgtcgcgagagtaagacacaggcacagcacaccctgcagaaggatctctttgatctgacgaccgatgacctcaagggcttcgacgtgatcgtcggcgccttcggcgagagaaccccgagaccctgtcgcagcaccagatccccctcaagcaccttacagatatcctttctggtgccaatgtccaccttatcgttgccggcagcggcggcagtctctatgtggatggcgcgctgaccaaacagcgcgcagacagccctgacctcccaaacgccttcaagccgctggtaaccaatatcgcgaaggcgctggctgagctgcacaagcgcaccgacgtcaagtggacccacatctccccggctgcagacttccagactgacggcaagcgtcccggctcctatcagctcggcggcgagaaggttccatacaatgcagcgagcaagtcccagatcagctatgcggactatgcaatcacggtggtcgaagaggctgggtacaccgatggtgcctccatccagaagcgcatctttgccgtagagaagtaaggctttcctctcgtcgaaggcctgagccagcggcatagcgacaggccaggtggtcgccgtgtagtgtgctgagtcctgagagctggccatatttggtttctctccccaaattctgcacgcccctgtcgcaatcgcgtcgcccaagtgaggcacttgatatactgagaggaactgaaaggagctttcgggcaatcagaccttaaataatctcgaaggagggcatatgagtcagaagaaagaccccaaggacacctgcgtactcgttaccggcggagcaggctttatcggcagtcacacggtggtagagctgctcaacaatgactacacggtcgtaatcgtcgacgacctctccaatgcatcggaaaaagtcatcgaccgcatcgatcagattgtcgggccggacaaggcaaagaacctgaccttctataaggcagactgcaatgaccgcgacgcaatgaatcggatcttcgatgaaaacccaatcgagcgcgtcatccactttgcaggattcaaggcagtcggtgagtccgtgcagaagccgattgagtactactccaacaacctcggcaacaccctggtactcgtcgatacgatgcgcaagcacggctgcaaggacatcatcttctcaagctccgcaaccgtctacggcgtgcctgacaagcttcctctgaccgaggagtcccctaagaagcctgcgaccaacccgtacggttggaccaagtggatgatcgagcagatcctgaccgacctccacaccgcagaccccgagtggaacgtcgtgttgctccggtacttcaacccgatcggtgcccatccttcaggactcatgggtgaggatccgaaaggcattcccaacaacctgctcccctatgtcgcacagaccgccatcggcctgcgtccgtacgtccatgtctacggcgacgactatgacaccccagacggcactggcgtgcgcgactacatccacgtctgcgacctcggcaccggccatgtggcagcgctcagatggatgaacggccgtaccggcgttgagatcttcaacctgggtaccggcaggggcacctcagtcctcgagatcatcaaggccttcagcaaggcctgtggccacgatatcccctacaagatcgagggacgccgcgccggcgacgtcgctgccaactacgctgactgctcaaaagctaaacgtgagatgggctggaccgccaggtacaacatcgacgatatgtgccgcgacagctggaactggcagtctaagaatccgaatggctatggagactagctgtgggatcagaaagtgaaccgtttgtagcctacctggctcagaaacgtcctctgattgaagactatctcgagacccatgccgcaatccccaactctgaggaccgcaccgcctcagatatgaaccgctacgcgtatagtccgctgcgccgcttcaccgcaagcggcggcaagcggacccgccccgcgctggtactgctcggctgtgaggccgtcggtggaaaggacgagcaggcgctctcctgcgcacaggcgctggagtacttccagtccgccgccctcatccacgacgatatcgccgacaaagggcagatccgccgcggtgagccctgcacctatctcaccgagggcgtgggtgtcgcaatcaatgtgggcgatctcgggatcgtgcgcacctttgcgggcgtgattgaggacgacagcctcccgacggagaccaagctcgacgccctgcgctatctcgcgaccatggaggagtgcacagtgcagggtcaggcgctcgatctgggctgggtccgcgatgggcgctgggacctcacctgcgaagattatctgagcatggcgaggcataagactgcctactactctgccgctaccccgttggcgttgggggccctgatcggacagggcacagcagaacagatcgagacgctccacggattcggcctggacgccggccttgccttccagctgcaggatgaccttttgaacctcgtgggggatgaggagtcccaaggcaaagacttcagaagcgacctcaccgaaggcaagcggacgctcgcggtcgtgtgggcactctcccacctcgacgagcagcacaagcaggaactgattgggctgctctcctcccataccaccgaccccaaagaactcaaccgtgccttcgatctgatcgaaggcgtgggcgccatcgacgcggtgcgcaactatgcgctcaagctcgttcactccgcacagaaccgcttggaaggcgtacactttgaggggaatacccgtgacattttggtggcaatgaccaactacttcatcagccgacgcgcatgatttacgttagccatatgcaacgaccttgttgatttgcatgcggacagccaccccattccagccttgatatgcgaggtgtctttaagaactatgaaagaaaataaaatggacccgattcttgagggcatgaaaggcgtcgccgtcgaagacattcaggaccgtctcacccatctgcactacgagattgacaagaaggagcgagacagcaagtactttggcccctcaaccgccaacgcgattgtgaaattcagagtggagcacaatctgcccgtcgggcaggaggtggataaggacacctggatcacgctcgtcgatgagtgctatgagatgggcgaccgtaccctctatctgcgcctgccgaacttccatggcaacgacgtgcgagagctccagaatgccctcaacatcctcggcttctcttgcggcgaggcgggtggctactacgatgcacacactgaagcggcagtgaaatcctttcaggagagcgtgggccaactcgctgacggcatggccttcccggagacctttgacgcaatcgagcgcctccaccatgtctgggccggcaagccggccgcgggcccccatccgatgggcgctatcggctatgcccgcgccgctaatgtgttggagagcgtacatatcgcgatcaccggtgatgacccgatcagcagaaatgtggcaggccgtatcttcaacctcgccagcgccaccgccaacgactccggcttggagctcgtagatgaccctaaccacgtttcaaaagactgccaggcaatcttcatgattagctcaaaaccgcttccggaaaactccaccaatgtgccgaatattgtgctcgatgatatcgacacgctgggtagacgtatccacactgcgcttgcttcctccgtcgagaaacagccgctcttgcgcgttgagctgccagtgggagaccactacaatggcacctttaccacgagcgatgcgcagaccttagcggtctttctgcttgacgcgatctgctctgcctttgcccaaaatggttgaactctggtgtagcgcaagaggggtacctttgctacactaaggaagcgctgaagttctgcttcagttgatacagtggtgcatcgtccaatggctaggactcgggtttttggtgcccgcaataggggttcgaatccctttgcaccagccactgtaggcccaaggctccgccctcctttaggggacgggaccttttcgcgtttcacagctacatcgttagccgcgagccctagcgttattgctgctatcgcaatccccatcgatatctagctcctacctaagagagctcccgccagcgcaaggccggcgggagtgaaaggcgacagtgggaggccttatcagctgaaggggttatctcgttattgtttctcgtctaggcgctcgtacacgtcgatgaaatcctgggcgacaaccctgaaggtttcagcttccatcagctgatcctccgcatgcaccaagatgagtgagaaagcaacgttcttgttgtcgattgcagactgccggagaagcttcaggtgggcggagtggcctttgttgaactccttggtgccgctctcgatcatcgcccgagcacccttgatatcgcccctctttgccgtctggatagcttcgatgtagtgggactttgcggaacccacggtggcgataatctggactgctatctcctggattttctcgaggtcctcatcttctgtgaccatatcacacctttctgcgcggttgcgcgaattcatcggtaggcgttactcacccatgagcttcattgcgtcagcaaggatcttcttagcgttcatgcggccgtagtcggtcattgcgatcactgctaccggcttacctttggcagcctcgacggcatcttttttcgcgtaggcgatctgaggtcccaagagcagacaatctgcattgtcgatccgctcgagtgccttgttgagtgggccggccttgatctcgacatctaatccctgtgccttgacttccttctgcatcttctggacgagcaggctggtggacataccggcattgcaggcaagtataatcgttttcatgattaatctccttttttgaaggtcccagcaggaccctgctaggacctattgtgtatgtcttgcgttagcgcagtgaaactgcactggtcagttcagtttaggcttcctcatcggcaagctctgcctgcttggcctgagcgcgctcagagaccctcatgaacggcaagtagataagcataccgagagcgacctcgatggcctgccagatgattgcgacgacaccggcggagccaccaccgacggccaggaacccggagatgaagaccggggtcgtccaaggaaccataaccacacagggggcaaggatgccggcagcagtcaagaagtaggtgaggccgataaagaggtcaggaacaagcacgaacgggatgatcaggggcaggttgtagacgatcgggtagccatagatgaccggctcattgatgttgaagatgctcgggagcagtgccagcttggtgacgtccttggaagccttgctcttggagaacagcaaggtgtcgagcaggagcatcagggtgcagccggagccaccgatcagagcaaaggtattcacgatctgcatgttcatgtagtgatcgggcgggatcggctggccggccgcaaacatagccatgttctcagtgatgaggatggtgaggatcggctcagccaagacaccagagatcgtggactggtggacgcccaagcagaagagcaggttagccagggtgtagaccaggatgatataccaaggaccggcgtttgcgaagcccttgagcggctctgcgacagcggtgttgatgatggtcataagatccgtctgccataagccgtgcaggattgccgcgccgagtgcgaagatcgcaagcgtgatcagcattgggaacatcgtattgaaagagtcaccgaccgcaggtggaatcccctcacccaagctcacctgaagcttcttgttctcagagagtttaataaacagagtcgtggaaagcaggccgacaatgatagcgccgaagaggccattagtgccggtataggtcttggagaagacaccggaaacggtgtcagagtcaacctcagtgagctcgtagccctcagggatatcgaggttcttttcgatgtcctcacgggacacggtgtagggttcagagagtgagtcgttcggatcgaaataggaaagctcggtaaagtcttggatggtcactgcagcgccactgatggtctggggcatgatgatgcagagcgcggcgatgctcacgacgacgcaggcgatcgcgttctcaaagcgcttgttcttggctaagcagtagcccaagatgccagcaagcacgaccgtcgcgatattgagcgagccctgagtgattgcagtaccccagtactgggcgttgagcaggacatccccacgtaggaacagcgggagcacgacattgttgataaggactgcgatgcccgccagaatgtagatcggcatgacggtggcgaatgcgtcgcgcaggctccttaggtgaacttggttaccgatctttgcggagaattccgcaaagctatcgagaaatgacttcttctcggcactatcctcggccatggtacctcccccttcagctggttctttcaaatcgttgttactcgaccatgtgggtcgttgctacctttttgagccacgctgcggacttctttggacgtcttctgtagttgtcttcgaggtcaacctcgacaaatccgtagcggttcttgaatgcatggttccaggaccagttgtcaatcacggcccagtagtggtagccgcgacacttggccccttcctggatggcgcgggcgagccactcgaggtgacggcggacaaagtcaatgcggtaatcgtcctggatcacgccgttcttatccttcttgaggtcctcgcgctcaacccccattccgttctcggagacgaaccactcgaggtcaggatattcattgcggaacttacaagccaggtcgtagagccctttagggtagatctcccagccacggcttgtgttcatctccgcttccggccacacgtaagggtcagcgaacttggggatcccgttctcgtctgtgtcgcttgcgggggcctggacacgctcggggtgatagtagttgcaccccaaccagtcgactttaccgtcagcgaggatgtacttatcctccgggcgagttgggagctcgatgccccgagagttcagggcgtcgatcacgtcctggggaagctctcctttggtcacgaggtcgagccaccagcggttggaaaccccgtcggtcatgcgcaccgcctcgagatccgctttgctcgggtttttatgggtgtagggcggtgtgaagcagttgatcaggccgatacgggaactgtcgcacaggtaaccttcttcctttgcggcacggtactcacgcactgccagcgcatgggctagcgagatgttgtactggaccgcgcgggcgcgcgcgtagtccttaatgaacggataccagtagccggaggtgtagcgctgctcaggctcgacgatcggctcgttgaacgtaaaccagtaatggacctctttgccgaaggtgcggaaggctttgcttgcatagtgcgcataggcttccacaacctcacggttctcccagccgccgcggcggaagaggtaggtcggcatatcaaagtggtagaggttcacgaaaatctcgatgcccacctcacgggcgtcggcaaaaagatcgtggtagtactgctcccctgccgggttgatattgccgtcttgatcgagcagccggctccactggatggaggtgcggaccgagtccagccccaacgacttgagcgataccaagtcctcgtggcggcggttcgtgaagtcattgccgccataggagccaatccggttgtggaagtcctcaatcctaaggttggaccaggtgtcccacaggttctcgagcttgcctccgctacgccaatggccctcagtctgtggaccggacattgcagcgccaaagaaaaagtcgtcaggcaatctgtaggtctgctgtgccacggttttcctccactcgtttcggtaaaacaccgagcgtgaatgttcttataacatgttctatttataatttaacatgtctactttatttttgaaacagttctataagaatatctgacctgtatggtttgaatggtagtcatttaatggtaagcggctagagcggcaatttgagctattccataggggtacagttgttctaacaacgaccgaaggaggcaagcgcgtgtccaagtatcagattgttatggacgatctgcgtctcgcgataaaaaacgggacctatcccgcctattcgcagcttccctcagtcagcaagctctgcgagcagtacgacgtgagcaagatcactatcaacaaagccttaggtgaactggaagcccagggcctcatctcacggcgtcggggatccggctcctttgtcaaaaaggttgaaacttcctcagacattccgaacgcgaacgatacctccggccaaatgacaggcttctcggccgaacatgaggcccgcggcgaaacggtaaagagcgatgtgtacgacttctctgtggtgcatcctgcgcatcacgtggctgaagcgctcgatgtggacgacgactccttcacctaccatgtgtgccgcgtgagacgggccaatgacaagccccgagtgatcgagtacacctacatgcccatcgacataatccgcgacctcaaactcaagaatgtcgagacttcgatttactcctttattgagaaagacttgggcctcaagatcgcgagcgcccaccgtacaatccgcgcggtcatgccgacggcagaggagcgtgagcggctcaatgtacctgagggggaaccgctgctcgaggtagaacagatcgggtatttggacgatggaaggccatttgagtactccatctcacgccacgtacacgactatgagttccactcgatttcaacacgctaaggtacgactgcagtgccttcagatgccgcagtgccgatatatatagcgacgagacaggtcatacaggacagagagcccgaccatgggcctgcagggttgcaggcagctggactgtttacttaacaaattgatataaaacaaagcctacacacagggtagttcataaaccgtccctttgggccttataaagtgcctgatctgtcccgttattgtgtgtccgtaatgatcatcggtgggtgctgccccaaaataatttctaagtgctttaatataagggtacttggttttttgtttgcatgtaaacaaaagcctatttgtaaagacggattcatgcatagtactactcggaggccgttctatgccatttaccgcgattgtcctcgctgcaggcgagggaacgcgtatgaagtctcgtcaccccaaggtaatgcataaagttttggacaagccactggtatggtggccggttacggctgcgcgtaaagcaggcgcttcccgcattgtcgtaattatcggcaacggtgcccaagaggtgaaggatttcttcgcgcaggaagagacaagcacagacacaacccctgtcgagtttgtcgagcagaaagagcgcctgggtacaggccacgccgtcaaggtcgcccgcgaccagctcggcgccttctcaggtccggttgtcgtcctcgccggcgacaccccgctcatcaaacctgaaaccattcagtccctcgtcgagaaggccaaagcagagcacgatgcgtgcacggtgctgaccatgacgccggacgatgtggcgggctatggccgtgtcgtcgtcgacgataaggaccacgtccaagccatcatcgaggacaaggactgcacgccggaacagcgcgccaccctcaaagagtgcaactcctcaatctactgcttctgtgggcgtcgcttaagcgagaacatcgataagatcaccaatgacaacgcgcagggtgagtattacctccctgacatgatcaagatctttgttgggatgggtgaaccggtcggctggatccactgccccgattaccacgaggtcttgggcgtcaacaaccgcgtccagcttgcgcaggtcaccaaagttatccagcacaacatcaatgagcagctgatgctctccggcgtctcgatgctcgatccggatcaggtctggatcggccctgaggtcaccgtcggccaggacaccaccctgctcccccaaacgatcctctttggcaaatcttccgtaggctccaactgtacggtcggcccgaactcccgcctggtcaacgcccaggtcggtgacgggtgcaccgtcgatgaatcagtcatcgtcgagtcgatcgtcgagaacgacgtcaatatcggcccgcgcgcctatctgcgcggccatacccacatgctcaacggctccaaggccggcacacatgtcgagctcaagaattccaccgtaggcgaaggctccaaggtgccacacctgagctacatcggcgataccgtgatgggcaagaacgtcaatatcggcggcggcagtatcacctgcaactacgatgggaagcacaagagtcacaccgagttgggcgaccatgtcttcatcggctctgacacgatgatggtggccccggtcaagatcggcgataacgcgctcgtcggcgcgagctcctgtatcacgaaagacgtcccggcaggcgcattggccctagaacgcaatcatcagatcatcaaagagggatgggctgatgcgtattggaaacgtctcgagaaagaggattaatgtacgagaacctttgtaaccctatcaaggtcgagaagaatattcgcctctattccggcaccagcaatcctgcgctcgctgcaaagatcggcgatatcctgcatcttcccctctcgggattgaagattgagaagtttgccaacggtgagatctacgcacgcttcgaggagaccgtacgtggctgcgaggtctttttcatccagtcgctcgccggacagaacgtcaacgacctcattatggagaccctgattgtcgctgacgccgcctcgcgcgcttcctgcgcaagcttcacagcggttatcccccactacgggtatgctcgtcaggacagaaaggccgcttcccgtgagccgatcaccgcacgtctgctcgccaacctgcttgaggccgcaggcgttgaccgtgccatcacgatcgatctgcactccaaccagatccagggcttcttcgatatcccagtcacacacctgaccgccctctatcagttcggcgactacttcaagcagaagcccttcgactggggtaacaccgtcgtggtctccccggacatgggccgcgccaaggtcgccaagaaactctccgattacctcggctgcgaggtcgcaatcgcccacaagagcagaccgaagcacaatgccgctgaggtcatgggcatcatcggcaacatcgtcggcaagacctgcatcatcaacgacgatatgatcgacaccggcggcacgctgatcggctccatcaacaagctgaaggagatgggcgcgggcgacatctacatctccgccacccacggcgtcttctccggcaatgcaatcgagcgtctgcagaatgctccaatcgtcgagtgtgtcgttaccgactgcatcccctgtaaggttgccaacgagctgggctccaagatcaagtcgatctcagttgccaagatgctcgctgatgcaatctacgcagtctacgtgaaccattctgtctccgatatcgcaggtggtaactctgagatgtaagcctcgtctcagatacacttacctgcaagggccgccgcgaggcagccctttctttatgtcttcccattacagtgagagctagactctgggggcctctccgagctctggggtttcgacaatgcaccgcctgcgaattccctaaccttgtagatgacccctgacgggactgctggccgaccgctgggctgtaatcttttggtggccagctggacgccagcaagtggaggcaagtatcctttgcccagatgcccacccaacaccaccagcggctttaggccatgaaatgtcagtgagtgcaagtaaggcagaagaaggcaaaggcaaagtcgaagcttcccaggcagtatatagatgagtagcgccttcaggctgtatttgatagcctctgagttggggttttgagcgccggaaggctacggctttcatcacgaagatttttctggtttgcgcatgggcacgccgaccatccccaggataccccaaaatgtcgctacttcggtatcgacagaaaggggcagaaggaaatgatcggtgtggacaagatctaagatatacgagagatgtacaggaacaaagagcctgatcgccaggatcgcgaagaagctcggagtgtgtgagcccactgcgaggaagtacgcgaagatggaggacctctcaccaaagatgcctaaggaacagggaggcgaggcgctcctccctcgaggggttcggtcgcttcatcgataagatgctcgaggaggagcgcagctgctggcgcaagcagcgccacaccggcgtgcgcatcctcgacaggctgagaagcgagcacggctttaagggctcctgtcccaccgtgcagcgctacgtgaaggagaagcgctatgagatggcacccgacagggacgtgaggggccttgccggcttctttgccctcgaatggctacccggtaagtgccaggtcgacttcacggtgaggggcgtaacgtctaaagggggagatacctcaccgtgagcttcccccactccaacgtgggcctgacgcaggtgttgtggggcgagacggccgagtgcgtgtgcgaggggcttgccgatgtgttcgagttcataggtgacctgcccaagcgcgcggtcttcgacaatgcgctcggcataggaaagatggtcggcgacgagatctgcctgaggcgagctcttccgcctgttttgcgcccactgtggcctctcgtactccttcacgaacccctatttaggcaacgagaagggcaatgtggagaacaaggtaggcacccattgccggaacatgttcgtgcccatgccggccgtgggcgacgtggaggccctcaacagcaggctccttcagcagagcctcgccctctcggacggcaagcctcactggaagaagggcacaccgcagctcgagctgttcggaaaggacaaggcagccctctcggcgctcgcgccgcagaggttctcctgcagaaggtgggagacgaggaagtgcagcaagcagggcacgtccacgctcggcggcatgcagcgctactgcgcaggccccgcctgggcgggaaaggaggtggcggtcttcttcggcgccttccatgtggagctcttcgatcccaagacaggagataagatcgccagctacgagagggaatgggggcaggtcccgacggacagcgcggatcccgtggcgcagctgcgtctgctgtgcataaggcccgccggctggagggactgcgtcgtgaggaagtctgacccctgtcaatataatggacagaggaatctcagatttttttatgcggtctgcatcgcctttggatcgtatgcaaggcctctctcgaggcgctcgaagaactcttgcatcacctctgtgggcacgcgatctcctatggacttatgcgggcggaagcggttgtagtacgactcgattaaactcgtgtgctttgtgcttggtcgtggatgtatccgagaggcgcttatggtagtaccattcgttcttgagcgtggcgaagagcgattcggcgacagcgttgtcgtggcagcttccggttctccccacggagagcctcacgtcgggtacggctgagcaggcggcgagctttgagcttgtgtactggctgcctgggctgcttagaatatggcccctttggccacgtatccgtgcgaatatgccatcttcagggcaaagacgacaaggcctgccctcatgttgtcctgtatgcttcagcccaccaccatgtgtgtgcacagatggtgtgcgacggcgagatatataaagcctgccgtggtcctgcgataggttatatcgcccataagcttggctgtcggcacaagacacgaaaagccgcgccgggtgagggcgggacgctcgagggtatcaggtgcgggcagtatcgttctcttggaggcattggatcagatgccgcagatgccaagcttagccatgcacctgcgcacgcggtagcgggtcgtgcctgtaaattttgcgtaactgcggatctcctgtgagcttggatcagaccttacaggagctaaagcgcctgtcgctttcctcccatatcgcgcagatggcttccttgataggaccccataggtcctcaccgcctttggccttgagccatctgtagaagtgagccctgctcacctccagtacgcgctccatcatcgagacgctgtaggttgcccgctttaccagcatgagctaaaacctgtccttcaacagaggcttccggcgaagaaggctgccactttttaggaacttattttcgctttcgagctcgtgtatgcgcctgttcactgcgtcgagctgcttgtgctcgtcggtcctttcctgggtcacccttttggtctttgagtgcttgatgatctagtcgtttaaggtcttgtcgttgatccttaagctctgcggcgcattctctgatgctcttcttcgggttggccttacgtgccttcctgtagtagtcgacagcctcaaggcaatacttcttcagtgtagtgtttgggtgtttccggcttcgtgcgggactttgccttctctatctcgcttgcgctcaccgacatctcatctcttcaatctgctggtgttggtaggtgggtatctggacagagcatatctgctgccagtccctgagtcccactgtccaccaaaagattacagctcatctatcctcttcccgagctctcggattcgagctctgccactgcatcgatcttctctgcgatgggccccggcctcctggagatgcgagccttagacaccttcctcttctcgggcgcgagctcgtcgatccatttcgcgagggttgcgttcgacttcggatatctcatggcccgcctcatcctcgagaggctccttccgtgctccaggtagtacgagacggcagactgcatctgcccgtcgctgaatgcaggggtgcgcggttccctttccgggaccttccccatcctctcgtattccttccaccacatccttaagcattgtcctcgatggatagccgagctccgctatcgtgtcagcgctgctgtggtcgaacctgatgtatgtctcgattgcagcccgcttctgctccatgctgtacatggatcctcctacaccacttgcgtaagggctgcttcaggtggacgttatccacgctaataactgaggacccccagcataaccgcaggagttcctgtagcctccaaaccgtacaatgaggatgcaaggttgatgcatccgagagggcaaagaaagagatggcgaaggggcactcaggcgctctgagtaggcgcgaatgcgagagcaaagagacattgatgggccttttgaagaggttctcagacgagaagtcgtgcgaggggaggctgctcgaggagaaggtctccggcggctttgtctgcccggtgtgcgccaatacgtcctgctcgaaggtctgaggccgcgcgcacaagtggcagtgcacgaagtgctcgcaccaggtgagcgtgagcgcagggactattgatggaggggacccacctcgagctcaggaagtggttcgtgggcgatatggctcatgtccgcccagaaggcaaggatcagcgcctgcgccctgcagaaggcagataggctgcagcttaaagacggcagggcgggtccttttaaggatatactcgcctgggtcagatcgcagtgtgttcagtgtccttgcagctgacacacacgaggtggacgacttctatatcggcgccaaggcaccaggcaaaagcgggcgcggcacaaagcagcagccgatgcttacagcggcaggcagagctgctgccccctgcgctgcgcaaaggggtgctcgaaagattgctggcgccaggtggggcatgaccagctctgccatacatcgaagataagggcggatggctggagcggcaaagcttgccggcctctcctcgttttgcgggctcgtctaaagggagtacgacagagcggacggggatgcatcccttcccatggtccacagggtgatatccaacttcaaggcctacgttgagggcgccttccatggcctttccaaggcccacatgcactccttatgcggactcactcagctaaagatacagccacagggatgtaagggatggctgcatggagctgctgcatgagatgtgcctcatccatgttccgctctttggcatcgcagccaccgcgacggtccagccgaagatgccttcgatcttgccttaagccgcttacagttcagggagcctaactatgctggaggtactcagctatttcttgcgaatcccattgtttcgccaaggctcttcctcaactaatggaaagcgattcggaaacgtgttgagcgaagaggcagcatcttagaccatatcaacaagatgcacagcagcattcgggctaccaagctccaatgcaatgtaatgagctatttctgcaagctgacttttcgcctgccacgtcatctctatttcgaaatgagctacatctacgatgtcagctccttcctgacatcgttaagcgccgaatggagatcctcggagtcaccttcttttgcctgacgcagccctgtatccatcattgcatcgaactgttcttttgacatctcgtctcgagagagcgggcgcgcagggagggaaacatcgaatggtatcctgcgccgaataataatctgccgatagagcatattgatgagcacagatgcaggtacgccaagttcatccagaatgccctctgcctcagacttgatatcgggctcaactcttgcgactacatttgctgtctttgctgccacaacttatcacctctagccattaatagtataatatttgttatacacaagcaatacattgtttatcatactggcagatatatctgctgtcaaataggttttctgacagtttagaagtgtggtgataggagcataggggccggcgtgaattggtatgattgtcccgccaacttagatttgcccgggcgtccatctgctcctaagtttggcgacgtcccgactggatgggcgcctgggcggtgcgaggatacaaaggagaagattggcttgagaccttcgaggaggtcgcaacacggcacaggtccgcgccgccgtgccccttatgcggcgggaagcactacggcgccttctcgagggccatattcgacgacttgaagaaggacctgcccacctggatctccttcatcgagtcgatgtgctggaacgtgcctttaagggacatcgcgaagatttgcgggctgaaccacaagattgcctacgagtggcgccagcgcgtgtttgcgaccgtggacggctacgggcaggcccacaagcgcggcctgcccaagcaaaagctgtgcatcgccgtggccatcgacgcctgcaagcacgcgctcgtcgtcggacacggcaagccttcccgcgtatcagggatagcctgcgctctcacatcgccaaggggtcaaccgtggttggggacatggagaaagtcgcacaggtccccggtcagggcggtcaaaggtgtgcacgaggcctacagggcacacgtcagtgacccgcaatacctcgagtgcatggctgtcgtgaataagctctgcttatggctcaaacgttacctgtggcactttaccggtatggacccgaagagactgcagagctacctgaacaggtaggtgtacctgttcggtgtcaaccagtcgtacgacaaatggccgagattggaaagggtggtgcgccatctgatgatggaggacgcgacttaccgcacgtcagagccttgctaggcacaccacacttctaaactgttagaataggttttgtcctgtgaggtcagtccacagtcctgtcccctgcgatatccgtaagttccgagatgatagggatatgctgcgggcaggcatgttcgcactggccgcagcggatgcaggcatctgcaaagctgccacgtcctgcaatctctgcaagtgcttcgcgggactcctggatcttcctctctctgaggcgcaggttctccgttgcaaagatctcagggatgggaatctgcttcgggcagccggaggtgcagtagtggtatgccgtgcacagtataccggatgagcgtcccatgagctcctgtgcctgtgcgatggcagcacgctcttttgcgtcgagcggtttcatatctttcatgaatgaaaggttgtcttgcatctgctgcacatcggacataccggagagcatcgtgagcacacccggaagcgacacagcaaagcgcagcgcccatgaggcataggaggcgccgggtgccactctgtcgaagagctcgcgcacagcgcgtggcggctttgcaagcgcgccgcccttcaccggctccataatgatgatggggatgtggtgggcacgtgccacctcgtagttcgcgcgcgagacgatgcgcggattctcccagtctgcatagttgatctggagctgcataaaatccatctcgggatgattgtgcaggatctcttcgaggagctcaggcttcccatggaacgagaagccggcttcgcgtatgagcccctgccgcttcaggtcctggacatagtcccagatatggaagcggtcatagcttcggtagttctgctccatgagaccatgcagcaggtagcggtcgaagtatcctgccccggtccgctctagtcacaacaattcggattcttaggtaaccgcatagcgcactcccagtcgtaccgagggaggaatgcccaatctatcaggcattcctccctctttctgtcttgatttcccctgcctttccgccgctgtggtataggcatggtgttagatatgctgtaaggctccatgggtaggtactccgtgccagcaaagatccgcgcgatgaagccgaaaggcactatggtcaaggcgatatcgggccactactgtgtctgcgagtaccgcagcgtacgtgagggcaaaaggcgcaggacaaagatgggccgctgcatcggcaggatcaccgaggcggagggctacctcagcaatgcggggacgaaggtcgcaaacagcgagcttgcctgcgtcgagttcggccagtatgcaatcgcgcttgcctgcttacaggggacccttaccctgttcaggaagcatttcgcgcgtgccgatgccgacaggatatatgcctgcgcgctcatccacttcgtcgagggcttccagcgcatggtggcgctcgcgaggctctacaagatgagcgtgctctcgcttcaggatgcccgggctgaagatgggatacgatgcgctcttcaggctaggtcctcgggagcaggacctgaccgactcatgctcgggcgaggtggccacagacggccacgtgataggctcgcgctcctgcaccaacttgcttaccgagaagggatacaggctctaaaagctcagggatccgcaagtcagcatgctcatggcatacgacgtgcgcaccggcatgccgctgctgtcgcgcatgtataagggaggagccgcagacggcgtctccgtgagggagctcttttggcaggcgcgtgctgcacttttgcgacctcttacagcaggcgcagatccaggcgaactacctcaggcacatggagatgggcacgtccgaatacacgcaaggagaagctcgatgcgatgctgccctacatgggcgtgacgctgctacaggcaagcctcgggagcggccggacggcccaggacatatggtcgctctacaagaggcgctggtccatcgagactctcttcgactacttcaagaacggccagggggcggttgccctcggccagcaggactactgccgcgagcagggactggcgttcgtcctgctcgtgagcgccctcatcatgcgggaggtctctgacgccgcgcaggcatcggggctggggatgtctgtcggcgacatcctgctcgatgccaggatggtcaaggcatgcaggcgcttcggaaaatgggaggcgctcaactgcaagaagaagcggctcgagctcttctcgaagatgaacacgggcctggaggtcgtccccaggccgggcagcatacctagcaatccggatcgttgtggctagtggtgcccgagctcgagaccgcagagagtggagacaatcacgccgagggcccctgcagccgccttctgcgtcggcctgttcgccaagcctctcctgccatgcctgcctcctttaagatcgagcgggtgtgtgagggggcggttatgccttgcgctctatgtagcgcttcaggcagcggtgtatctccctggtgcagagcccttctttgcgccttcttttgtgcatatacgatggttctcggatcgatcttcatactgtggatggcaatcacgtgcagcaccctgttcgcgcacctgtcccctccgcggtagagcctgtggcgctcgctcccctcgatgccttgaggggtgatgtatcgcacagtgctgtgaaggccgccttcgagcgcatgcgctttgggtttccccctttgcgattgccacgtcgctgcagtcgacagacacctcagacgaagcgtacctgtacatgatgctggctgtgcccaaccctgcaaaggagatgtatgaccacacgaggctctcgtgtaccacatagagcgcctgcagcgcagccctgagtgcatctgcggcatcgcccttgctgcagatgcgtttgcagcccgagcgtgacgacctcgtagcagggaatgccccttccggcaagctccctggccattcctgcgctgcacgatccgctgcaccccacgcctgccgacatcgagatgcttgtggcaaagatcctgtctgtggcctttcgctgttgcaggcagctgctccaagcacagctttctgccgcggatgtcgacgacggagagccagtttgtatctgcatgcgtgtcgcctccagcccagagctccccttcgggcacattttc

SEQ ID NO: 387 - DNA, 7738 bp, Unknown
  Metagenome-assembled genome
tccctgccgatctctgccgcgatataggcgattgaccttccctctgcatgcagctcggctatgcagtccctctcctgtaggcttgagatgcttgtagtggcacattccttttagcttgcgacgttgactgagacaaccaacatcgtagccttccggagtgtgccacgcttgcattcagcgggctatcctgttgcacttagaatgctaatccaccgacacaaaaacttgagatctttaagctacattggatggtgatatctgatcctcttctgatataggtttcgttctttcaaagaaagcatctactaccttcgctggaattttgttgttgatcgttgagtagggacgttttctgttgtagtagccctcaatgaattcagctagcgcatgtatggcgtcctttcttgttgtaaagccttctcacgagtacatctcgcctttaagagtggcaaggcactatcgcagcaggtaccctaagcggctgcaggagagcctcacatcggttatcttaagcccacagagcagacaagcctaagaggtgtattgggcacctttgtctgaatgaaagattgcattttctgccacatatcctcgacacctagccacttgcagtgtatctagcacactatcggctcccgttctatccaacagcgatcaagcccaccaccatgtaggtgtttaagtctcacacagcaagaaagatagagccagcccttttctgtggagagataggtaatatctccaacaagcttataggtggagtcagggctttatgaagtcacaatgtataagatcaggctttggtttggcatatctgtcagggacagtggttctcttctgatctgtaaaggggtgagccctttatcttcaagctcgcgcatgcattttcctaccctgtagagggtagtgtgggaaaaactcatcagctagatagcagtgggtgtagacctagccccaaaacctctgtcagagtccacccacgcccgccagatagcctctttaagctcacctcacctatttctgtggtgctcctgcgaaacacccatgaataaaagcttgagcgtaataccttaaggattaaagcctgtatcttgatcgggaagttttccttctcctcaagcacctgcttgtaacaatctattgcgcttaagatcctttgtgaagaaggcttaacagctgcctttaagaggctcttcgacacgatgtgtgaatgaagaatatgcgaatgcacaggtggcaaggcacgttctcctgtaagtttttaggtgtgaagtaaagacccggcaaagagggcgcaccgtgtgcatttcaagctgagccaagattatgatcggcatcgagaatatcgtcgtgcaggatatgtccttcgacgaggacgcacagacgataaggccctacaggccccactcctgcagatgcggcaagtgcgggcagaaggccccctgctacgatgcaggcaggggaaccaggcgctggagatgtcccgatgtcgtcgggacgaaggtgtatatccaggcggatgcattcaggatgagatgcccaaaatgcgataccgcggtgcggaagctgccctgggcagaccacagaagctggctcacccgtgcctttaaggacacctgctgctggcttgtgctgtcgatgagcaagcttgcctgccaaaagcttctgcgcatcttgtggaggtgggtgggcgcgatatgctcgcgcgtgctggcaaggctcaagcaggggcagccgccaaggacagcaggcctcaggtggataggtgtggacgagacaggctacaagaagggccacagctacatgacgggcatagccgcaaggtcttcgacgccttcttcgagcagatcgccgttaagggaagggagcccatcgaccttgtgagtgcggacggggcgtgctgggtggacgatgcgatgaaggagtgggtggcacatgcgctgcgctgcacagacaccttccacatcgtccagcgggcaacggagctgctcgacgagctgtgccgccagtcatggagaaaggctgtgcaaaaggccaaggcagcaccgaagggcaggcgcgcccgccccaggaggggagaggaggcgagccccgaaaggaaggccgctgcatccgtgaagggcccaagggaccccctccttcaagaacccagagagcctgaccgaaaggcagaaggcggcacttcagctcaccgcgatcttgcagccgcgcctccacagggcatatctgctgaaggaagggataaggcttgccctgaagctgcctgctaacgagatcagggagggcatcgggaagtggaggggcagggcctggcgctcgaggatcccccaagttcgtcgagctctaaaggaagatcagaaggcatctggatgccatcgtcgccaccttggagagcggcctgtccaacgcacgcgttgaggtcatcaacaacaagatcaagctgaccgtgaggatggcctatagctttcgcagcctcgacaacctcttcgcgatggtgatgctcatatgctcgggggtgaaggtaccgctgccggggagggcctagcgctcacatttcggttcacacattgtgcagatgcctcaggatttaagcctatatcttgatcgggaagttttccttctccttaagcacctgcttgtaacaatctattgcgcttaggatcctttgcgaagaaggctgcggctgcctttaagaaggcaggttccatctcaagctcttagctgcgcttggcataaggcttttgagcttttcctctttagcctcgctgcactaagcagctgatagcctatctcttcgatcttttacccagcggatctgtgttttgggactttagccctaacccggtggtaaagtggcttttaggcttgccggtggagatagcacactcagctgttttcaggcgctactcatcgctgtatttggtagcgggattgtttgccacctgtagtcctttcggtcggcttgtcttgcagttaagaggagcctcataattcctcaagccgcactgtgcgaaaaaatgatacaggtcactcgtctttagagaatagctcgaaggcataaagtcgctcgagttaaggcgcgcaaggctcgagcgggcctgagaggagcgtggcgccggggaggacatggcgcttgtagtgtcggcgctaagatgcatcaaggggatatccaccgtgagcgccttctccatcgcagccgagatcaaggacttctcccacttttcggatgcatgctcgcccatgtccttcgtggggctcgtaccgtcaaagtccttaagcgggaagagcgtctcgcgcggaaagatcacccaaacgggcaatgtctatgtgcggacccttcctgtggaggcggcatgacactacacaaggccccaaggccgatgtcggcgccagccatgggcagatgtcgcgcagggtgcccgccgggagagccgcagacttcacgaccgctccgtccatctgaggggccgcctcaagcctgccaacgtcgtggacaccgccatcgcccgagagctcgcagggttcgtctgggcactcaccaggatgggcggatgatgccgctacggcctgacacaaaagtccttcctagaagcccgcgcctggctcgatggtgcgtggggcaatccgtaagacctctgtgtgcagccttcaggccatgcgcgatcctagacacgccataaaggcgcagggtttccaaaggacgatatagagccagtcctatcccggagcagaatccgggatggggctagcgtgcctcttgacaggaagttctacatatcagaggtagaaatctaccccttcgtaatatggccccatcctttcaccaaaaatgataaatgtggcttgcggaaatgtgggatttaggttattcttaacaatcacttgcgggcttggcgcagttggtagcgcgcaaccttgccaaggttgaggtcgcgggttcgaaccccgtagcccgctccagtaattttcccagctatcctatcaggtagcttcttatactcggcgagatggccaagtggtaaggcatgggcctgcaaagcccctatccccggttcgaatccgggtctcgcctccagaaatgtcaaaggtgaactgctcaaagcagttcacctttttgcttactatttattatcgatcatcttagtgagacttactgcggtgcccttgccccctgatttcatggatatcgacacctcatcggccagcatccgcatcagctttatgccgcgtccccgctccagcttcatatcggtgggcgtcttcggcttctcattggccctcagttggtagccacagccattgtcgctcacctgcacgatcacccgatccgggtaatagcatacggttacaagcgtcagtctcgatttggcgtggtcaaaggcattacctaaggcttcgccacacgccagcgtcatgtcaaacgtctcatctgaggtaagcggtgtctgcaccaagaggtctttgactctgtgccgggatacggacatcgagcatgagtcacagcgcaggacatgccaccagatgggttcggtacgaggatcaagtgcagggacctgtttggacacccctgcacgcgatactggagcgaaatcaaccgccttaatgcgacacagagtacggtaagcctgatcccccacattcgtgagggagagcagccctcctgttttcctcatggctctaatagagcatagaatcagtgccatgcctgctgaatcaataaattgtgccttacctaaattcaggatgatgcgccggcaccccgtatcgatcagatacgaaatcgaggcgtacaggcgtgggacggacgttacgtccaggtccccctcaaccggaatcactgctatatcacatgaacgttgcatataattacttgttcccacctgcgagaacttgtaacttggcaacgctcaaaaacgttacattctgtctattaaacggtagaacttcaatccagtgtcgcctattgcgtagcaccgctctttttcgaccgtttccctttgcgggaggtagtgtctgactttttgtctgtcagtccactctgttccttaggatcgtcaaagcgcaccgccaccattgccacgtcgtcgtcgaggttgcgatcggtaaaggtatcgagcccttcgagcaaccggtggaggatgccgtcaaagccaagcggtacctgcgccattatcgcatccctcaggccgtcctccccaaagaagttcccctggggatcgcgcgcctcggtggtcccgtcggtgtacagcagcaggaaatcgtccttgccgatgtggacatggccgttgcggtaatccatatcctcaaaggcgccgactacaccggactgcacattgagcatctccagctctttggtggaagcccgatagaagatcgcaggtggatgcccggcactgcagtaggtcagctttgcatggtctagatcgataaggccgataaagagggtcgcaaaggtctcgatacggctgaaaccgagcaggaaatcattgagtgaccgcaccatccgcgccggagacaggccttcccaggcatacgctccgagcgccgtcttcaccgccgcagaaactgaggcagcctccacgcctttgccggacacatcgcccataataacggcagctttacggtcaggcaggcggatcagatcgtagaagtctcccccgacgaaggcatccttcgtggcagaggaataaatcccatcggcagacaacccatccacatgttgtagctcgtttttcatcccgagctgcagagcctgtgagatatgtttgtcctgcatccgtttggcggtgccggtcataatctcgaccagatcctcggtgcagcgatggacaaagccgatctcgtcggaatccagcggctctgcatcctgcgggcgcaggatcatgaatgtcatcggcttctcactgatcttcccggcatccgccaagacgcctaaggagaattccccgatatcggtgagccactggtttaagtcagagccatagctgattgcgacgaccgaaatttccccattgttgtgccgctgggcaatcttttcaagattcaccgggatcgcacgcatccccatatgcgggagatgggcgataacagtaggaccgtactcgttgacctcgacctcagcgtacagacctctgagcgccgctgcgacacctgagaggaaggccttcacatcgtcgtcggtcggctcgcctgtggcatagagcttttccctcagctcattttccgccgtttcaagccaccgcacatgttcggtcctcatctgcgtaaaggcgcccatcaactgcaccgagagatagttaccgacggcctcaagcatctgggcatcttgcttggtcgtgggatagagattctcccatccgacttcgatgatgccgacgacatagccgccaaaccaaatgggaaccccaatcagggaggtaaagggtggaagcaggttacgctccatctgatagacctcgtgggtctcctcattgagcagggcgcgtttggcatgcttgccggcacgcaggctttcggtatccggaggaaggacccttaggcgcagagcctggatcgagcggagcaacacctgagctaatcctcgctttgtcgagagaaactgcggcacgaaagcgttctttagtgacgccgttctgccacgaaggtgaaggccatcaggctctgcgatatagatgacagagcctgccgcctccatcgtatccgcgatctcctcaagcactcccccgatcagctcacctaaatcatcgcagtcaagggtatcgagcacgattctcagcgtccctgagaggcgccggttagcccgctgcagttcctgtaccgaacgttcctgttcgtgctctacgttcgcctgaggatccgcccgatgtgccacacacacgtaggtgtcgctcaccgcattcgtcttctcacagcggacccacagctcacacgtctttccgttggcatcctgacaactgacaagcgtcgtggacccatccagcggaaacgggagcgccaactggctcctatccccatccttatcgggaatattcagccagccgcgtgaggcgcctgtcgagaagattgtggtgatcggttggccaaagaggcctgaggcgggatgacgaaagaggtgctccgcctcttcattgaacaggatgatacatccccgttcatcgaaggctatcaccgcgtcactcgtgagcgccagcaccgatccgaatgtcgccggaatcaaagttctccctaaccggtcgatactgggcccaatagccttctttgccatcccacacccctcattgctttcatcaaaagatataagctctgccgttaagtatagcggtatgaaaaagggagccccgaagagctcccccctcacattctggtgtcggaggcgggacttgaacccgcatgaccgtttagttagtcactagcacctcaagctagcgcgtctgccaattccgccactccgacttataacatgcagagataatagtaccacgcgcaagcctgtatgttcaacacccattttgaaaacagcctagctgttttgccaaccgatcacggtaggctcgagtgattggaacagtgccgggccgtagttggccaggttagccttggtcacgacaacatctgggccggagaagataggaatgaaggcataggactgctggcacttcttctctacctcgttcagtgccttgcactgctctgcatggtcttcaatcgtgatgattttggaaagctcttcatccagctc

SEQ ID NO: 388 - DNA, 15645 bp, Unknown
  Metagenome-assembled genome
cgatggaagagggaggagcactcgtctcgagctctcccaaggctatcggctgaccacgaacaaccgtatggaactgctggcggtgatcgtggcactagaggctcttaaggtgccctgtgcggtgaagcttcattccgattcaaaatatgtggtgaactctttcagacagcactgggtcgaagactgggagcgacgtggatggaagaagtccaacaagaagcccgtcgagaacatagacctgtggaaacggctgatgcctcagattgagcggcaccgggtcaccttcatttgggtcaagggacatgcaggggacacctacaatgagcgctgcgacacgctggcggcgggtgcggcggatgacaaagcgcacctgatcgaggacacgggctaccgcgcctaagtcctcaccaaaaactctgaatttgttcactttgtgatgtttgccgaatggcagttagccactgcttacttaaataggaagacggatagaatatctatacccctatggggtgtaaaaatcagttaccaacaggcagagggagacacaccatgagctcagctgacgttgttattgtgacgctggttgtcgtcgcgtttgcatttgcattccatcatgcgatccaggtcttttcaggcaagaagagctgctgcggcggaggtggtggcggctcagactctcggttccccgaagcacacatcggggatacggacgagtcccactacccctatacggagacagtcaagatccgtggcatgcactgcgaaaactgcgcacgcaatgtgacgaatgccctggattccgtaaaaggcacctgggcgaccgtcgatctcaaagatggttccgcctatatccgctccaagtcaccgattgacaaagacaattaccgtgatgctgtcaagcaggcagggtaccggttggcttagttctcagactcctgtgcgttcagtgactcaactaagtgcgggagttcttgggcgaactggtgaagattaccgcgaaagattgcgcggcgtggatttgcatacccgacataggcagtcggtaacccgatatccggatgcgggaaatcgcgctggatatcgttgccgaccatcaggcactccgctgcactgaacccgatctgccctagaaactcttgatagtagcgggcggagggtttggtgcgcgttgcggtgtcgatcgtagagattgcgacgaagggggcatcctcgatgcctgcccagccaagccggaccatatcggcctcgaggctgaagagcgtgttcgtcgccagcgccatggtcagccccatatcctgtactttctgaatggcttcgttggccccgggttccgggcgtgactcaaagaagccttttttgttcatcgaaggcacgatttcggtgtcgtagcagtgcagggcatccataaccataggatcctccggagtgatctcgagggatttccctaaggtagcattgaagagttcccggttggtgaggccgtcggtgcgcttttgattgttgattgtcaggtacgcattgaccagggatccgaaggccgcggggtaggactttcctgagatgtcggagaagatatgggcctgccctgagatatagcggaagaggaaatattcgagtctgatgtccagtaaggtgtcatctaaatcgaacaggatggccttgatcatcaatcttccttgtcttaggttgtgcgtacgttattcggtgcttcctataacctggttttacgcgctcagagagtgctactccccgattgtataaaactctcataaatgaataacgtagggtgaggcatcagcacctaccagttaaccatctactctataattgtacatccgcggaaaaaatatctgaaattatgtcgtttagcttgcatttagtgcctgaaacacgatactcttaacagtgcataaaaatcatgcaactgtatctattggcccccaagagcatgtacgttgaaaagtctatggtatttgctacgaacacaatagcggatagcgtgacaacggcaagcatgacaccggggccccgttttcgaaaggggtccacctttgagtgagattcagaactcgtccgtcttttctcttgacgacgtgtccaatgaggaaatgaataaactcattgacagcaacgtcacagattttgatgagggagatttagtgaccggtaaggtcgtcaagattgagcatgatgaggttctgcttgacatcggctataagtcggagggcgtcattcctgcgcgcgaactgtctatccgtaaagatgttaatcctgcagacgttgtaaaactcggcgataccatcgaagtcatggtccttcagaaggaggacaaggaaggtcgtctcatcctctccaagagacgcgcggagtacgagcgtgcttggaaccgtgttgaggagaagttcaagaagggcgaggatgtggagggcgaagtcatcgaggtcgtcaagggcggcctgatcctcgacatcggcctgcgtggcttcctgcctgcatccctcgttgatctgcgcagagtcaaggatctgaacgcctatctgggcacccgtattgaggctcgcgttatcgagatggatcgtaaccgcaacaatgtcgttctgtcccgtcgtgttgtcctcgaggaggcccgtaaggctgagcgctccgagatcctgtccaagcttaagcctggtatgcgtctcaagggcaccgtttcctccatcgttgacttcggcgctttcgttgatctgggcggcatcgacggcctgatccacatctccgagctctcctggaaccacgtgaactatccgtctgaggttgtccatgtcggtcaggaagtcgaggttcaggtgctcgacgtcgatatgaagcgtgagcgcatctccctcggtctcaagcagaccactgaggatccttggagaaccctggtcaagaagtacccggtcggcgcaatcgtcgagggcactgtgacaaagctcgtcaccttcggtgcgtttgtcgacctcggcgacggtgttgagggcttagttcacatctctgagatggctaagcagcacgtcgacacgccttcccaggtctgcaaggtcggcgacaaggtccaggtaaaggttatggaaatcgaccttgaccgtcgtcgtatctccttgtccatgaaggctgcggctgagacgctcggcatcgacgtcccggtgaagccggcagagaagcctgaggatgacacggcagttgacaaagctgataaggctgacaaggctgacgagaagaaggacaagtagtacttcatagtcgtcatatatggcagattgagtgggaggtcctggcatgtgctggggcctcttttagtcttctgattttttattgacggggcccacctctgcagtagggtgaagacggtttgaaagaggtctgtgaggtgaggggtacgatgccacatgcaataacgcggcgctcatttgtaaggggtgccggtgcactaggagcagggttggtcctctccggcctcaccggctgcggcaaacggcgtgcgcggagcgatatgagccccactactttgcggaagatcctgcgctttgggcagggcaatgcgcacgaggtgctcgatatgcagactgcggctaatacgctgactgccacgatctctgactgtgtttgtgagccactgctgaagtgggaccaagacaatcagttggaaccctgtttgctgacctcagtcccgcgctttgagcatgacggagtgaccctgcactgtaacctcaaagagggagttcagtttcaggatggcaccgagctcactgctgaagacgtgaagtatacctttgaacggatgttcagacctgatacccaggcacgccgtgcctacctctacacccatatcgccggagcaaacgagatgctctcagagcgtggcgattccctcgacgaagggatcacgatcgaagacgatactcatttcacgtttcacctcacgagtccgtttgcaccctttatcccacgcctgggactgccctgcgctcagatcttcccggaagatgtctgcgagcaggccggggatgactggggggacggaaccaactttctggggaccggcaaatactacctggtgagcaacgatgaggacgaagtggtactcgagcccaatggttactaccacgagggtgaaccactgctcgatgaaatccacatcgtgttttttgaggacagttctgacaaactcaaggccttccagtacggccagattgactactgcgatctgccgaccgaacttctgacacagtatcaggatgacaaagacgtggggccactgatcactccctacgacacccttggggttcagctggtgaatctgaacttatcggacacgatggggctcacaaattcgcgaatacgccaggcgctctcgcttgcgatcgatcggcagacgattgttgatacggtggccgccggctccggcacggtctgttcaggttggctgccgccctcaattcccggttacgacagttccgcccccgctttcgcctacgatcctgaccgtgcccgccagctgttggaacaggaaggggctacctccctgcacctcacctcccaggttcgcaagggcatcaaccagcagcagctctcacagatccagtcaatgtggcgagacgtgggagtcgatctcgatatgcgtgtggtcgacaacggcgcgtgggcatcggatgtggcggacgggacgctgcaggtcacaacgctgggttggtacgcctcatatccgagtgccgacgatctgatgtattcctacttctatgcgaacaatgctgccaagcgctcctcgttctacaacaacccacagttcgacgcgttggtcacgcaggctcgcaagacgatgaaccctgccgaacaggcgcggctctaccagaaggcagacaatatcctcacccgccaggattatgcgaccttaccgctctactggccccaaaaccagttcgtcgcgcacgactatgttctcaatgcgaaggtggccaacttaacctatcacctggaggatctcgatatcgacacgaccaaagcagactattcagacggagtatctgagtagctgacaaattgttttgtttctttaattcccctatcaactgtaacgtctgaaagtgaacgtcccagggtgtcttgttagcgaggcatctattcggtcttaggttggtagcattcgtatagagctgtctgacttcagataaggtggtatcaggaaagcttgtacgcgttgggagatactcttagatagggccatgagtgtttttcaacgctcgctttttgccacgggtgataaggcagacagaagagaagctcagctttcagtgtctgtgtgacatctctgtgctgtgcagatctctttgtctctctttggtgtgctggtcttgacaggacaaccaaatacagcaagctttcctgtctcagctacagcttgtgctgtatgtgtctgtgcaaaaggtagcgcttaggtatcttgtgcttcctgccgacaagtgtgaggcccttatctttcccacagtgtgctatctgccttctcagtctttgatcctttaagcgctcctctgtcttatcgggtctgtcagcgacatcgcggagaactcgatacgtataaggccaagctatctttaagtgtgcgatcactgatagctctgcagagcgtggcacaggctacaggagatgatcccctctttagtgtgggccttcctgtgatctgttgtggtgatagctgacagttgacagtcttgtcctgcacacgggcacagagactcttgagacttcactgcctgcatctgttgcagtgcccctgtgcaacagatgcctctgtatcgcatatcggatacttcccggttgcatgagcttgttgcagacttacaagctatgatcgacttgttgcaatgtagctttctgacaatcttgggatatgtctttgccttcagtgttggaaagcaggacatcttctcgcttctctaagctaagatgatggtagcagcccatagggtaatcccctttgattattttttcgcagataccatcgcattgtgagagaccccgggtcgctgttctttgatccttgctgttgcactagcaatgaggatacaccgtttgtatggtttgtatactgctctgtaatgtttggcctgtattctaaagattgatgaacaaaacagttgtgtggtgagcgcgctttaagggaaagcgtgccgccttattctatcctttaccacctatagattggagaggagcgacgatgagaagttacctcataaagaggatcctgcaggccctcggcgtcattctttgcatctctgctattaccttctttgtactcaacatcgtaccgggcgatccggtccggatcatgatgggcgagatggcagacgagaatgtggtagagcaggttcgccattcgatggggctcgatcgacctgtcggagtgcagtacctcacctggattggcaatatgctgcacggtgacttcggtacctcctatgcgcagcgccgaccggtgatcgtgttgctctcgagtgctgtcggggtaaccgcaaccttagcgacctttgcctacttgattgcgcttgcggtcggcctgatcttcggtgtggtcgccgcggtcaaccatggtaaggctgcggaccgtatccttatgtcgctcgctatcttaggtatctctgcgccggctttttgggtcgctatcattctccagatcatctttgcgctgaacctcaagtggttcccgctctccgggactaagagcgcaaatgcgttcgtgttgccggttcttgcgctctctttccgctatgcagcctccatcgcgcgtgtgacgcgcacctcgatgctcgatgtcctgaatcaggactacatccgcactgcagaggcgaagggcctgaagagatggtcggtgattttggggcacggcttcagaaatgctttaatcccgatcatcacgatcgcaggtacgcagctgggtgatatcttcaccggttctatcctgatcgagtcgatcttctctctgccgggtatcggtaagctcttgctcgatgctatcaacgcgcgtgacctgcccctgattgagggtggcgtcatgtatgtcgccacgatctgtgtgatcatctatctcgtcgtggacattctctatgcgattgcggaccctcgtatccgtctcggcggggaggcgcaggagtaactatggctttgcttcactcagacaaaaaagataagaagacccaggaggccgagcgcatcgccgactcgatcaacgaggataacctgcatgccgctgaagcggtgggcactccgaaggcggctaccaagcgggcagagacctactggacggtgtcctggaggatcctgaagaagaatacagtgggcatggtgtgcctgtggatcattgtggcgctgatcgcggtggcgatcctcgcgccgctgatagcaccctatgacccggacacacaggccttaaaccagatgctgcaggccccgagtgccgcgcatcccttcgggaccgacgagttcgggcgggacatcctctcccgcgtcatctatggctgtaggatctccctctccgtcggcgttgtctcccagctcatcgcttcgctgatcggcttctttgcgggggtgtgcgcaggctacttcgggggcaaagtggacgcggtgatctccttcatcatccaagtcttctcgagcttcccgttcctgctcttctcgatcgtcgtgatgtttgtactcgggccggggctcgtaaacctctatgtagccttaggacttttgatgtggtgtacgacggcgcgcctggtgcgcggcgatgtcatgcggatcaagagctccgaatacatccaatcctgtatcctttccggcggcagcagttggcgcatcattacccgtcacctgcttcccaacgtggtctccacgctgatcgtgactgcgagcttggggatcccgtcggcgatcatgagcgaagcctccctgtccttcttggggctcggcgtgcagccgcccatggcaagctggggacagatgatctcagcttcgcaaccctacatccaatccaacacctactactccgtgattcctggtattgcgatcatcattaccgtaatggccttcaacctcttcggtgacgcgctgcgcgacgcgctcgatccaagaatgcgctcgtagggaggggactatgacagacacactgtacacgatgaccgatgcagacagaaagtatgctcagcagcaggagattgctcagggcaagggcgttctgttgcgggtcagtgacctctgcgtgacgctttacaccgaggacggcgcgctgccggcgctgcagcatctgaacttcgtgatgcgcaaaggggagaccttgggtgtcgtgggtgagtccggttgtggcaagtccctgaccgccctctccatcatcggccttctgccgtccccgcctgccaagatcaccgggggctccattgagctcaacggagaagacttgacgaagctttccgaagaccagatgcgaacataccggggcaaggatatcggcatgatctttcaggagccgatgacgagcctgaatccggtcatgaaggctggggatcagatccgtgagggcatcctcgtccacaatccggccatgccaaaagaagaggctagcaagcgagccttagctatgatacgctcggtgggtattccagcaccagagaaggtgtacaaaagctatccacacgagctctccggcggcatgcgacagagaattatgatcgcgatggcactggcctgccagccctcgctgctgatttgcgatgagccgaccacggcactcgacgtgacgatccaggcacagattctgcagctgatcgatcgcatgaagacccagacgggtaccgcagtcatgctcatcacccacgatatgggcgttgtatcagagatggcagactgggtcatcgtgatgtatgcgggccacctcgtggagtatacgatggcaagtgcgctcttcaccgagccgctgcacccctatacgcggggcctgattaactccatcccgtcgctcgataaccagatcgatacgctctacgcgatcccgggcaacgtacccatgctcaacgagctgccgcagggctgccccttcaacccgcgttgcccctttgccaaggatatctgccgtagacaggtaccgaagctggagcaggccaaagaggatcgatgccatctggttgcctgctggcgctaccggaaggaatggggtgagaccaagtgagtgagaaggacaacgatgtgatcctgagggtcgagcacctcacgaagcactatccggtgaacaccggcgttttctcccgtccaaagaaggtcgtccatgccctcgaggatgtctcttttgaagtccatcgggatgagacctttgcaatcgtgggtgagtccggctgcggcaaatccacttgcggcaagtgcatcctgcgcctgactgagccgacctcaggcaaagtgtacctggatgcgaaggacttcacatccctcaaaggggaggagctcaagcaggagcgcgcgaagatgaagctcatcttccaggacccctacagctcgctcaatccacgtatgacggtagcagacatcatcgctgagccgatcgatatcgccctcacttacaaaacgaaggaagagcgggacaagagggttgaggacgtgatgcaggcggtgggcctggaccttgagttcaagtaccgctacccccacgagttctccggagggcaacgccagcgtatcggaatcgcccgcgcgatcgtgctggagccggagctagtgatctgcgatgagccagtctccgccctggacgtctccgtgcaggcgaaggtgatcaacctgctcgaggatctgcagcatcggctgggcctctcctatatctttatcagccatgacctctccgtcgttaagcatatagccgacagagtcatggtgatgtatctggggcatatgatggagcttgcaggcaagcaagagctctacgacaacccactgcatccctacacgaaggcactgcttgcagtcgtgccgcgcatcgggcgggagcgcatccaggacatgcacgtgctccaaggtgatgtgccgagtcctacagccccaccgacaggttgtgccttccacacccgctgcccacactgcatgagggtctgtaccgagaagaagccagagatggttgaggtggctccggaccactggtgtgcttgccacctcttcgataaggacctcagcgaggcggagcgtaaattggatctcaacgagactctgctcgaagctgaggaacagacgagggctgtacgataacgaattgcttaagattgttgcaataaaaaggtgaacccgctttttcaagagggttcaccgttcgctaagaaaagaactttgttgtatcacgcctgattagccgttatatgtcatgcctttatagtggaagtcgaccaggatatctagcccatcgtagccgggacgcagtacgtaggggctctgcggccacacgactgggatcgtggcgtagtcctcatggaccagctggtggtctgccttgatcgtgtcctcgttagcctcaccctctgaggtagcagtgcgggcagcatcgacgtaggcgtcgaactgcgggctgttgtagaagctcgaacgttgggacgcattagtgctatagaaataggaagccatatgttccacgcccacaaaggaaagtgtggaccacagtacgagggtcataaccagggaaccattggcacgggcgtcgcgccacatgccggcatcgatggtctgtacatcgacattgacgccgatctgcgaccagtagttctgaagtgcgaccatcacagcctggtcctggcttttcacctgagcagtgatcgaaaggtcgctcataccggcttcctgcaggagctgacgggcacgatcagggtcatagtcaagggtctgcgcggagtcgtcgtgaccggtctccgaaggaggaatgaacccggagcaggggatagcagcgccgtttaagacggtgtctgccagttcctggcggttgattgccagcgagagcgcctcgcggatgcgctcatcctggaagcgaggatcgttgaggttgaggttcacgaactgcgtagcacccggcgtgtagtagacgatatcgtttttgacggaatcatcgttttggtactgctgcagcagtgaggtgctgaagaagcacaggtcgatatccccgttcttgtagctcatcatacgggtattggcatcatcgatgtagataatgtcaacttcgtcgatcgcaggcttaccttggtggtagtcatcaaaggccttgagcaccacttcggtgttgtcgtcattggattccagacggtaggggccggagccgataaagttggtgccagtaccccagtcatcacccgcggcttcgcaggcagcctgcggatagatgctggcatagaactgtgccaacatattcaggaagttggtgtagggctgcgtcagggtgatcgtgaagtgcgtgtcatcctggacttgtacgccggtcagcttatcgctgtcaccattgagcactgcatcagcgccctggatgtaggtgaaggagtccgcttccgcctttttcgagatcagacgggtgagggagtacctcacgtcatttgacgtcagcgttgacccatcgtggaacttgatagcgtccttcagctcaaaggagtaggtcaggcggtcgtctgagaggtcgggcatctgggtgatcaagaggggctcaagctccaaggtcttggtgttgagcgtgacgagcgtgtcgcagatgttctcagaggcaccccaagagttcgaggtgacctgggtgtcgaaggaggaatggggattttcggtaccgacgcgcaggacagttccatcgctctggtcatcagcgctgccgccgcaggcggtgaggctagtgccggctgcaagcactgctgcgccaagtgagcctttcaggaatgatctgcgggtcaccgcaggtgacaggggatgggccagagcggttctgtgctccttgacctcattgtttaaagccatatgctgatcctctctgtgagtctgcatctattgtacggtatagaacgaatagcagtgtgacgataatatccccaaattactaggaattacaagtttccgttacaggcctgaaagcgaaattctgagaagagaggtctgacctgcccgatagggatatgcatcgtatgcgcgatgcggaagagcgcaggcttcggtactgtctgcgattatgtggggaggtgcggcgatgagtttcgcttcggatgcggttctgagatactgcgcgtctcgcagtccgatccaacagtcgatatcacgcaggagcaaaacataccgagtttaaagcgtgagcttgcgatggcagagacggttgtacaggacctaaaggaggttggggcgcaggacgtgtcaattgtcgagcacgcctacgtaacggccctgtggtccgcaacccccaaattggagtcattgccaacctttagcttttgctgccgcctcgacaccgtgtggcagccacacatcgaccgcgtgactccgacggtgcaccactacgaaggcggcaagtgtacgatcgggcatgacgctgaaggggaagaggtgtggatcagtcatgagactaacacgaatttcaagtatatggtcggttgggaccccgtgaccggtgacggaacctcgctcgtgggcggggatgacaaagcgggcattgcagagttgatgggttgtgctcaagcgtctcaaggacgacccctcgatcagacatccttgtatcgcgctggcctttgtgccggatgaggagttgggacacggggtgcctgctggacctcgatgccttgggggcagcctatggctatacgatcgttgcagggcctctgggagagttctgctgcaggaccctcaatgctgcacaggtacaggtgaatgcctacggcaaggcggtccataccgggactgccaagggtctcacgatcgatgcctcagaggcgctgatggagtttcgtgcgataattctgcccccagagcaaccggagtacacaggagggtatgaaggattttactatctggagcgtatggaagggacctgcgaggaggaacacaccacctatatcatacaagaccacgagcagagcctggtggaaaacgcaaggagctcaagcagagggcagctcagtccgcaacctaccagttggggaaggaagtcctgacccatacgatccgcgaccagtaccacaagctggctgacgtggtgactaagcctcagtaccgctacttgatcgacaacaccaggcaggcgtcatggagcagaccatgcatgcgatccccatgcacgcagggggtgatggctctcagctgagctttagaggatttcctcgctacacgaagccacaaacccagagctagtacaacaattgatggtttgcttgcaagcatggtcttttcttcagtttctttaaatgcctgcatcaaaggtgatgttatttggcatcattaaagagatatagcataccggactttggtttttcgatccccgatatggtgctatgaggcccctcagccgcgcttcctgccggcagaggggcctttcccttcaccgcgcagcatgggcgagcgtgcatgaggagattgccttcacgttgcctttggtgaggttgaagtgaagcagcggcagccctgtccttgacgccagctcctcgatgatggggcttctcctggatatgttggcatacctcctgtccgaggtgcggcacacatcgaggccgcgacagagccccatgatgtccttggaggagaagctatctcccagcaccttcatctgcaggagcctcatgagcagcacggcgatgtagcagacgaggaagtggcccgtgattgtgctttgcctctgaagatagacaggcctcgcatcgagcttagacttcatcaccctgaagctctcctcgatcctccagagcctgtggtaggtgccatatatggcgcgggggtccatcctggtcttcgaggtcacgatcatgttgtagccggcaagggccctggccttcctgatcgcctcgtggttgagcatggccgcgaccttcgcgtccttcctgagctcgccctcgccgtcgacgggggagaacgtgacatacttcgcgctgtcgccgtactcggaccttttcgcggctgccgccctgagcgacctcgccttctccacctgccggtctatctcgtatttctgcttcctggcaagcgaggggctgtacgtgacgacgcgcctctcggggagctcgaccttcctcttccttccgtcctctccctctaccgtgtactcgaagtcgccgtccgccatcttgtagcgaaacgatgtctcgcccttcccgtcggggacgtccgtccagccgtcccccgagagcgcccacgtgcgctccttggcagggagcgccttcaccgacttcgagaatatgtagccgtcccctgcaagcaccgcctccgcgatgttggctgcgcagctgagccccttgtcggcgaccctcacggtcctgccggatatggagctcctctccttcatctgggcgatgcatctccccagctgcggcttctcgctctcgttgccgggaaacaggctcatcgccaccgggatgcagttggcgtcgaggagaaggcccatcgcgactgtcggctccggcctgtgctccttcgaggggcccttcctcctgaaatcgtccttgcggtcgatctcgaagtagaagttcgtgcaatcgaagtaggccaaggacatgtcgtggccgaaggcctcctccacgtgcgcattgtagatctcgacgaccttgtcgtactcatcgcccagataggcgagcccgtctcagagctggtccagcgtgaactgcgcatcgatgccctccatctggggcagcacgtcctcgaatgtcctgagcttcgagcagggggcgacggccctcgcatagacgagcgaggagaggagatcgtgcagcgagaagcgcaagcccgagggggtctggagcagcgccatgtcctccgccgtgccgagggccgtgtccaccgccttgagcgcgaagtggccgagatgcctcgtcgccgggacatcggagatctcccgcaccctctccctctccatgccggccttgcgctcggcattcatgcgggccacctcgcgcttgtaatgggagacgggatcggcgatgcccttctccatcagcgcgtcggcatagcccagcgccttcacggacctgtgcgcggtatggccgcgcttggggtcccagtggctctcgtagatctggagataaagccccttcttgttgcgcgtctgcttgaggaagtaggccatctgccactccctgtcaacgtaaagcaccatagcaccatgtatatattctatcagggagcgattcccggatcaagcatacaggcatgaaaaaagccagctcagggctggcttttgcggttccgggccatgtcccgggtcctgaagaatcgtggtgctaaacgctaaagacggggatttcctcgctacacgaagccacaaacccagagctagtacaacaattgatggtttgcttgcaagcatggtcttttcttcagtttctttaaatgcctgcatcaaaggtgatgttatttggcatcattaaagagatatagcatatgatgtacctagtgaggcac

SEQ ID NO: 389 - DNA, 40672 bp, Unknown
  Metagenome-assembled genome
ccgcaatcatctttgtggtagtgtttctcgccctgtttggcctatcccctcaggaacatctcggctaactttaaggttgagcttaataaatgtcgaccgttacaatttatggaccggtacacgttgttttttctacatcgtgcaccagcccattatcttggttgctcggtcgttgatcttatagcagctcctgttttagatttctaaggctcagcgcttgctattgaacctgcgtctacctgataaggctcaaagaccttcttgagccgttttgggatctttgctgttgcttgtaggcccttatccttatattcctcatggatcacctggcagcgctcatgcagcatgtccatcaggattcccttgttatacggcactccaaccgtcatgctcacatcgcctctggaagcctcctgagcaatgtggtagagcaagccacgcaaccccttcttttgaagggctgagatgcagacagcctgtggatagtggcgcagcaggttgtgcagattcgcatcgcttaccagatcacatttgttcaggacaacgagccgtgggatcttatcagcatcgatctctttcaaggtctggttaacgacattcagttctttcaggacatggggatctgaggcgtcagcgacctcaagcagcagatccgcattcatggcttcctgcaaggtcgtccggaaagcatcaaccaacagcgtcggcagcttctgaatgaagccgaccgtgtcagtgatcgtgatctttctgctctcttgtaactcaatcgcgcgcgtcgtcgggtcaagcgtcgcaaagagctcatcgcgtacatagacgtccgaaccacacagagcattcagcaatgtcgactttccggcattcgtatagcccaccagagcgacccgatagataccggatttccagcgcgccttcgactgcgttttgcgctgcgtatccaaagtcttgagctcttgtttaaggtgagagatgcgttttctgactaaacgtctatcgacctcaagctgagattcgcccataccgaaccggcctccgataccgccgcgcgtctgctcacgcaccaagtggctccacataccgcgcagtctcggtaacagatactccgcctgcgcgaggttcacctggaggcgtccttctttggtcgtagcgtgtgctgcgaagatatcgaggatgagcgcagtacggtcgatcaccttgatcttggaaccgaccacatgctcgaggtttgattgctgtgaaggtgttaactcgtcgtcgaagaccaccaattgcgcttggagtgcctgggccgtttgcgtaatttcctccgcttttccggcgccgacaaacgtacggggattcggagtctccaaacgctgcgtgatccgggcgacaaccacacctccgtcggtttgaaccaaacgttcaagctcagccagagattcatccactgaccactcagaggtgtgggtatcgacgcctacgatgatcgctttctcaggttctggcttggtgctggtcggtgtgcagcgctcagccatggctcaccactcccctacggctgcgatgatttgctcagctgcctcatcgcttgtcattttgtcaagatcgagccaattcacgcggggatcgcggtggaaccaggaaagctggcgtttcgccagatggcgggtattctttttcatcaattcgcgtgcttcatccaatgtaatctcaccgttcagtgcgcttacgatttctttatagccaatcgcctggagcgccgtcagcgctgaggcgagcccttgatccattaagcctttaacctctttaactaaaccttcatcgaacatcgcgtcgacgcgcgtatcgattcttctgtagagtcgctcgcgctccattgcgatcccatagatctgcgcttggtaccacggagcgcgtttgtgcaaccccttgtgttgggtggcgtagctcttcccctcatcgagcatctccagagcgcgtataacgcgtctgatgttgtgggggtggattatgtcagcggaatccggatcgcgctcctgtaagagtgtgtagagcgcctctacgtcctctttttctgcgagggcctcatactttttgcgtgctgctgagtcggtttgccctttggggaagcgcatatcgtcaatcaccgcatcgagatagagcccggtccctccgcagagtaccggcagctgatcatccgcctgcaatttgtcgatgtattctcttgcctgtgtctgaaagagctgcaccgaatagttgtcgacgatatccgccatatccaccatcagcagtgggcagacccgctcagcgactggggtcttagcggtcccgatgtccatgccgcgatagacctgcattgcgtcaatagagatctcactggtgtgaagctgggcagcgactttgtcagctaatgcgcttttccctgaggcggtcggtccaacgattgcaaggaccttgccccctttcaccgaggctcaccttcgacagagcccttgaggtaccaggacttcacctcattgacccgtacatccacgatcttgccgatcagatcagcgctgctccaccctgctaccccatcaaagagcactgtctggttcttctgactgtgacctacgagcaccttcggattcttcttggagggaccctccacaagcacctctgagagcttcccaaagtccttctcgttggatgcatgggagagatcggtgaccagcttcgccaaccggttaaaccgttcctgaatcacgctgtgaggcgtattatccttgagtttggctgccggagtttccggacgtctagaatagatgaaggtgaaggcggagtcaaaacccacctctttgaccagagagagcgtctgttcaaagtcccctgcggtctctccggggaagccgacgataatgtcagtggagagggccagatcgggcatcgccgtacgcaggcgccgtgcgagggcgaggtactgctctctcgtatactttctattcatcgctttgaggatacgggtggaaccgctctgcaccgccaggtgcaggtgcggcatcactgccggcgtttctgccatggctgcaatcacctcgtcgctcagatccttcggatttgaggaggtgaaacggatacgctcgaccccggtcttcccgacttcacgcaacagctgcgcaaagcagggcttcccgtagatatttttaccgtaggaattgacattctggcccagtagggtgatctcacggaccccgtcggccaccagaaactcacattcggtgataatggactccatggtgcgggagcgctcacgcccacgcacatacgggacgatgcagtaggtacagaagttgtcacagccggacatgatcggcacccaggcgtggaagcggcttgcacggtgtgagggtagatcggttggagagtaggaggggtcctcttcagtatccacgagcacgtgcttgtcgttatcgtccttatcgaatgcctcacagagcaacgtgggtaaggaagctagcgctgcggtaccgaagaccacatcgactgcgtggatatgctttttcagctcggctccttcgcgctgtgctacgcagcctcccacggcgatcacgcgcctgcctgagggcggcgtcggagcgctcacggctccggaggcgaccccatagagccgggtatcggccccctcccgcactgagcacgtcatgtacactgcgatgtcggcctgatcgatagaatctacctggatgcagccacagctgtccagaaggcccgagacgcgctctgagtcggcaaaattcatctggcaaccgaaagttgtcacatgataggtcttccctaccagttctcgatactgttgcatactacctatttccttgtatcagagggcatatcttgagaaagctgaggtgggtccaacttgtgcacacagaccgcgatacggatcgcggtgcggctttgacccgagatctcgatctcggagaaggttggcacgcaggagatatccacgcctgtggggatcagaaagccccgagcaatcgcgaccgccttcacggcttggttcaccgcgccggcaccgacacactgcatcgtgacggaagctccatctttgaccatgcctgcgatagcacctgcgacggatgccggagacgacttgctagagactttaagaaaatccatgtttttaactcctgttgagtttcaacactatgtagtggactcaggcgtccctacataccttatatggttttaccacaaagtaccctcaatacggatcacgcatcccctaatcttccttacgatacgggaacgtgaccgtaactttacctgacgtgagctgaaccgtcggcgttccgttcagatggaggtaatagcgctcctccaaataggcgaagtctttctccatcagtttctcgaaggcctcccgatcctcggggctgagcttgagtccacgtcgatctttttcaaggttggcgctccggcgaggtggattgagtggtggaggtgtctcaatgactggttttgcatgcgtacagtacgtatagacatccggtgccggctcgatctgcccggtaaggatacgctgtgcgctacgttcggagatcgtaagaccgagcgagtttgcgacctcggcgagctcgtgggcgtcactcgcgagcttcaatcgggtcaacaggggcagctcgttgagcttcacgcccatgagctcagaggcagagccttggggcaagggcgtatagcgaatcgctgcggcaatgacctctgcggcagagccgataaagatcgagcagcgccgcgaagccgcaaggcaaaagtcacaggcgcaccgaatcaggttgtgggggccacgcacaatgtggaccttcccgccctcattgggggcaagctccggccagctcgattggtctttcttctcggggatcttctgcgtgtcgaagaccacttgtattgaagtacccaagcttgtaccggagttaactacccgggcttgctccacattctcacggatcgaatagagcgccatgcctcttccgtggatcccgtaggtatccacgtgcacgctcttgagcttgccggtgacgcgcgcctcaaagacccgctcccacatgtcctggggaatcccgtccccgtcgtccaccacggtgagactgcgcttgccgtcagacagattcgtggcgatgagtattgtggaagccctggcgtcgtaggcgttgcgcagcagctcgatttccgcatcctcaacgcagcggatatcatcctttgcctgccgacgctccgcttcggcgaccctcaggcgtacaaagccttcacctaaattctcttcaacgcttaactgctctccctgcccgctgcggacaaggaaagcagccaaatcttcatgggtatttttgctcatcgtctactttgcggtatcgatcgcacgggactcacggatcaccacgacgcggacctgccccggatactccatctcgtcctcgatctgcttggcgatatcgtgcgcgaggacggtagcctgcgcgtcggagatcttctccggctcgaccatcacgtggagctcacggccggcttgcatcgcgtaggtacgctcgacgccctcgtgggcattggcgatctcctcaagcttctccaggcgcttgatgtagttctccgcagattcacggcgggcacccgggcgggcggcggagatcgcgtcagcggcctgtacgagcacatcgagcactgtgttgggctcaatgtcagcgtggtgtgcctcaattgcgtggacgatctccggcttctcgccgtaacgtctcgctaagtctgcaccgatcactgcatgcggcccctcaacctggtggtcgatggctttgccgatatcatgcaggagaccggcacgctttgcgggggccggatccataccgagctcggatgccataacgccgcagagcgccgccacctgaatggagtgctgcaggacattttggccataggaggtacggtagcgcagggcccctaaggtcttgatcagctccgggtgcaggtcgtgaatgccggtatcgaaggccgcctgctcgcctgcctcgcggacgcgttcctgcaccagggactctgccttcttgtacatctcctcgatgcgggcggggtggatacggccgtcagcgatcaggttctcgagtgctacgcgtgccgtctcacggcggaccgggtcaaaactcgagaggacaaccgtttccggggtgtcgtcgataaccaaggagaccccggagacttgctcgaaggtacgaatgtttctgccctcacggccgatgatgcggcctttcaggtcatcagaagggatatgaaccgtggcgacggtgatctcaccggcctggtctgccgcgcagcgctgaatagcggtggagacaatctcacgggcggtcttgtcagcctgggcgcgtacgcgctgctcagagtcacgcaggatcttggcttcttcgccgacgctctccttacgcaccttgttcaagagctcgtcgtgtgcctgatccttcgtgagagaggcgatacgctccagctctgcggtcttcttggattcaagtttgtccagatcgttctttctgcggtccaactgtccctggaaggaagaaagctgatgctcgcggtgatcgagtgaatcgttgcgcctgtcgagggactcctcacgctgtaccaggcggttttcgagcatatggatctcgtctttacgctgcttgtcttgggcctctgaggtctgccgaagctggagaatcttctccttcgcctcgaggatcgcttccttcttggaagtgtctgcagcctttttggcctcatctgttatctgctttgcttggcttttggcgctctcaatctgtcgctttgcgtcctgtacccgatcattgctctgattggtgacgacaatataacagatggcagctcccaccgccaatccaacgatcagtaaaacaatccccattgtgactcctcaatagcacatgatcaatttaatgaaggaaaggtacacaggtgctaccatccaagaggtatgtcacgaccactcggctacgtcttcgagccagacgccaatccaataatttttcaaataaaaatatttattaaaacacctgacagaatcgcttccgcagacgtgaaaaaccacagatggtctttcaatcgtatgttgtgcacgattgactgtcaaactctaacgggcatacgggcctaaaattgcccaaaacatccgcaccagtacggaaacaaatactgcgacagaatcagagctcactgtcggaatcattctcagctgccgtggctgcggcccgcatcgcggtgccataggaaaaaccacgccctaccaggaaacgcaccgccttctgataccgatgagggggacgcagggttttgtgctccagcagctggcacgcatgtgtatactgatcgtcttctgggaagaacgcctccggccagccctcgatctcttctggcaccaatccgcgcttcttgagctctaaggcgatcttccgtttgccccaaccgaggcggattttggattccacgaagagacgcccaaagcgtctgtcatccaccagatgagtcttcgaagccttctccacgctctcatgcacaacagcctcggtgtaccctctgaggtgcaggcgcttctctagctcaaagctcgtatagtcgcgccggttcacgagcgagatgatcttttcccaggcgcaggtgtgctcagcttgatcgatagcctcgatcagctcagcgagtgaagatatgggaaatgaggctttcttctcatacttttccagtcggcgcgccacctcaaccgggacatagagcttgcgctcatccacctcgattgtggcggtcggtttacgctgggaaaatccggaagcctgcttagaggggtagctcacctcccaggtaaaatcgcccgcagcatgcgtatgggactgatgggattgcttgcgcatagcagctatgcactctctgtggtcttgctcttgtcttccttctcatccacgacaggctcgccgaccggttcatcgtcgtccttgatcagcccacaggcgacgcgcaccttgtggtcgatctccttggccagatcgggatgctcgcgcaggaaacgcttggcagcttccctgccctgtcccaaccgttcggtctcataggtaaaccaagcgccggatttgttgacaatcccatagtcgacgcccatatccagaatggagccttccttggagataccggtgccgtacataatgtcaaactcagcctgcttgaacggggcggcaactttgttcttaacgaccttcacgcggacgcggttgccgataatgttaccgttctgcttgatcgtgtcgatacggcggatgtccatacgcaccgaggcgaagaacttgagggctctgccgcccggggtcgtctccgggttgccgaacatcacaccgatcttctcgcgtaactggttgatgaagatgcaggtggtcttggattttgccagagagccggtaagtttacgtagcgcctggctcataagccgtgcctgtgcgccgaccgtggcgtcaccgatctcaccttcgatctctgcacgcgggaccagcgcagcgacggagtcgataaccacgacgtcgatcgcgccggagcgcacgagcatatcgcagatctcaagcgcctgctcaccggtatccggctgagagatcagcatatcgtcaatatccacaccgatgtgggctgcatagcctggatcgagcgcgtgctccgcgtcgataaacgccacgacaccgcccatcgcctgggcctcagcgaggatttccagggacagcgtcgttttgccggaggattcagggccgtagatctcgacgatacgtccacgggggacgccgccgatacccaaggctgcatcgagcgcaagggagccggtcggaatcgctccgatctctaagtcaggtccgccatccccatagcgcatgattgagcccttgccgaaccgcttttcgatctctgcggtcgtagcctcaaccatcttgtcgcgctctgcgccataggttttctcgtgggcctcgtagttcccatgcctctttgccatgaacaagctcctctgaatggttgtgtcgcagctatcctatacgaacaaacgttcgttgtcaattcctccctgctacgctagcacaagaaactgacaacgagctcaccccttctgtcaccgatctgacagacggggtgctatgtgcctcaaatgaggtgattatcaggcatttttgacggccttaagcaacagctgcaaggctacatagaccgccttgttgcgcacctcgggacgggtacccgagaaggtgtgcagctcggttgtggtctcaatcctgtctccggcaaggccgaaccatacagtgcccaccggcttgcccggctcttcgccacccgggcccgcgatcccggtaatggagaccgcataggtgggttccagcacctttctggcgccttccgccatctgctcggcgcactcagaggagatggcgcccacgcccggtttgttgaggatctcgttcgagacgcccaaaaccgcatgcttcacggagatcgcgtaactcacgacgccaccgcgcagcatctcagaggagccggggacgtccgtgatagcgcctgcgacaaggccaccggtgcaagactccgcagtgcccacggttacgtgccggtcagtcgccgtgtgtaccaactcctctgccagcgaatactgctcctggcaggaaggaagtttcatatcacctaaggattcagccatatatcatcactcacctaatccgctaagtatttccagcacttgacaaagtaatctatacccgaccagagggtgagtatcattgccacaaccaaaagggtcaggctcaggggcaggaccaccgtgaggcctacctcaggcggcaggcaacgcactaagagcatgcccgagatgccggccatcgtcgtgaaggtcttggccttgccgaggttacttgcagcgaccacgacgcctttggaggcggtgaccatcctgaggccggcaaccaagaactcacgggcaatgacgatcaggagcagcagcgcatcggtcagattgatctgcaagaggaagaccagagcaaagaccacgacgagcttgtccgcgatcgggtccaaaaacttgccaaaggtcgtgacctcgttgcggctgcgggccagatagccgtccagcttatcggtcagggcaagcacgatgtagaagatagcgacccccagaagcgagggagaaaactcaccctgtactgagatcggattcatcattgcgaccgcataccacactgggatcaggaagatcctgatcaccgtcacgatgtttgccgcggtccacctgcggtgcggctttggctccttgcgttcaagctctttgtcctgctgcttgttctgctgctctgtgggcatcctatagtctccttaaatgagctctcctaccatctcataggcaaagctgtccgtcagcttcaccttcacaatgtctccgaccgtagcttcaccggattcgatgtgcaccgcaccgtcggagtccggcgcctggaaccaggtgtggccgatcagttcaggccccttatcggtctgttcgataccgtcaatgataacgtctgcggtctccccgatatggcttgcagtggcagaaaatcccatctgctcagccaaatcgatcagacgctgcgcacgttcctgcttgacttcctcgggtacctgattgggcatatcgtaggctttggttccttcttcacgggagtatgggaagaccgaggtgtagtcaaactcctcctcttgcaggaagtcgagcatctcctccgcttcctcatccgtctcccctggaaaaccggtgagtgcggtggtcctcaagaccatgcctgggatctcacggcgcaccctcgcaaagagtctcttgaactcttctgcggaaccttttctgcccatgcgatgcagcacggttgcgcagcagtgctggatcgggatatcgatgtagggcaacacttccggggtatccctgatcgtagagatcagctcgtcggttatgccctccggctgcaggtagaggactctgacccagccgtgatagggacgcacaacctctgccacctgacgcaccagccaggctaaggtcttctttggatcatcgaagtcgctgccccagataccagtgtcctgtccgatcaggacgatctcacgcacgccgccttctagtaaggatttgacttcgcctacaatttcgccttccggtctggagtggtagtgccctctgatataggggatcgcgcagaaggcgcagtagcggtcgcagccctctgagatcttcacataggcgctcgtaccctcaaccgtacgcagcgcactcgcatcgagcacattggcagtcttcggctgcggcctatccagtatcttgcaaacggtgctcacaatcgaatcctcatcttctgcccgcacaaaggctgccacttcaggcagttgatcgggcagatccgccccgtagcgggaggggacacagccgcacatgatgatcgggagcttgagagtttgggcatcggtcgcttcctgtgccaactccagggtcgtctcgatcgactctgaggtggcagaagccagaaatgaacaggtattgatcagcgcgacgtcggcgtcgtctgcctcgtcggtctcctcaaaccctgcgcgttccaaaagcgaccgcatgcggtcggtatccacctcattcgttcgccaccaacggtaataaacagttacgcggccctgtggtgcctgtactgtcggttggcgtgtggcactgctgtccatactcaactattctctaatcacctatcgcacagcaccccgcacgcgctgcgtgcagggtccgattgattatctttgttgcgatcatcgctctgctattggctgcgtccgttcgatggtactcgcagtatagagtttgctgtcccattctgggttgtggtcgtcaccagcagcgttgctctgggtgttctgtgccgaccttgttgtttggtcgcgatgtcgcattcgcggccatcgctcgatgagttgttgctctgcttgttttggtcagagcttgatgctgtcgcctgatactccgccttgatggtcatcgtccccacggccggaggccttcgcatcaaagttctgcgtctgaccgttcattcgtgacgtcacggcagaggcattccccacctggatggtcatcgactcgctcgggcttataggtctgagaccaagggccatgacgtctgcgctacctgacttgacccgtcgaccgtaacctcgacccaggaccttccgccgcctttgacgcttactacgacgctcgggtgggcatcgtcgccgttgtccttgttctggtcattcgaagacgtatcctgtacagcctgcgcgctgttgtcctgtgactggtcgttgctgttgtcaacctcggccttagtcaccggcacggtctgccttgtgttgtcatcacctccggcggtgcggctcacgcaggagctgacgctgtagataatgaggatggtgagaagtaagccgacgataatgacgatccagaaggtattctgctgggccagtgtctccgacagggactgtttcggacgcttcctatgttgggtgcgtctctggcgtgtacgccgatcctgatccagctggtccatcgcaggccgcatacgggctgcgacattgcgggaataatcacgggcagactcggtgctggccgcgcggtacggctgtgcctgttggtcgtagcgcatatcgtcctgatagctgtgtgagaccggacgcatctggatagttgcggaagggtcatggaaggaatcctgacgctgccggtcataggaggaagcgctgcgacgggcatgctgcggcacccgggaggtatacagtctcccctgcggatagtgggcacgcctgctgcgggcgagttgctggctgtggcggtacacccgctggtcgtggttgaactcgtacacgacctcctgctcatcgaggccgaggtagcgcgcataggtcgccaccaatccctgggcatagcctcccttagggatcgagtcaaaatcacccgcctcgagggcgaccagcacccgctctttgaacttcagatcatctgcagcctgtgccgtggtgaggcctaactggtgacgacgctgggacagcatttcgctgaaacgcggacgtggcatgctactctacctcctgatacttctcttcagcaatacgtagttcctctagctctgcctggtccatcagcacctcacggggctttgaaccgtcaggaggacccacaatccccttgtcttcaagcatatccataattctgccggcacgggcatagcccactttgaggtggcgctgcagacctgaggtggagcccaattgggagtccaccacgagctgtgcggcttcccacatgagcgggtcatcgtcctcatgcactcctgcgccgtcctggtcagtcatctggcccggggtcacggcagagaggatctccgagtgcagatccgcatcgaagtgctctttcacgaagctcacgaccgcctcgatctcgtcgtcggagacgtagcagccaagggcacgtttcgcagagcggcctctgagcttatagagcatatcgcctgcgccgagcagacgctctgcgccggtggaatccaaaatgatgcgggagttgactgcagagtcgaccgccagtgccacacggttgtcgatgttggccttgataaggcccgttacgacatccgcagagggacgctgcgtcgccacgatcaggtggatgcccgctgcacggcccaactgggcgatacgaacgattgaagcttcgacttccttgcgggcgatgatcatcagatcggacagctcatcgattacgatcacgaaatagggcatgtgctcagggggatgctccatatccgcccatttgcccaactcgaggttgcggttgaagctcttgatgtcacgcaccttgtagtgctcgaagacccgaaggcgccgctccatctcggagaccgcccattgcagcgcccctgcggcctggtgcgcatcagtcacgactgggacatagaggtgcggtaatccgttatagccggtaaactccacgcgcttggggtcgatcatgatcatgcggacttgctgcggcgtcgcgcgcatcagcatcgagacgatgatggaattcagaagcactgacttgccggaaccggtggtgccggcgaccagtaggtgcggcagtttggcgatatcgacggtgatcgggcgcccttccgtattgcggccgaaggcaacctcaagcggagatttgcccttcgcatagggtagcacgtcgcccaagcagacgctctggcgcttcttgttcgggatttcgataccaaccagcgaggtcttcgggatcggcgcaaagatacgcactgaagtcgtcgctaatgcgagggcgatatcgtcctccaggttcgtgatcttattgacgcgctcgccttcgcccattgagatcttgaaggttgtgaccagaggccctgagacccagccgaccacctttgatttgagcttgaactcggctaaggtctcctgcagcttctgcgctgtctccctcaactcctcgtttgagctcattgacgttgcagaatccgggtttgattccagaagtgagagcggaggcagctcctctttatcggtgctcttgcccgcaggcgtgatgctcttagagcctgcagaagccggctgaattcccgagggagccttcacaatcggctctatcggagcgacgcctgcagcaacagtcctccgcttgtgcggcttgggggctttggcgccccgcttgagcgtctttgccggtgtaggctgatcagtatcctgtcttgcagcattgcgcagaaaggccggaaccgcattgtcggtttcggtcacctcgccatccttgtctgtgggaaccgtaaccgtcgcgttgaggcccccgtcaggttgagcttcagctgtattcgtatcctctacctcatgcgccggctcacggtgcagcaacgagagacggggatggcgcttctgggcaggcttttgcatctcaattgtaggctcatccatcttcttgtcacgcttgaggactgtggtctttcggctgccgagataggtggtcttgccctcagcgtttgtcgggaacagctgggtcggagcgaccgactcggggtcctccccatccgcaaagagctcgtcgatcggatcgtcggaggcaccgccagccgcataggtgggagtggattggctgcggcgctcctttgccttgctcacctgtgtggcgacacctttcccgatctttctgaaggagaggccaccgatcagagctgcggtcacgagcagaccggtcagcaccacattggcgacaatgcggcccacaaaggtcaggagaaaccatgcgagggcgcccccgacgtagccgcccgcatgggtggcataggtctcctcaaagacgagcatcggctgggtctcccgcacgcccatattgacggagagaagtgagagcaccgccagcaccaccaggataaggcttaaggcaatgcggcgggacttcacttggtcgtgcgtcacaaagtgcatcacggtataggccacaagggctaccgggcagagtattgccccgaccccaaagaggaggtccaggacgtgccccacggtagcggtcagatatgcgctggttggagagaccagcgataccaccatcatcaccgctacgacacagagcacgacggccaagatatcctctttgaccgaaggctcgatgacggaaggctccagatgttggacttgcggtttggcagcgcgttcggcatttttctttacagtttgacttttgcgccgcgcgggcatttatacctccaacactaccgggatgaccatgggtctcgtgtgcgtcttgttccacagatagttagaaagaccatttctggccgccttgcgcatcgcgtcgagcgcggcatggtctgagattttattgaccgcggtacgtaccgcatccaaggcgccttctaccagtttatcgtcattcgcagccgagaacccgcggctcgaaagattaacatcttccactttgtggttccggctcgaggctgtgatgacgcaggtgacgataccgtcagaggcgaggcgcttgcggtcgcgcaggaccactgggtccgcatcggagacagaacccccgtcgacgtagatcacgccggagtcgaccgaaggcccacgcttcacgcggtggcggcgcatctcgagcgtgtccccattatcgaggataaagatgtggtcctcagggatgcccatctgacgcgccagtttcgcatgcgttctcaggtgcacggcctcgccgtggaccggcataaagtagcgcggatgcaccatggcgagcatcagcttgagctcttcctgagaggcgtggccggagacgtggaccagcgcattgtttctatcaaagatatggcagccgatcttggagagcgaattgatgacaccctggacggatttctcgttgcctgggaccggcttagcggagatgatcaccgtgtcgccctcgtggatcgaaagcgacttgtgctccccgttcgccatccgggacagtgcggagagtggttctccctgtgagcccgtacacatcacgacgatcttctcgtcggggatctcgtccacatcgtaggcgtcgatgatgtcctcatccgggatcttaaggtagccgaggtcacgggcgatctgcgtattgtgcaccatcgagcggccggtcacgacgactttgcggccgacagctactgcggcatcacagatctgctgcagccggtggatgtggcttgagaaggacgccacaaagacacgaccgggggcattcttaatgatatggcgcagcgccggtcctaccgcagcctcagactgcgtgaagcctggaacggtcgcatttgtggagtcagagagcaacaggtctaccccacgcgtcgcgaaacggttgatcgcggcatagtccggacggaccccgtcgatcggggtctgatccagcttgaaatcaccggtgtgcagcactgagcctgcaggcgtacgcaggtataaccctaaggttgccgggatcgagtgcgtcatcgagaagaaatgaatctcaaaggctccgagctcgatcttggttccatcgtgcacctcacggtaatcttgtttagcgagattgtgctcttcgagcttgctttcgatcagtttgagggtcagcttgctcgagaagattggggctttgtggttcaggtccttcagaagatacggcaacgcaccggtgtgatcctcgtggccatgggtcacgataatgccgcgcagctcgtcctcgtgctccagcacatacgtgtagtccggaagcaccaagtcgacaccgggcatatcgtcatccgggaacataatgcccgcatccaccaggaccatgtcgccaccgtattcgaatgcggtcatatttttgccaataccatctaagcccccgagcggaatgatcctgaggggctggcttttcgtttttgccatagagacttacaagctcctttcaacgtgtccagtgatggtcatacaacttcgtggtcaacatcggtttatctgccaggccacgtacccttctgaaaagaagatagagatgacggataaaacaactcaatatattcttatatattctatagtacccacctcacgtacgagaggtaccgctgagacaaagtgccactcaaaaatcgtagcgccgaaacactgctgtattggcacagctttcgttcaagtactgatcttgagtgtactcaatcgaaaagtgtgcccgcactcgtttcggtaccacaacacgtaagagcggcatataaagaagagccgaaaagcttaacgttcgccttctggctcttctatcagttacgcacctagagacacgcttatcgcatgtcctgttctttacgcctcgtggtgacggcggggctgatggccgtggatcctgccttcaggggtgcggtggccgttgtcgcccgggtgacgagtgtggcggcagcgctcatgtccctcatgctcgcgatgatcatagctctggccggagcgggcttggtgcaaagtcccaggcttgtccagacggtccaggctgatcttgccgtgctcgtcaacgtcaatgaccttaactttgacctcgtcgccgatgttcaggacgtcctcaaccttaccgactctgcccttagcaacgcgggagatgtgcagcaggccgtctttacccgggagcagctcaacgaaagcgccgaagggctggatgcccacaacgcgtccggtgtactcttcgccgacctccggaaccttcacgatctgctcgacacgctcagcggctgcctcccctgctccattgaggccagagatgaggacggtgccgtcctcctcgacgtcgacggtagcgccggtatcctcctggatgccgcggatgactttgccgccggagccgataacatcatggatcttatccgttgggatgtgcaggctgatgatctgcggcgcgctgggctttaagtgctcgcgcggtgccgggattgcgtcggtcatcgcgtccaggatgaacatacggccctcgtgcgcctgcatcagtgccttacgcaggatctccggtgtgaggccggtggccttgttgtccatctgcatcgcagtgatgcccttggtggtaccggtgaccttgaagtccatgtcacccaggaagtcttcgagaccctggatgtcggtcaaaacgacggtcttgccctcttcttggatgagacccatagcgacaccggagaccgggcgcttaatggggacaccggcgtccatcagtgcgagcgtagagccgcaggtcgatgccatcgacgaggaaccgttggactccattacgtcggaaacgacgcggatcgtatacgggaactcctccgcagaggggataaccggcttgagcgcgcgctcagccaggttgccatggccgatctcacggcgcttcggggaaccgatacggccggtctcaccggtgcagtacggcgggaagttgtagtggtggatgtagcgcttgccctcaaccggctcgatcgtgtcgaggcgctgccactcgttgagcatgcccagggtgcagacagagagcacctgagtctgaccacgttggaagaggccggagccgtggacacgcggcaggtagtccggcttgatcataagaggtctgacctcagtcgcggtacggccatcgacacgctcaccggtctcgacgaccatgcggcgcattgcgtgcttctcgaggcccttgagttcgaccgggattgcccggctccactcttcctgctcgtcctcggtgaactctgcagtgatggagtccttgagcgcctccaccttctccaggcgggaagccttgtcgacatctctgagcgcggcgctcatctcgtcgtagtgggcaaagatgcggtcgtggacctcgggaatcggcccgtcgagctcatagtcgtgctccgggaatgggccgttagcgtcctgaaccttcttgaagaagatcttctcctgctcgcagaaggcggcgatggcttcctggccgaaggccatggctgccagcatatcgtcctcagagatctcgtcggcgccggcctccaacatggagatgtaggtcgaagagccaccgagctcgagatcgagatcggagttcttgcgctgcgcataggttgggttcacgataaactcgccggtctccttattgcggccgattctgacgcaggccagcggtccctcgaagggcacgccaccgacggtcagcgccgcagaagcggccatcacgcagatcgtgtcaaccggatcgatctgatccgcaacgagcggcattgccacgatctgaacttcgtttctgaagccttccgggaaggacgggcgcagcggacggtcgatcatacgggccgtgagcgtcgccttctcactcgggcgtccttcgcgcttcagatagcctccggggattctgcccacggagtacattctctctatgaaatcgacggtcagcgggaagaagtcgtagtctttgcgctcctttgagacgaccgcggttacgagtacggtcgaatcccccgccttcacgagcacagcgccggttgcctgtttcgccagttctcctgtctccagcgcgtagtgcttgccatacaggtcgaattcatgggttactttcatagttccccttatctccacctgccccatcgcaggtgggccgtcgaggtgtgtttcttgtaacacaccgcacgctttcaggcgtgcacacatacgaaagggcacctcactcttaggtgccctcctagatacttaccttaccttactgaacgttgtcgcggatgcccaggttcttgatgagggaacgatagttctcaacatccttgttcttgatgtaacctagaaggcgacgacgcttacctacgagcatcagcagaccacggcgggtgtggtaatccttctgatgggttttcatgtgagcggtcaaacccttgatgcgctcagtgagaagcgctacctgcacctctgcagaaccggagtcgtgctcattcttgccatactgcttgatgagctctgctttacgctctttgctgactgccatacaaccacctttcaaaatatttgattcgcctcgaactgggaccggcgtctggcatgaacggctggctaagtacgaggtactgacaagtcagatagtttagcacatgcgatagacctacgagcagcgacgtagccaaaatctgtagaccatcataacccgcgcataaactcaaagctgcgcagccttgtatcgaggtgcgccgtagcccattcatgggccagggagaacaggaaacgtgcggtccccttgtcgatcggtgttaccagcaacgtggaaaatctttcggtgagcagggctttgagcctccccaactgctgtggggtaagctcatgagctcctgagatctcacgggcacaggaagcgcacagcgtcccgcccattcgggctgaaaagaagctcacatcgggctccccgcaggaggtgcagcgcttaagctccggcctccagccttggtgcgcgagcactttgaaggtgaaggctgcaaccaaaagatcgatctgtgataggcctgtaagaccttccagggttgagaaagctgccttgaggatcgcaaagacgaagggatcctccacgttctcgtagcaggtgtattccccgagctccgccaaggcactggcaccggccatcaggtccagatcctcacgcagcttcacgtggggatcgatgagcgaggcttccgttacgatatccaagttcctgcccttggcgataagcgcatcagagtcgcagaacatatcgagtcgggaggcaaagcggttgcccggcttgcgggctcctttggctactgcacggatctgttccccatcggctgccatcaacgtcagaatcagatcagactctgagagcttcgtcttccttaagaccatcacctccgtgtggagggtgcgcctgccggccatggctactcttccgcctcaaggccgagttcccggatctctgtctgatcgcgccgccagtcaggctgaaccttcacgcgtagcgagaggaaaacctttgcatggaagagcttctccagatcgtaccgggcatcggtcccgatctttttgatcatggaccccccgcgtccgatcagaatcgctttttgacccttacgctctactaagattgtcgctgtgatgttcatacggttgctcttcggccattcgatatcgtcgaccttgacggccaccgcatggggcacttcctgccgcgtattgaggagcactttctcacggatgaactccgctatgagatcctcatccgaggcgtcgctatccatattctcaaggaaccagtgcggtccctccggcagatgcgccgcaagcgtgtcgatgaaagcgtcgacattgaaattttcctgggcgctcacgacaagcacatcgtcgaagtgcgccaactttttggcagactcgatctgtttctcgatgatcttttggctggccttatccgctttggtgataacgagaagtttgaagggagtgtgggaggcttcaatgtgctcggcgatccaggcatcgcctcttccgactggcttggtggcgtcgatcaggaacgcgatcgcgtcgatgtcggcaagctcacccaaggcaaccttgttgagctctttaccgagcgcgtcttttggtttatgcaatcccggggtatccacgaggaccagctggaaatcctttcgggtgatcaccgcacgtaaccgctttcttgtggtctgggccaccggggacgtaattgcgagcttttcacccatacaggcattgacgagcgtggacttccctactgagggacgcccgatcagggagacgaatccgctcctgaagggtttggtgtgtccttgttcctctggcattgagccccctcaggcaaagaaaatagcgtggataaagacgatgaggccgacgatagcggcaaagactgacatgatgtagacccctgccgctgcgatatccttcgcgtgtccggctagggggtggtactccggtgagaccaggtcgacgacggtctcgatagaggtgttcataagctcggcgcaggtcacgcagccgcagcacaaaaggacaatcgcccaactcgcaacgtcgaggtggaacacaaaccctaagatcactaccgcgatagcggcagcgagcattaccttgatgttgcgctcagtcttgagggtatatacaaacccctgtatcgcgaacagaaagcttctccgaaacgttggatgattgttcttctgaccgggtatcatgcgtcctcccgatgcctcgcgagcacaacatggctgagcgtgtggtcagtgggaagctgtgcaagtagcacatcctcacacgcctgcatcctgtgtgcatctgcctcctgtatatggtcataccctaacaggtgaagcataccgtggacaaacagcagacgggtctcatccgccggtgtggtgtagaatctgcgtgcctgacgctcgatataggcgggcgccaacacgatgtccccgagctcgcagggttccccttcacctaaatcaggatcatcggggcgctcgcactcgagtgacaagacgtcggtgggggcatccacctggcgccactcatggttcagcctctgcatgtgcttgtcggtgacgacagaaagcgagacgaaacaggggcgcttcaccccctgctggtcgagcacaacggtgccgatccgctcaatctcgggttgatccaacgcgagcgaggtaccctcgtcgcagcctatgtcaaactcatgcttcacggacgcgctcctttgcctctgccctatcgtaggctgcgacgatcttcgcaacaaacgagtgccgcactacatcttcggtcttgaggtggacaaaggcaatctcagggatgcccttcaggatgtgctccgcggattcgatgccgccgaagccgggaacatcgcgctgtgagaggtcgccggtgatgattaagcgggagttgaagcctaagcgcgtgaggaacatcttcatctgtcctggggttgtgttctgcgcctcgtcgaggatcacaaaggaatcgttgaaggttcgcccacgcatgaaggccaagggtgagacttcgacaacgccctcttcgatcagccgcagcgccgtctcatggcccaccatctcaaagagcgcatcgtagagcgggcgcacgtaggggtcgatcttctcctccagggtgccgggcagatagccgagggactcccctgcctcaaccaccgggcgcgtcagcacaagacgctcgatttcgtggtgccgcaatgctgcgaccgccattgccatcgccagatacgtcttgccggtaccggcgggacccaatgcaaagataatcgggtgattttccgcgatggcgcagtaggcctgctgtcctttggtcttcggccgtatggtcttgccggttgcagtcaccagaagtgggctggcattgactttgggaagcgtggtggttgcatggtcgcccgacatcgcgtagttgacatcagcctcatccggtagctgtcctgcttccaccaactcgatcagatgcgtaaagatcgcggtcaggcggtcgacctcctcaggggttccctcgaggttcaccacattccctcgcaccgtgatgactgcatcgcttgactgctcgattaaacgcagcagagaatcttgtggacccataaccaacgtgggatcgcaggaatcagggattgtgagacgaacgtacgtcggctccatgctcctcctcggttgatgtttcaaatttgtatatctaaggataccgggttacgctgtgcccgcaacctcaaaccccgctctgacatttcattggatgcagcaccggtgacctcagtgcggtgctctcgccgcgacgagcgcaccgtcatcctccaccgcctgtatcgtggccctcacgaagcgatcagcgccccagctgtctgggaccttcacctcgaacaagccagcagtaatgccttggccagcgccctcgatcagaaggtcctgctgagtgcctaccagcttctctgcttccgcatgccgcattgagtttgcaagctctttcatcttcgctgcccgtgcgctcatcacctggggcggtacctggtcaggaagctccgcagcgatggtgccggggcgttctgagtaacggaagatgtgcatcttagcgaagtgcatctcacggcagaactcataggactcctcgaattcctcgtcagtttccccggggaatcccacgatcagatcacagccgagtgcaagtgagggcacctgcgcccgcagcatctcgacgcgctcccgatactgtccggcgctatatgggcgcttcatgcggcgcaggacggcatcacagcctgactgcaggcagatatgcaggaaaggcgcaatacggcttgggtgttctctcataacggagatgagccgctcgtccacatcaggtggctcaatcgaggagagcctgaggcgggcgatcggcgtctcttgaaggatcagctccatcagatccggtaggaaaagctcgtgtccctgtccatccacgctgtggtaacggccgaggttaatgccggtgagcactatttcctgagcaccgcgtgccagttcgtcattcacctgattgagtactttttggacatcggccgagcgtcccttaccgcgggctttccacacgatacagaagctgcagcggttgtcacagccgtcttgcactttgatgccggggcgggctctacccgtcggcgtcactgaggtatctgctacccgatgcgtttcgacatcaggcatacctagatagtcgaggacgcgctgcgccaccgtatccttctgctgtataacttcgatattttccgcaagcgaagacagttcatcagagaagaggttggcaacgcagccggtcgcaaagacctgggggtgctgcgcgagtcgagcagcgcggcgcagctgttttctggtcttggcttccgcttctccggtgaccgcacaggtattgacgacgatggcttgggcctctttgggagccgtgatcgcgcacccgactttctccaggtgttcggcaattgagtcgatctcgacgcggttgacgcggcaaccgagattgacgaaggctaccttggggaccacagacgctgccattaccgcttaccaaacggatgcttgctgccacgtttgctcttcgccgtcttcttggcagctgtgccttcgcggtctttcacaatctctctgattgcatccatctgttctttattcagattgtctggcaccttaatgcggacaaccgcaaccatagtgccgcgggcattcgagttcattctcggcatcccgcagcgatcgatcctgatctggtcgctgtgctgcgtgccagctgggatcttaagggtgactttttcatcgggcagaataccgtcgagggtcttctcacagcccaggattgcatcgagggcgtcgatctccacgaccgtgtagaggtcatcaccctggcgctcgaaccgttcgtccttatcgacctggatctggatcagtaggttgccacacgcggcacctctgataccggcttcgcccttgtctttggccgtgatagtctggccggagtgcacaccggcagggatatcgatgcggaccgactcatgtgatggagtacggccagtgccgttgcaggtctcgcagggattgctgacgattttgccggtgccgttacacttagggcaggccatcgtcgactgcatctgtcctaggatcgtacgctgaaccgtcgtgacgtggccggtgccgtggcatgtcgggcagccaaccaccttgccaccaggaccggtgccggtgccgtggcagtcatcgcagggggccatacgctcataggagatcgtcttatgggtgccgcgcgctgcctcagccaggctgatgtgcaatgtcacactcatatcgcggccgcgcatgtcgcgcgtacgggtagtaccgtgcccgggatttccgccgaagaacgaagagaagatatcatccataccgaaaccgttgaagatatcggacatatcgacgtagtcggagccaaacccatttggcccgtccgcagtgccgtagcggtcatagttggcgcgcttccgctcatcggagagcaccgcataggcctcgttgacctccttgaagcgctcctctgcatcgggggccttgttcacatcagggtgtaaggttcgcgccttcttcagaaacgcccgcttgatggtcttcgcatcagcgtttttgtctacgcccaaaacctcgtaataatctttcttcgcgctcacgaacaaccttctcccacacacaaacgaaaagggacgcacccccgcgcccctcatgattttgaaaaagagacatccttttcaaatgtacccagctttgagctgctcaattctctaaatatgcactcttgtactataacccgttgaaccgaagctcgaggtgcatgacaccatcgccacaatcaagatcgccacaaagagtcccttcagcactccgttcatcgtggcagtgcccgcattgttccaccatttcgagttgtgcggacgtgagcctccggtcagaatcaacaggaagccgactgcagcaagcacaataatgaagggggcaagcgcggcaaacacgtctgcgatcaacgagagaatcaggaagggtatgtcaaagcccaggaactgaaagcccacagcctgacgcggcgcgaggcgctcggtcgggactccgactctcaggacgaagtcaccggaggcctctccgttggttcccgcattgcccatgcctttgatccgcacttcgtcgccgtcgtgggacttcggtggaatcatcacaacgacctcggaagccgcaagcacacggccggtgccgccgcaagcggggcaggggtcgacgacgactctgccagtgccttcgcactccgggcacaccatgtccatctcaccgaacccaaagaggctgtccaggtcgacgctgatatggccggtgccaccgcaggtcgggcaagtttcggggtgatcggaaactactgagccgtggccgtggcaattctggcactgcacgtagtgttggtaggtgatgccccgcttggtgcccttttttgcagtcgccgcatccaaatcgatgtgatagacaaagtctgagcccgcttttgggttaaaggagcgcgatcgtttctgctgcctgcgctggcccataccaccgaagggccaaccccagtaggactgctcaaagtcccagaacggatcctggccttgaggtccgccgtagccggctcccggagcggaagctccctgggaagcaaacacgctaccggagtgcatcgcatcgtagcggcgacgtttatcgggatccgagagcactgcataggcctcagagatctccttgaacctctgctccgcgtcaggcgccttgtttacgtcagggtgatacttgcgggctttctgctggaacgctttgcggatctcgtccgtcgatgcgtcgctcgagactccgagtattttgtagtagtctttgtcgttcatcgaaggcatacagtctcctgcctcatgttcacatatcagaaaatctactgctctttacagtagatagactcaccacagttactcttaacaataccgcttcacgtcagaaaacctaaataattacacggaaatgagctgtgtttgcctatctccggccaaatcccacatgtggctgaagagctcattgcccaaaagccacccttgatgggtcggcttcaacctctcattcagaagcccttctgcctgctctctatgcacggcagtatcaaaggtatcgcccaactcgtctcgggcatatgagaccaatatagggtcgagtggcttctgcatgcgacaggcgagcatcaaatcttcggcgagtgtctgacgcgccgtgagggcttcaatatcgaagtggagatcacacgcttgggtgaggtgaaggtaatcctcgatctttgtcgtattggtcaggcggatacggaatgcgtcgttttccagctgaggcagctgcgggtaaacgcggcgcagccgtgcatacccctttcttgtcaccatgccagacgccgcgcatcccactccaagatagggcaatccggtccaatagatcttgttgtgcgcacactcatatcttggcttggcgtaggaggcgacttcgtagcgatgaaagccgaaagggcctgccaccttggcagcctcctccatccgcatcgcctggacatccgggttattccaggagggataatcctcgaccccataccggcgcccgaaggccgtcccctcctcgatcatcaggggatagacactcaggtgctcaatgccggttgagaggacctgcttaaggctcgtctgccagcttttgctggtctgatccggaatggcgcacatgaggtctgctgaaacggtgaggcctacctcttggccccacttcagagcctgaagcgcggttcgctcatcgtggatacgtcccagatcgtgcaattcctggtcactggtactttgcaccccaaaggagatgcgggtgagcccggcttttcggtattcctgtagaagttcaggcgtcacaaaatcggggttggcttcactggtgaattcaccggtgcagtatgcccggacttcctgaatcagcgggatgagtctttcccccatcagactgggagtgcccccaccgatataggcggttgcgcatgaatcgagtaggccttcgtgctcaagggcttgcagctcactcagcgcaacggttatatagcgctcaagtgcagggttgtcagtgtggctcgccgctgagcagaagtcgcagtagagacacctgcgggcacagaacgggatatggaggtagagtgcctgagcgtccgacaggtggtagcgctcctcccaactgtgggccacctcagtcaacctcttcgccataggcgccataggaggctttcagctgatcgatgtagtccagatagtcatcgagcgattcacagtgcatcgcacgctcccgccaagctccggcatggggaaaccctttgatataccaacctgctaaggaccgagcccgtgcgagatgcgctccggtcgcctgcagcaggcgtagctgcagcgcaaaggcgttgagtcgctcctccacgctgggggttctgttgttacctgtctgtgcatcgtggaagatccaggggtcgccatagctgccccgtgcgaccatcactgcggtgacgccggtctgctctcgcattgtgcgtgcagtctcgccactcatcacatcgccggagccgatcaccggcaccgagatcgcctcgacgacatgtttgattgcctcccaggaggcttgacctcgatagagctggtgtgcggtccgtccatgggctgcgattgcggagacgcccgcctgctcaagtgcccgggcaaactccggtgcagtctcctcacctttggcaaaccctttgcggatctttgcggtcaccggcgcatccgtttcctcacggcaggcacgtacaagcccctgtgcaagctcaggattctccatcaacgcagagccctcccccttgcgggtgactttgggggctgggcaggccatattgatatctatcaggacaagcttatcgccgagacgctcgctgaccgccgcggcagcctctctaaattgttcgggcttggagccgaagagctgcactgcaatgtcaggctcggcctcgtcgggcagcaccagatcccaggtcttctgactgttgaagtgcagtcctgccacggagaccatctctgtataggcaaggcctgcccctccgcatctcgctatcagtcgataagcgctgttgctgacgcccgccatcggcgccatcaggtacccggcttgagctagccgctctttcaggctgcctttgcgcggaaaaggtcggggcagcggcgagaggccggcaccttcagcataggttgcaagaagttcttttgttgtcactggccatccacctttagcacagccagaaaggcctcctgcggcacatcgactttaccgattgccttcatgcgtttcttgccctctttctgcttctctaggagcttacgcttacgggtgatatcgccgccgtagcacttcgccagaacatctttacgaactgccttcacggtggatcgggcgatgatcttgttgccgatggcaccttggattgcgacgtcaaattgctggcgtgggatcatctccttcaacttgtcgcacaagcttctcgccattgtatacgccttatcccggtgaatgatgaaggagagggcgtcgaccggctcaccggcaagcaggatatccagccgtaccaggtcagaggtagtatattcccccatatcgtagtcgagcgaggcgtagcctttggtgcggctcttcagctgatcgaagaaatcgaggatcagctctgccagcgggatatcgaagtgcagctcgacggtcttcgaagagggatagatcatgtcggtcgtctcaccgcggtgatcaacgatcagctgcatcactgcgcccatatagtcaggcggaacaatcacctttgcgtggagatacggctcctcgatgtggtcgatctgcgtcggacctggcagatcctgcggtgaggtgatcgaaaccatcgatttatcggtcttatatacgtggtattccactgaggggctcgttgcgatcagatcgagtccaaactcccgctcgaggcgctccttgacgacctccaggtgtaggctacagagggggaaggcaaggaaaccgacaacgaagcacgacacggaagccgaagcctaacgctacagagttctccggagtccacacgagcgacggatcattgaccttgagcttctccagtgcgtcgcgcaggttctcaaagtccttcgtatcgatcgggaagagaccgacaaacaccatcggctttgcctcacggtaacctgggcaggccttcgccgtcgggcgcttctcgtcggtgatcgtgtcgcccgtacggaccatctccggatccttgaagccggtcaccacgtagcccatatcacccacgtcgagttcgtcaagtggggtctccttcgggcgcttgcagccgacaccgtcacacagaaacgtgtcccccagtgccatcatcttcaacttgtcaccttttttgatcgtaccatcgaagacgcgcaccgtcgccaccacgccgcggtactcatcgaagtatgagtccagaatgagggccctgagcggagcatccgggtctcccttgggcggtgaaatcagatagacaattgactccagcaggtcgtggataccctccccggttttgccggagacaagcacggcgtcatccgccggaatcgcgagctcatcctcaatctcctgtttgacttcctccgggtgtgcggaaggcaggtcgatcttgttgatgaccgggatgatatcgagattcgcattcatcgcgaggttcgcattggagacagtctgcgcttcaacgccctgcgtcgcgtcaacgaccagcaacgccccttcacaggcagaaagggagcgtgacacctcatagctgaagtccacgtgtcccggcgtgtcgatcaggttgaggaggtactgctccccatcgtccgcatcgtacatgacgcgcacggcattcgacttgattgtgatgccgcgctcctgctcgatcgccattgagtccaggatctggtccgtcatgtcccgctcggctaccgtgtgagtctgctctaggatacggtcggagatcgtcgatttgccgtggtcgatgtgggcgataatggaaaagtttctgatatgcgaagtgtcaatttttttcgtcatacgtcatcttactcagccgttctgaactacctaaagttaggccgcccatatacggacggcctatgaaattttgtttgatggcctctatcttaccaaagcacctataaaatacccaaattgaatctgctatactgattgtttgacctcgccgtgtccgggttttgaaccccactccaagcccagaagaggtctcatagttttgcactgaaaggaacttcgtcgtggcaaacatcaagtctcagaagaagcgtatcaagactgccgagaaggcacgcgtccgcaatcaagcagtcagatccgagctcaagacctatgtaaagaaggtccgtgtcgctgtcgagaacggtgacgctgaggaagctcagaaggttgctcgcattgcaaaccgcaagctcgacaaggcagcttccaagggcatcatccataagaaccaagctgctgagcgcaaatctggcgtccaaaagcttgtgaatgcccttcagaagtaagtatatcgcttcagacgaacaggttagagggcatcgcgtgctggcgatgcctttcttttggttcttcggcgtctctcgtgggtagcacaggccagctgtctctgggccgagaagttgcgttttccagtggaagatcctcgtcctgaagtatctggtgttcctgaagcccctggcagcgctttttgctggctgggccatgtcttaagccatgtcgcgtatgacctctaagactcccgtcttgtccccctgcgtgctccttaagctcatctcacttgccgcccttgtcctttgccttccgtgatagcgcgggcgcgctagcggtccaggtcggccatgatgctgatacagctttggtcgcaccttttggcggtgtcgtctgtacccacacgcacgactccggagtagtctgctgcatccctcacctcggcgacgactctgctaagcagtctctatatgcgcgtgggctgtctcgtgcagaggcttatggccgcaacgctcatgccaaagagggctatcacgtatcagctgggcctcaaagagcgccgtgatgcgtctttggacggacctttcagggtatccttgcggcaggcacgctgtccttggggccctcaacactgcgccgtgcacgatcgtatcgtattgccagatgccgagatgccacaaggtcctctcgcgcctgccacaggtgctgcagcgcctgtggcaggcagggctcaccactgcccggccttgacgcgtgccaccctcacagggagctcgtcccgcgctcatctgcgcccctcaaaccagatatcgaagagctccattcatccctaatgaactgcgccccaaatcctggacgccctaatagagactgagcctagacggcctggttccggaattcctctggggtcaggccgccgagcgccttctggcgcctgcgggtgttccagaagattatatatgcctcaaggtctgccttgaacgcctcgaacgtgtcccagtcattcccgcggaagaactcgtccttcatatggccgaagaggccctcggtgcaggcattgtcgaggcagttgcccttcctggacatgctctgcacgatccctgccccctcgagcttggagcaataggcctcatgctggtactgccatcccatgtcgctgtggagcagcggatgcttccatgcggggagcttctctatgagcatgcagagcatgtccatctgctgcgccatgtcggggtgctccgatatggaccatgcgacgatctccctgctcgagaagtcgtagagcggcgcgaggtatgccttgccgaacgagcacctgaattccgtcacgtccgtccccatcttctcccatggcccttcggccgcgaagtcgcgtcccagcaggttctcgaaggtgctgcccacgacccccttgtacgagttgtatctgtggtagtcggtctcgcgcctgatgccgcaggatatccccatctcgtgcatgatcttgagcaccgtcttgtcggctatgcgcgctccgtcctcgctgcgcaggcacatggctatctccctgtggccgcatccgttggggcagcgcgagaatatctccgccacgcgcttccagagctttggcctggtgggtctggcgggatgggagagcgcatagtggtacgtcgacctcgcgagacccgctgccgccagcaggtcgtcgagcctgtagccctcctgcgcgagcgcatgcacggcctctgccttcgccctggtcagatccttccccttccggccagggaccgcagtttttttaggtacgccacctcggcctcgagctgctgctcgcgcgtgagcggcctcgctgcggtccccgatcccttcgggcgtcccttgggcttcggcctcagcgcctcggcgccgcccttgcggtatgccctgcaccacctgtcgagcggggccagcgacatgatgccatagctggccatcgcatcgcccttggacatgccatcctcgacgacggccttcgcggccgcgaccttctgtccgtatgtataccttgcctgcttcccgtccatcgacagcagcgcctcgcttccgaacgccttccatatctgctgccattttctcacggtgctgcgcggcatggagagctccttcgccacgctcttgtatccacgtcctttcccgaagagctctgccgccttcttccttgcctcgatgtcgtgcttgaccctcagatcggtatgcatgaatatgcctcccatttcctatatccaggaaatgggaggcagttcataagccccctggggcctcttaaagagccttgtcagcatacctgctttaagcatccatatcacaccttaggatcgcatccgtcgccaaaagcttggctgtcagggcgccacgtgctcaagggatgcaggagtattaaccataagtagcgaagagcacctttttagcaattgtaggtagtctggctcggttccccgcagatactcgcaagcaaagtgatcagggtattgcggacatctgatccgctcttgattgcgcggtctgtttgagcgcaagctttcagggctgccaccagctcctcacgggagaacttccgtgcccaccgggtatagtttttcacctgccaggactgcttatgcagctcgctggccagggcgctactctcaccgcgctcctccaggctctttgcgcagatgagctctttcacgcgtcccgtcagataggctatggttcccggtcccactgaggtcttcatctgcgccaacagctcaagtgacttcttaagattgcgctcacacatcgcatccgccagatcccacggcgtgggttccacgattctcacgacattatcagtgacgtcctgcagacggatgtggcccggttcctgtgcgaggttcttaagcgtctcaagctcgctgcttaacagcgacatattggtccccagccgtttgaccagctcctgcgctgcatcgggatcgatcgttgttttggccttacgggccaacttggtttggaccgcctttggcatctcccaaggcttcggtgtcggacaattgatagtagcctcagggcccatcttcttgattttgctgtagagcttggactttacaaaggcatccttcttacggctctcctcctcacagggaactgaggcgtcaagcaataggacactgccctcattggggttatcgagataatcaaggagcatcttctgtacccgtgaggagagcttctgcgcgtcgtggacgatcaccaaccgatatttgtcacccaccggcagcgcttcgaggctcgtcttgagggtctgcggctccaaatcgccacgagcatccatctcgtccaggttgaaggctgcaagagagtctttcacatattttttaaggtggctcactgtatcagagcgcttgatctcgttattgcctaacacgatgtatgcacgtaacagattgctgcttctcggcattcttcactcctcaaatctctgggatccattgtccctgttttagcgctcggtgtacaccgcaatactgtctttgtttgcctttaccgtaattgaacccacatccttggtgcacaaaaacttcgccccggcgctctcgagtgtatcaacacattcctgcgcgggatgcccatacttgttcccttctccggcagaatccagcgcgagttccggagagagtcggtgcgcttcttcctcgttgatggagacctcagagccatggtgcccgactttcagcacgtcgatgtcacctacctgttgctctatctgcgccagctgctcttcctccgcatccccggtcagaagtccccgataatgggcggcgccgttttgatattccagcagcagttcgatagaatctccattctcatcaccggcaaccggttgtttaggccagaccatcttgaggtgaaagtgctgctcagtcaggtttgctcctgtcgtaagctcctgtgcctctctgccgctcaccgcctggacggtctcctgcagctgtctgctcatgtgatttttcaccccgttggccacatagacctgatccaccccgatgcttcctttcaactctgccagtccaccggtgtggtcctcatgcagatgcgtcaggatcaccgcatcgagatgttcgacatgcagccgttccaacggggccaagagtgattcctgcggacccgcatcgatcagaattgccgagggaccttcctgcaccaagatcgcatccccctgtcccacatcgagcaccacgagccgcgccggagcgaaccagcggtagcggatcatcaccgcgaggacaatcaggcaaaacgcaggcacgactctgcgccacacgtgcgcatgcatcgtcggccacagcacaatcagaagtataaaggctgcaagtgcgacgagctcaatccatacacctacaccttggatctcgaggctcgcatagggaacgcgtttgaggccatcgagcacccacactgcaaaacccgcagccccatcggctcccctcagtgccagtgaggaaagcgctggaaacgggacgaagcaggccgcgagcatacccaaggcaatcaggaccgtaaagggcaacgtaatcaggatgttggccaccggagcgatcagcgaaagtgtcccgaaagtctcgagacagatcggaacggtcactgcctgcgcggtcagcgtcgaagccaacgttgcacgcacctcgctctcaatccatctcaatgaacggttaaaccggggtgaaaaccttcggatatacccgatacgtggcaccaacctatcgagcagatagaggctgtagctgctgaagaggcacaagcccaccaccgcagagacactcagaagataacctagctgagcggttacccccgagtcgaccaaagcaaagcacagtgcgacaaaactcaccgagctgaggctgtggcttcttcgccctaagatctcacccatcaaggctatcgcactcatgcaccatgccctgagtgcagacaccggcgctccacagaacagtacaaagaggccactggctatcaggctgatcaccatcttgtggactttcgagagccgtgcgccttcgagcaatgccgcgatagctcctgcaacaaccacgaggtgccctccggagacggccaccaggtgagagacgccgcaggctgcaaagagctcgtccagaccagtgcgttcaagcggtatttcaatgcccgcgaccgatccgatcaccagtgaacgctcaggggtatctgacttttcaaagacagagaccacccgtttacggaatccaaagacgagccctctgagtccgtggggtcgctctcgatctgtgacgttcacgcagcggactgtcgccgcaacaccctgggcgcggctccaccgtccgtagtcgtcatcctcaaagaatttggttcgaccgatcagatgaacagtctctccgttttcaaagggcatgtccgaggtgagccaaacttccccatccggagaaccttccgaatgtgcacgagcccgacaacgatacccataggtccccttggtcgagtcacgggtgatctcgaaggcccaggccgaaggtgccttagccgcaagcgcactcgaaaaatcagccactgaagcaacgagcaagtacgcagcagagagggaggcgatagcagagactaagagcagcgtgaccagatgctggtggtacttccagctcagtgcagcgagtagtactagccctatagcagctgagatgatgatccagcgaggtgcactcagcagttcactttgataccaaagacagatgcgctcggtggtgataacaacgatgagagcataaagggtttcagggatgtagggccgcgccggcttgtgcacttcctcagacacagattcggctttcaagctttgcgtacttctttttgccgataccggagacccgcatcagatcctcttttgaggtgaagggtccttgctccgtcctgttctggacgatcttctgtgctgtcgaagccccgacgccgggcaaggtctccaattcttcagcagtggcggtgtttatgttaaccacggcggtgttcacagagcccgaggaggatggggaagaagcagaagaagccgtaggggtagacggcgaggcgctactcccagatgatggagaagcggtatcgctctgagttgtctgtgcagtggcagaagtcgcagcgttctccccttttgtcgggatatggatctttgtcccgtcagtgatggtagcagccaagttgatctgcgcggtatccgcatctccagtgaggccaccggcagcctcaatcgcatctcgcactcggatgtctgagccttccacgtcgaagacccctggctggttcaccgccccatcgacatccactacgatccgagaggtctgtggctgccctttctgctcatcctgcttggatgctgtatcgctttcgctctgttcggcttgtaccggttgctcaactgtgagtgccggccgcgaaaggaaccgaacggccccaaagcctaccagtacagcacagaccacaatcaggaccagaaccggagagcggcgccctttgaggctgagcttgttcagcagtggtgaggtgtgcgatatatctcttctctccatacaaatacctccctgctcaccagtgtgaacggggagatcatctgacagaattaggattcgctcaggatcgaaacagcactcaaacagcgctcaaacttgcttgaggatgctcactcgttttgatctgacggcattgctctggcaggagcgagctccacatgatgttcacgaaactgcttaggcggacggtaggagacgcattggtccgcatcgatatattcgatgttatcgatcagatcgtcgatcatcccgtcgtggtcaaaggagtcccaggcctcatgcacctgatccatctttgcatgagtttcaggtctgcgcggcataaacagcgtgcaacagtccggcgcggtcgttgaggagatatcgtaggtgccgatctgacgtgagcgctcgatgatctcctgcttgtcggacccgatcagaggacgcagcaccgggattgtcgcgatctcatcgacagccgcgatattctcaagcgtctgggaagcgacctgcccgagcgattcgcccgtgacgagggctttggcgccttcgatcttggctaagcgctgtgcgaccgcaaacatcacacgccgataggtgatgatgcgcagtttctggtcgaccttgagggagatctcgcgctgtctggcaccgaacggaacgacatagagtcttccgatcattccggcaggggctagggctctcacgatgtcctgcgtgagccactctgaggtatctgacgttaggggtctacccgaaaaatggatcgggacgcagattgcaccgcggcgtccgaccttccaggtagcaaccggggaatcgaaccctgaggagagcagcgtcacgactttgccggcagtaccgacgggcagtccaccgaccgcacgctccgagagcgcataaacaaagacgacgccctgaacgacgttgacatgaaccgttacatccggatgatggacatcaaccttcttgtccgggaaggcctcgcagagcttgttgcccacgagacggttgatatcaagggtgtgcatcttgtaatcggttgaggacttatgagcgtggaccttgaaggtcttgaagccctgcgcctcgccgagtgcatcgattgccgcctggcagtagacatcctcttcgcgtgggcactcgtgtgccatcgatacccgggcgacgccgggcacctgagcgattaaattcgcttccgcttcggttgcatcgcccttgcatgtgaccaaaagataccccgagatgcggcgcaccgttgtaaccggggtatccttcagcgcaaacttcaggttcgtcacgagctggttttcaaagaaaccgcggtttttacctttcaaaccgatctcgtggtagtgaaccaagcaaacacgttttgttgtagccatgtatctaaaaacctggcttactcttgcttcttgattgcgttatcgaagtcctctt

SEQ ID NO: 390 - DNA, 17376 bp, Unknown
  Metagenome-assembled genome
gagtctcaattgtggcagttgtgcagtgaccgatgtttttatgctcttgtacccttgaccccgagggtgatgtggataaacctcgtaccatagaaaagtcaaacacgttggaatagcgaggaagcatggtgctggcaggcgtcggagtcgatatcttagagatcgcacggatggagcgtgcactgaagcgcactcctcatatgaagacgcggctctttacgaaagaggagcaggaatactgcgataagtcagggtggcccgccgaacactatgccgcgcggttctgcgcacgtgaggcagtgctcaaggcgttgagtaccgggttctcgcaaggggtcggctggcaggatgtctcggtgacgcgcgatgagtcgggacggccccgtgcgctccttaaggggagggcaaaagagatcgcccaagagcagggcatccaggaagtagccctttcgctctcacatacccatgagctggcgatcgccaatgcggtgtgtgtctctgaggaggtcaggcccaagaaaaaggaggcctcggatccgcgccgtaccctcgataaggcctttcgggaagcccgctccgttctggacgatctggacaacattgaagatgaaggtgcgactcctgagcctttagaaggctcggatgcgctaacatcagaacagaaactattgcagaatcagggcgcctcgggaaaccctgctggcgaaggggatgaacatcgtgcaaccagttctaaacgttgaagacgtcaaagcggttgagaacggcctctccaaagagggagtcagtgtatctgaactgatgcgccgtgccggcggtgcggtggccgatgaagtgatgcgcttagaggatatcagaaaagtcgctattttagtcggctttggcaacaacgggggcgacggatgggtcgccgcagcgcagctcttccggcacgggtacgacgtgactgtggtgtcaccgattgagcccgatgaaatcaagagcgacatcgcgcgactggtagcccagcatacccgtgacgccgaggttccgatcgtggtcggaccgccccgcgaggatctggagcagctgctggaagattccgacctgatcgttgatgcgatgctcgggaccggcttccacggtgagcccaaagcaccctttgatatctggatcaatacagtgaacgcctctgaggcccccgtcatcgccgtcgatgtgccgtcgggactctctgcacagactggccatgcgcccggtgagtgcattatcgcggacgagacactgacgatgctgtgcctcaagccggggctgatctcagatatgggccgcgacgtgaccggcggcatcgtggttgcgcccttggcggagcagaccgagcgtgtggttctggagtcggatccagtagcctggcgcgttgagtctcaggactatgcggatgtcctgcagcccacgatcaacaatatggataaatattcccgtggctctgtgcttgtagttgcaggctcctcccgctttccgggtgctgcactcatggctgcgaaagctgctgcacgcgctggcgcaggctacgttacgcttgcggtgccggtcacgatcgctccgctcctgcagcagcaggtaccggagattccggtcgtcggtatggccgcagaccaaggcggaacctttgccaagcaggcgatccctgcgatcctcaagcttgcggagcgtaactcctcgatcttggtcgggccgggcatgcgcgtcaccgcaggcaccatctcagtcgtttcagcactcctcaacgcagaggtgccgctcgttgtcgatgcggatggattgaactgcctctcacgtctgaccaacaatgcgctcgaccagttcccggaggtcacccggcgggataagccgctagtcctgaccccgcaccgccgtgaactcggccgtctggtcggattgcaggatacacctcctgattcactcaccgcctgccttgaagcggcgcgtcgcatcgtctggagcgacggtggcagtgagatctgcgttgtcgcaaagggcagtgctacggcctgtgtcggcgtggaagccgctttgcttccggagccgggcacctcagtgctctccacggcagggtccggcgatgtcctgagcggtatcatctcagccttgctcgcaaaggatccggaggacaaggaagaactgtcgcttctgtgctcgctgggctgcgagatccatgcgttggccggatcgcgcgccgcaaagcgctatggttctcatggagctatggcaaccgatatcatcagcgagatcgggttggcgtcagactccctggagcagcacgtggaagagctgctctcttcggatgatacaaaggagtaactgttttcatgagagaaaacaattgcccgcctgaccgctgggcctgggtggagatcgatctcggcgcggtgcgctccaatgtgcgcgcattcaaaaaacagcttgagtcgggcgtcaggatgatgtgcgtcgtgaaggccgatgcctatgggcacggcgcggtgcgctgtgcggacgtcatgtcaaaggccggggcctactcctttgcggtggcgacgccgagcgagggcgtcgagctcaggaagagcggtatcgaagagccgatcgtggtcttgagcgagcccccaatctctgcgatcccaatgcttatcgagtacgatctggagccggcggtctatactaccgagtttgcgctcgccttcggtgaggcggccgcagatgccggcacggtgggcaagtaccacatggcgatcgataccgggatgcaccggatcggggttacccctgatgatgccctcgatttccgtcacgcagtcgacttccaccgcggcctcacctgcgctggggtcttcacgcactttgcgaccgcggaggtccccgacgactgggatttccggatgcagtgcaagcggttcaccgatacggtgaacgcgctcaagagtgccggctatgagacgggccttatccactgtgacaataccccgggcaccattctgcacaaaggtatgcagttcgatatgtgccgtgtggggatcggtctctacgggctacatgcggctccgatcacggtttcctacatcgacctgaagccggtcatggcagttaaggcgcgggtgacccgtgcgatcgagccggaggtcggtgaaggcgtcgggtacgggatgacgtaccgtatcgcgaacaaggggacccagattgcgacgattccactcggttatgcggatgggctggcccgggaactctcaaaccgtatggacgttattgtgaacgggacacgctgcccgcaggtcggcaacatctgcatggaccagacgatgtttgcagtgccgcctgcctcggcgaatccctttgcgccttcgacgcgggtgggctatggggatgtggtgacgctgatcggtcaagacgacgatgaggctatcaccttggatgatatggcccgcacccgtcgcactatcaactatgaagtagcctgtgactttggcctcaggctagaaaagatctatgtctgaacaacctgtcggaggtgcaccccatagaggacaccgccgcaagccgcggacgtatatgagtgatgcggagatgtatatggcaatcatgcagataccggggcatactaaccagaagccgcaggaggtcaccctagaagaggtccaagcggtgctcggggattgcatgcgctgcccactcgggcagacgcggaccaacatcgtgttcggcgtcgggaaccccaacgcacgcgtgatgtttatcggtgaagccccgggcagaagcgaggacctgcagggggagccctttgtgggtgctgcgggtcataacctcgataacctgttgaagctcgcaggcctcaagcgtgaggatgtctatattgccaacgtcctgaagtgccgtccaccgtcaaacagaaaccccaagccggaggagatcgaagcctgcgcccccttcctgcgggaacagatccgctctgtctggcctgacgtaatcatctgcctcggtaattttgcagcccactttgtgctgaggactgagcaagggatctcaagtctgcgtggacggatgcaccagaccgggcactttgcggtgctgccggtgttccatcctgccgcggccctctatcaccacgagtggcagcagctgctcgacgaggacttcaccttcctcggacagtggcttaaagagcatcccgtaagcccaacaaacgggggagcgcacagcgatgagattgccaaaggttatagatgacacgcactacgtgtcccaatctcctaaggagaccaagaacttcggggagatcgtcggcacgcttttgaagccaggggatgtgctggtactcaccggcgatttaggtgccggtaagacgcagttcactaaaggtgtcgcccaggggatgggcgtgaaggatgaggtgacaagccccaccttcacgatagagatggtctatgaggggacggatatgccgctctatcacttcgacctctatcgactgaatgatgaggacgagctggaggatactggcctgttcgatgcgctcggtaccgatgggccctgcctgattgagtggggcgagcagtttgaggatgcaatgggtgacgaacgagtcgatgtgatcttcaagcgcttggatgcggatacgccggccggacaggaacccgcccgctccattgaatttgtcccccacggcgcaagaagcaccgaattggcttttgcactgcacgcgcgcacggtgtcggccaggaaagaagattaggtagttaaagacggtgagtctcgagttgaatacgcagtatgttttggcggtggacacctccaccgatatgttggcctgtgcggttgttgcgtatgatccaacgcaggaaggcgtcaagaaggtcaagctgctcggctgcagcgaccacaagtgccgcagacaggcgaacgtggagttagtgggaagcgcctttgatgcctgtagacaggcaggaatcacgtgggacgacctcagctcagttgtcgcgggacggggtcccggctccttcaccggtgtccgtatcgggatcgctaccgccaaaggtattgcagtggggcttggcaagaagctctatggggtctctacgctcgatgtgacagcctggcatgcctggtttgccggcatcagaggaccattggcagttgccaatgacgcgatgcgcaaagagatctaccccggaatctatgtgttggatgagactggagctcaccgacagttcgcgcgtgagaccgtgatgaaggccggcaaggtcgtcgaagcctgggctgagctgcctcagaaaaccggcggcgcgattgccctgaccggcaacggcctcgtcaaataccgcaagcaatttgaggatgcgggctttactaatatcgtagatgagaagctgtggttcccctccggtgaggggcttgctgctgcggcggccacctcagatccggattccttaggtaatggggatcccgcgctcgtcctgccgctctataccagactttcggatgcggaggagaacgagcgaaagcggttggggctcaagatccctgcctcggtcgatgtcgccggggtcgacgatatgctcgcgagcctgcatacgcagttgcggccaatgacggtcaatgactgcgcgcctgtcgcgaagctagaagagactatcttcgaaggctccgcccatgctccgtggagtgaaaacgcgttctatgaggaagtgtcacaaccgcagcgcagctggtggatagcccacgatcagggcaccatcatcggctatgcgggcggtgtactcgcggggagcgactttgagatcgacgatgttgccgtgatcgagcagcgccgcggtgagggcatcgctgagcggctgatcgcacgggtggtctatgatgcggagatgttgggagctacctcagcttcactcgaagttgcgaccgacaatgcgtcggctcagaaggcctatgccaagctcggcttcgaacaagtggggaaacggcctgactactatgcaccgggcaaagacgccctgatcctcaaggtctccctgccgctagcggctgaccctgagcacatgaagaaagcgccggtgtcgcacgcctcgctcacgaattggcccaagaagcctcaggagcgtacaactgagacgcaggaagcgattgctaaagccgcgccgctgatcctctcagttgagtcctcttgcgacgagacggcgatggctgtgatcgacggacaagggcagatcttagccaatgtagtggcctcctccgttgacttccacgcccgctttggcggcgtggttcccgagatcgcctcgagaaagcacattgaggcaatcgtgggagtctacgaggaagcgatggagcaggtcggcaagcacttcgggtgcgataccttgacccctgctgatctggcagccgtcggcgtgaccgcaggtccgggccttgtaggtgccttggtggtcggcgtcgcctttgcaaaggggctctctgtctcggcggggttgccgctcatcgcggccaaccacctcgaggggcacctctttgcgaacctctttgagacccctgatcttgagcccccctttattgcaagcttggtctccggcggcaacacgatgcttgtgtatgttaaaggctggggagactatgaggtcttaggccagacgatcgacgatgcggtcggcgaagcgtttgacaaagtggcgaaggccttagggcttggctacccgggtggtccgatcatctcggagctcgctgcaaaaggtaatcccaaggcaatccacttcccgcgtgccatgatgcactcaggggattactccttcagtctttcagggctgaagacctcggtgatcacctatatcgagggagagaacaaagcgggccgtccgatcaatctgcctgatcttgccgcttcctttgaagctgcggtgatcgatgtgcaggtcgccaaagcggtccacgcagtcaaggagaccggatcgcgtgacttctgcgtaggtggcggcgtcgctgcaaatccacagctgcgtgaagcgtataagaagaccttcagaggcatgggcgtgagagttacagtgcccccgattgccgcctgcggcgacaatggtgcgatgatcgcgctcgtggcgctgaggagctataaggctcacaagttcgctgatctgacgctcgatgcgcatcctaactcaaaattaggggcgtgggccgcctcgaacgcacccacggtgtggcaaggcgagcagacctggcttaagcatacatcctgattccgttattacaactctattactcactctgggatcgctgcgtaaattgagtaatcttgcactacaaagggacatttttttcatgccccttgggtgtgccgtcagcaaggaaagaagatccatgcaacaacgtgataccggctctgcccatcacgggcgagcgaatgtttcccgccgcagtttcctgaaggcttccggcctgaccgctatcagcgtcggcgccgcagatttcttggttgcttgcggtccttcaacggaaacggtcgagatcggcgaagaggaatcgggcagccagcagcggacgttcggcgataacggcacgatgcgtgtcggtatggaagtcgcctaccctcccttcaactggcaggtgtctgaggaaactgaggacacgatcccggttgagggacagagcgatgcctatgcggatggctatgacatctacttcgcgaagaagatcgctgagcacttcaatctcaaccctgttgcctcgaagatggaattttcaggccttgttgaggctctgaagaacgggcagatcgatatcatctgtggtggcatgaccgccaccgacgagcgtcgcgagtcaatcgacttctccgacccgtactggaccagccactatggcctgctcgtgagaaaaggctctgtctatgtgagtgccacgagcctggatgattttgccggcgcagccgtgttaggccagcgcgacaccttgctcgatacagtgatcgatgagatcccgaatgtgaaccacctgacaccggtcgattcggtccccgcccagctctcaaacctcaatcagggtgcctgcgatgcgattaccttcgacgtggaaaatgagaaggggctcttgaaagcgaatccggatctgacgccggtagagatcaatggatcccaggccctattccaagaggacgctccgatcaacgcgggtatcgcgaaggggcaaggcgacacgctacagcagatcaatgatgtggtcaattccgtcccccaggatgaacgccaacaggtgtgggacgacgtgcaggcgcgtctgccggagtaaatcgaagtaagcgattacagatagacatctcttcggcagcacaacagtaggggagatgccgtatctgacaaaggagcttttcagatatggcaaagaaaaagggcaggtttaagcgattcgttaccgaggaccatcgctacgtctttctttctacctcagtgattgcgttgattggcttgtggctttcaagccagccgcatacctcctcgagttttttgagatactcgtacccgcttgagtgcgtgctcttctatctgctcgtagcgtgggtcgtggtgtcactcgtggcgctcgtgaacaagatcgtgaagtggcacggtgacgcctaccagacaacctcacccctcgcgacgccgagggcgaagaagattgagcgctttagctcctatgtggcctggggcatcacgatcgtgatggtcatcgaccgcggcatcatgcgcattgtcgatatcgtgcaatacgcggtgacacaggattcgaatccttcagacttcctcggttccatgatctacatgctctatcagatgcgcagcaccttcctacaaggcatcctgaatacgatcatcatcgcggttgtcggcacgctcgttgcatttgtgttggctttagtgctggtcttcctgcgcctgcagcagatcgaccgctctgacaacgacttcgtcagattctggaaaaaggtcggcgtaggattcgcgaaggtttactccacgatcatgcgcggtacgccgatgatgatccagggactcattatctactatgcgggcaccggtatgctgaccgcgcgaggcatgacgccgacggagatcctaaacgtatggtccccgttcaacgccggcctggtcaccgtctcgctcaactccaccgcctacatgatggaggtgttgcgctccggtatcctctccgtcgatccggggcagactgaggcagctcgttccttaggcctctcacagtggcaggcgatgcgcaaggtcgtctttccgcagggcatcagaaactcaatcccggcgctctccaacgagctcgttatcaacatcaaggattcctcagttctcatggctatcggcgtgcttgagctcaccttcgcggtccgctcgatcgcaggcgtctactacaagcagatggaaccctatgtggccgctgcaatcgtgtacctgatcctgacgatggtcgcgacgaagctcctggacaagttcgctaagcactttgatcccaaggctgctcgagttgtactgagcacctccaatgcgccggtcccccagacgaagcaggtgaagtaagttgagtgacacaaatacgaacgtgcagtccgtcgtcaaagtcgaggggctcaagaaaagcttcggcgaccacgtggtgctcaaaggcatcaacttcgaggttatgcctaaggaggtcgtcacgatcatcggggcttccggctcgggcaagtccacactgctgcgctgcatcaatctgcttgaggttcccgatgagggccatgtgtggtttaggggggaggacctcgtctcccggaccgtgaacgtcaacaagctccgtgagcgtatcggcatggtctttcagggcttcaacctcttcaacaatctcaatgtgctcgataactgtaccctggcgccggtcacgttgaagaagatgacaagagaggaagcggagggtgtggcgctcaaaaacctcgacgctgtaggccttaaggactatgcgcaggcttccgtcgtctccctctccggcggccagaaacagcgtgtggctatcgcgcgcgccctgtgcatggaaccggagctcatgctcttcgacgagccgacgagcgccctggacccggagatcgtaggcgaagtcctttccgttatgcgcgatctggcgcggggcgggatgacgatggtcgtggtgacccacgagatggacttcgcaaagaacgtctccgacaaggtcgtctttatggatgacggcgtgatcgtggaatccggctccccgcacgatatgttcacccatccgaagaagccccgtacgcgtgagttcttgaagcgctacctggaagacgaaaaaagcaacctatagcctactggttttcaaaactcctcgtgtgagcggggagctttgttttatcctgaaagggatacacagaggatggcaaaatcccgtcaaaaggagatctccatgaaggatgggtttgtttcggttgccgcaatcaccccgcccgttaaggttgcggacgttggctacaatgtgggcgcactcattaacgcaatcaccaacactgccaacaaaggcgccaagctgatcgtgacccccgagctcggtatcaccgcctacacctgcgaggacctgttcctgcagacctccttgctcgaggcagcccaacacggccttaagcaggtggctgaggcaacggtgggtctcgatgccctcatcatcgtcggcgtgccgatgcgggttgccggcaagctctacaactgcgccgcagtgctcgatggggggaagctcttggggctcgtaccgaagcagacgattcccacctacaacgagttctatgagggacggcacttctccccaggtcccagtcaggtaagccagattgaggtagcggggtttggatcggtccccttcggggcgaaccagctttttacctgtgacactatgcccgacctcgtcgttgctgttgagctctgtgaggacctgtgggcgcctgatccgccttcgatccatcacgcagtggcaggggcgactgtgatctgcaacctctccgcctccaatgccctggtcgggaaagcgtcttatcgccgtatgctcgttttgggacagagcgcgcggctcgtgtgcggctacctctacgccagcgctggcccgggggagtcaacgcaggatctggtcttctcgcagcacaatatgatcgcggagaatggcacgatgcgcgcggaggctgagcccttcggttccgggcagacgatctccgagctcgatgtgtcctacctgcttgaagagcgccagcgcctctcaaccttccacactgcggtcacccctgagacggcgggctatgtggtgacgccgttccacctcgaacttacccatacgcacctgacgcgctctgtggatcccgcacccttcgtgccggataacgaggagacccgcgacgagcgctgcgaagatatcctgatgatccagagccagggcttagcgaagcggttacgtcacacccactcctcttgcgcggtggtcggcgtctccggtgggcttgactccacgctggcactgcttgtgaccgtccaagcctttgacgccgtgggtcttgaccgctctcgcatcatcgccgtgacaatgccgggcttcggcacaacgaagcgtacacgcagcaatgctgaggagctcgctaagtcgctcggcgtcacgctgcgtgaggtcgacatcacgaaggccgtacagcagcacttcgcggatatcgggcacgatgagagcgtgcacgacgtgacctacgagaatgcgcaggctcgtgagcggacacaggtcctgatggatatcgcgaaccaggaaggtggcctcgttatcggcaccggtgacctctctgagctggcattgggctgggcgacctacaacggggaccacatgtcgatgtacggcgtgaacgcctccgtgccgaagaccctcgtacgccacttagtccactatgtcgcggataactgcggcaacgaggtggaagcaagcatcctgatggacgtgttggacaccccggtttccccggagcttctgcctgcgacggcgaacgggacgatcgcccagaagaccgaggatctggtcggcccctatgagctgcatgacttttttctctactacatgctgcgcctgggatttgcgccgcataaggttttccgcttggcggtctatgcgctcggggatgagtttgacccggtggtgatcctgaagtggctcaaggtcttctaccgccggttctttgcgcagcagttcaagcgcagctgcctgccggacggcccgaaagtgggcagcgtggcggtgtcaccgcgcggggatctgaggatgccctcggatgccatggctcagctgtggcttgaggagctcgatcagatcgatcctgaaggctatgaggcataagctactctgaaatttgtaaggtgaggggaccttggtgtgtatgccgaggctcctcgctttctcagtcttgcccaccccgctgactgcggtgggggggggttagtatctgagcagtaggaaatctaagcgtatacacaaaagatattttctactttgcaggtataacttccatgcattgggtaatatctatactgttcgtgacaacgggttagaaaagcccattccacgcgcctggttcaggcgcacgttaaggaggttcgggaattatgacattgaagcctttgggtgatcgtgtactggtcaagccggcaccgaaagaggagaaaaccgcaagcggtctgtatatctcttcaggcgcacaggagaagccgcagcgcggcaaggttgtggctgtgggcgctggcaagatgaatgacaagggcgagcgcattgttccggatgttaaggctggcgacgaagtgtacttcggtaagtacggcggcaatgaggtcaagattgacggcgaggattacttactgcttcgcgcagacgatatctacgcaatcattgaggactaagttaggttatgtgagctgatatcggaagatatcaacagagctaggagataaataacatggcagcaaaagatattaatttcggcgctgacgcacgtgctaagcttgccaagggcgtaaacaccctcgctgatacggtaaccaccaccttaggacctaagggtcgttacgtggcactacagcgttcctatggtgctccgaccattacgaacgacggcgtgagtgtcgctaaggagatcgagctcaaggacccgattgagaacatgggcgcccagctcgttaaggaagttgctaccaagaccaatgatctcgtcggtgatggtacgaccaccgcaaccctgcttgcacaggttatggtcaatgagggactgcgcaacgtcgcagcaggtgccaacccgattgcaatccgtcgtggtgtggacaaggcagttgccgcggtcgtcgatgagatgaagaagtccgctcagccggtcaacaccaagaagcaggtggctgctgtcggcaccatttccgcagtgagccctgagatcggtgagaagattgctgacgcaatggagatcgtcggtaaggacggcgttatcaccgtcgacgagtcccagacatttgggattgatatcgacaccgtcgaaggtatgcagttcgacaagggctacatctccccgtacttcgcaactgatcaggagagcatgaccactgagctgcaggatccctatatcctggtcactgatcagaagatctccaacattcaggacatcatgccggtgctcgaggcagtctccaagcagggcgcatcgctgctcatcattgccgaggacgttgacggcgaagctctagcaaccctgattctgaacaaacttcgtggcaccttgcatgtcgcagctgtcaaggctccgggttacggcgatcgtcgtaagcgtatgctcgaggatatcgctgttgtcaccggtggccaggtggctatgaaggagctcggcgtcaacctctccgatgtcaccgctgagatgctcggccgtgctaagaccgtcaagatcgacaaggacaacaccacgattgtcggtggtgcaggctccaaggatgctatcaacgagcgcatcgcccagatcaagaatgagatcgagaacacgacctctgacttcgataaggagaagctgcaggagcgtttggctaagctctccggcggtgtcgcagacatcaaggtcggtgcagcaaccgaggctgagctgaaggagattaagcaccgcatcgaggacgcactgcaagctacacgtgcagctgtcgatgagggcatcgtcgcaggcggcggcgtcgcattcctcgagagcgcaaaggctttggacgacgttaagaccgtcgacgcggacgagaagattggtgtcgaaattgtccgtaaggcacttgaggctccggtcaagactatcgcacagaacgccggctatgaaggctccgtcgtcgttgagaaggtcaaggatatgcctgcaggctctggccttgactccgcaactggcaagtggggcgacatgatcgagatgggtgttctggatcctgtgaaggtcacccgcgttaccctgcagaacgcagcctccatcgcatctctgatcctgatcactgaggctacggtcactgatgttcctaaggataccacgattgaggaagctatctccaacgcggctgcccaaggtggacaaggcggcgcctactaaaggtacacaggcgtgaacagtgtctgagtgtttgaacgattgctccgggagtgtctcgcttctggagcttttttcgtgtctcgtgtcgctttactatagaaggtatacaggagtgcactatacttaatcagttgcacctaaggaggggattatggctgaaaagcacgattggctcgatgatattatcgatatctcgcagaactggagcgcggtctccgaccctgtgaagcatgtcgtgaacaatatttcgtttgatcctgagaagacccctcagtggaatccctccgactacaaggagcgtccgcgcgccaattcggtgcgctgcatggacgtggcaggacacgacaccatgctgtgccatgcctgcacggatgtgtgcccggtcaatgcgattacggtcaccgacagtaaggtttcgatcaatgaggactgccgtaagtgtgggctctgctccgcagcctgtcccaccgaggccttcatcgtgcagaagctgatgcccaagacgctctataacaagatcgcccggcaggcggcttcacacgtgcaggtctatatcacctgcacccgtgccctgggacggatccctgcggccaatgagatcgtcctgccttgtgtgggagcggtacccaaagagctctggttcgcactctttatggagttcgacaacatctcggtatacctgccgctcggcgtgtgcgaccgttgccgcactacgaccggtgaggaagcctatgtcaatgcgatcagcgaggcagaggagctgaccggagctcactgtgggcttgaggtcgaagagaaggcgctcaaccacgaggagacccgggagtacaaacgctcccagttcatcgggcagatggcacgttccggctcacgcatgttaggggcagaccgcacaatcagtggggcacaggctttgggccagcgcatccagaaccatacccgtcagatcaatgagctctcccgctcactggagaaagctgtgggtgcgcagaattcccagcatcgccggcgtatgctgacgcagcggcgtgagctggtgatggcggcgctgcagaagtggccaggtcctgccattaagatcaaggagcagatcccgaggtgcgataactccaagtgcacgatgtgcgaggactgcaccaaggtctgcgtcttgcatgcgcttgagatcgataacaccgggcatgtgaatatcgagcccgcttactgcatcggctgcggggcatgcgctgctgtctgccgtgagggggcattgacgatgcatccggctgacggcagcgcgctcgcggtccccgatcccaatgcggaagaggccgagaaagagcgtgagaaggtgtatcagctgaaggcgcagggcaaaaggatgctcgacaacgggctcaaggcgatcgagaaaaccgccgaagaagagtccggagagtcatcgaagaaacatagagcgtaaggagagcgtgcaggcgctcaggaaaaggagaagatgttcccgtggccttatccgttggtatcgttggacttccaaacgtcggaaaatcgacgctgttcacagcactgacgaaaaaaggaggattggcagcgaactacccgttcgctacaatcgatcccaatatcggtatcgtcaatgtgccggatgagcgtctgcagaagctagcggacatcgtgcatcctgggcgcattgtgccggcaactgtcgagtttgtcgatatcgcaggcctggtcaagggcgctaacaacggcgagggtctcggtaaccagttcttagccaatattcgtgagaccgatgcaatctgtgaggtcgtacgctacttcaaggatccggacgtcgtgcacgtcgaaggcaaggtcgatccggcttctgacgtcgatacgatccagacggagctcgtgctcgcagacctgggcaccctggagcgttcgatccccaagctggagaaagaggcaaagcaggacaaggacaacagaccgaagctcgaggtcgccaaacgcctgcagggctggctcaatgagggacaccgtgccacggatatggatatgaccgacgatgaaaaggctgcggcacacgatctcttcctgttgaccatgaagccgatcctgtatgttgcgaactgcgatgaggatcaactgcacgatgactttgagccgctcgaggggcagaagccgatccccatctgcgcagaggtggaagcagagctctctgagttggatgacagagaggcacatgagtatctggagtccctgggcctcaagaagagcggcttggagaccttggcacaggaggcttaccatatcttgggcctgcagagcttctttaccgcaggtgagatggaagtcaaggcctggacggtccgtataggtgcgaaggctccggaggccgctggcgtcatccactccgacttcgagaagggcttcatcaaggccgagaccatcagctacgacgactacatcaagtacaaaggtgaagctggtgcccgtgaggcaggacgactgcgcatggaaggcaagactacgtcgtgcaggacggcgacgtaatgcacttccgcttcaacgtgtaaactgaaagacagacagagcaggtatagaaacagaccaggcactggagattctctcgtgtatcggacttcatttctagacatatttctcttctgaattatattgatcaggcataagagggccagtaggattaacatcacaaaaacagccaacagaggtgatttgttccactgcgtgttataggggtgacccga

SEQ ID NO: 391 - DNA, 7894 bp, Unknown
  Metagenome-assembled genome
actgcttgcggctcaccctagccctatttcccttatgcatagaggcttcctcattgaccacctagctgtgcatcggattcgccgcaggcacgaccatgaggtttcctgtccatgctgccttgcgctctcgtcgagctcgatgcacccgcccggcaagacgatcgaccgccatcctccactatggaacagcgccttcgacgatctcttgcgtgcctgcaaggatacgtcgtgctgctggcggcgacatgcctgcgcatctcgggcataggcaaggtgcgtgaggcgtgcgtctccctcgacagcagacgcctccggcgcacctctgtcagctcatgcctttgagcgcacgctcacctcttcgatattggagcgcagcgtgatcgaggagtcgatctcatcctccatgtggtcaaggcaagacgaggcgacatggcaagggcggtctcggtctgcatggagacatagactctagtctccacatcgaacaagccttgggccgttcggcgaccccacggaacgaccgtgcgatctcgatcggtgttcccatctttcattgaccttgaggacgttccccttcaaggtccgagcgtcgagatgacagacccgcacctccttcaatgcgctgcctcgcggcttctcgctgtcagcctgctcggcaagccccagattctttgcgtaagcgttggcccacctcaccttctcgttccggtgccgctccttgccaaagagcacgcagaccgggcctgtcccacggacgaagaagaagccttcgagaggaaacatcagctgcgcgaagagaatgatcaggaagggcattcctgaaggcagcctcaggacgcagcatgtcgctcttgctacaagagctgattaatcgaagaaatgaagtagtgcgacagagtagcgacgaacttgcaagagtacacaaaaaaacaagaccagccgcttgcggcatgggcctttctttctcgacactcggctgagctgcctttctctctcaggagttctgcctacctggtaccaggcctctgcaatcgagttgccttgtgagtatcacattgaccttaggtcatgcctgggatcgacgggcgtcagtttgttttgtgggcggcattccccagaggctccgaccagcctcctgccctgaaccgccctcgcccccatctcgatcgacgagcgcggacaggtattcgtagcccttccttttcgcatggctaaccgcactcgggcctgagggccgctgatataacggcatccccttccctttcttccgtcttctgcccatctcgcggcctcttcgggctcctgcgcctcctcgcgcgtgagaggcggggatctcgcgccccgatgcctgcctggagcccgtatccgcgccatggtcggatcaacccccctgttaactgtaatcttttggggggacagtgggattccgggacatggcaacagatatgctcggtccagatacccacccagcccacagtccacacagattgaagagattatgaaatgttcgctaagcgcaagcggatatagaagggcaaagtcccgcacgaagccggaaacacctcaaacactacacttaaatattgcctaagctatcgactactacagaagcacgtaaggaccaacccgaaggacgctaggcatcagaggatttgccgcgaagcttgaggccccacgacaagaaccttaaacgactggaccaaacagtatccgctccgcatcgatccggacatctgggatgccatacagaggtgggcagccgatgacatgaagagtgtaaacggacaggtcggatatcttctgcgtgatgccctgaagcgggcaggaaggttgccgaagaagagcagcccgaaggacaagagaggagagcagtagcagcagggaggcacccataccaggtgcctccctgtgcttgtctcattgagctcggtgcggctgtcctgcatcagaagacgctatcgtctgctttcatgagagaccacttccaggcagggatggcgcggatgtgtccagcatcgctcggaatctctgcctcttccctgagcgtgatgatgaggccgtctttgagatgggcgatattcatggcgcgttcgagtgaggacacctctcgcttgcgggtcttgggacgcgacatgtccgccgtgacctgtatgggcagatagggctctgcggcgagcgagtcgcccaccaggaagtcgaccttctctgtcgtaggcgctgtgtaggaagtgaccacgtctggccttgtgcctcttgcgcgccgcatgagctcgacatagatagcggtttcgagtctctttccgacatcctgctggcttgcgcgcgaaacagcatatgccatgccctgatcgcatgcgtagaccttaggaatggcggtcgtcttttctgcaagcgcgacagagtattccttgagcatgctgatgaggtaggactgttcgagcagatgcactccttcattgacggtatcccaggaggtgtggtagccgacacggcgcagcatatcgagaagccggttgactgagaaatcgcaggcggtgtctctcagggcaaagagcgccatctgggtcgctattgtcacgtcgagacgggtgctgcgttccacgacgtcgcgcactatcacatcgcgtacgtaggactggagcatcagggtgcgggtcggagcatcgagtgcctgcacacccggaaagcctccctcgatgagatagcggtcataggcagactcaagagatgtcttcatctggggagaaaccgaatccgcatcctcgagctgtccatcttcgggaagctcgatgctgtggaacctgcagtactcggcaaatgaaagcgggagcatatggcattcgagggaacgtccgcggaatgtactcgcaatctggtctgaagacagcttcgaagatgagccggtgatgacaagtgtgaccttctcatgctcggctacacgctggcagaagccctgccatccatctgactcctgcacctcatcgaggaagagataggcaccttccttgcgggcttcaggcacctgccgccaatactcgtcgagcacgtcgttcagaagtgtggtcgaggcgggcttcaggcggtcgtctgcgaagttgaaatagaagatgcggtctcgtggtacaccagcagcgagaagacggtgtatgagctggaactcgtagaatgtcttgcccgagcggcgaacgcccgtgatgatatggacaagattgaagagtgcgggctcgggcaggctcgagatgatgccctgacgtggcctcacctcggggaatgggaattcgagcgactcacgtacgagtgctccatagccaggtgttgtttccatgattcctcccgcgctgttccagatttctctgctacgtgctgctgatgagctggaagtgcacagaacttctcgctgtcaatgataagtttaactcttaatttctcaccaacaacgagaagttatagataaaacttatctctgatgacgagaagttctgactatatcttcattccatcggagagaagtatagggaaatcttccaagtcccattgagacctctgtaaatggagaacgtgcacctctccggctccagagagatgcacgccaggtaccaagaatggtgaacgcctcagctatacctcataagccgtgagccacagattgggcgctccacaatgggcatcattggcagccgagaaccagcggccagccatatcgttctgctcgacgagaagcttcacgtcgtcggagaccgtcgtgtcagcatccatagcagcaaggatatcgtcgtaagtcgtgctgacatccttctgagcgatgactgcgtcgctctcggttgcgtcgaagaccatgctctccttggtgctgttgtcccaggcgctccacttgtcgagtccgtcgccattcgggttgccggtctcgaggaagttcttgaggtaggcgttgaatacctttgccattgcttcatatccaggctggtcgaaggtattgggaatgagctttgcatagttgttctcggtggagagcatcggcacgaaaatgccgtggaatgcaccgtaggtatcgatctcaacctgggaattgtcgctgccgaagtcgacctggcagacatagatgtccttgtcgtaggagccagacatctgctcggcagagcattcagcattgaagatgcggtacatgtcgcagccgtacttgatggcaaatgcctgggcagccttgagcttgtcttctgagagcgcggccatgggatcggacttccagaacgcatcgaaggcgctgaacatgctgaactccgtggagccggtcaacatgatgagcggcacagcgtgataggaggcattcgcgaagccacccttgggaagcgcgatgtcgtcctcgtagaggtgcgggaagacgctcatgcggatggaggcattgcccataaggggtgcaagcctctcgccggagaccgaatagagccagtcacgcactgcactgtcatcagagaggagccactgataggcgctctcttcgtctgcagccttgccatcctctatagcaagcggcacaagagcagctgcaatctttttctgggaaggctcgagctctgctgtcgtcattccgcccgagaatgcgatggccttgtcgaacttgccctcgaacagcgggctcatgagcatggccatgacatcgcggccgccagcagagaagccggataccgtgacattctcggggtctccgccgaatgcctcgatgttgctgcgtacccagtcgagtgccgctgcgatgtcgaggagcgtgaagttgccggtatcattcccgagggcagggaggcagttgaatccgaagaggcccaggcggtagctcagcgagacgtagacacatgagtcattcacgacaagatccttgccgggaatctcctgcgcatttccggtctggttgtttccgccgtggatatagacgaggaccgggagcttgcttgcgccttctgtagcatagacatcgaggttgaggcagtcctctgtgccagtgacctcgttgttcgtatactgcagcgctggctgtgctggctgggtgcagtcacgctcttccgtccaggattcgggctcttctggcgcctgccagcggagctctccctctggagacttgccgtaaggcacgccgtaccagatgttcacgccgccctcgttcgtgcccttgacgggaccgtatgcagtctttgcgaccaagctattgctcttcgcggcatctgtctgattggatgagccgctctgctgctgtgtggttccgcagccagcaagcagcatccccagtgctgctgccgaaaggctgcctgctccgacgaagctcctccgcgatatcgttctcttgcccatctctgtttcctttctcccctgtattccgttcttccgatatctttcgcctggatggccagacgctatcggcataaaaaactccccggtggcatagctgcatacatctggcatgagatgtacgagtaatgcctcccggggagtaacaagctcgtgtagagagcaatctatcatccaaggcacgatagccggcataagaatcccaacgtcagcggcctgttcccttttttttttttttttttgtggttttttggggggggggttttttttttttttgtgtttttttttcgctttttttttttttttttttttttgggggggtgttgcttttgaggggggggcccacgtgattggaagacaagaagaagaagagaactgtgtctcctgagtgaaaaacctttgcggtacacattgcggattgccagcataactgcaagaccggatttgccttgaatcgcttttgcacagcagtaaacgcgagactataggcagataagaatagatggaatcgccaacggccatttaagcaggaactatacgtacgagtcgtcttgtccagcccgaagaaggtcgtgaagaccataagcaaggccatcaccatgccgcgccgatggacccggaagtaccgggacaaagatgctcgtcacaaatcaaacaccacgtcgataagttgccatgtaatttcatgcctcctttgtcgacgggctcatcgtcgttggcaccatcagcctgcagcgatatgtcctaactgccatatcagcgtcgtagaaatcgccgacggtgttcccgataaagcgatggtctgaacacccttctgcatgactgtcaggacgccctttgtcttcttcagcgctccacacaatcagctttgctgtcatcctttagcttgaagacgcagccgtgttgcaacaagtggggtggcaagcgacaatgatttctccttgcgaccgacaagcttgatatcgcttcggcgcacactcctcactttgtcattttcatccctatcttaatggattccccccagccccccattcggatcctcttgtgttccgtatcaatcttttggagaattggactgaaagtaccgttcgctagaatactacaaggcgcatgacagcagatcgcgaaaaacagctatgcctcggcatggctggggaaaacggttaatctgaccagtggttatctgcttatgtgaattaaacagttaagcatccgaaagtgagagggatgtcatgtttcgaatcaaaggtggtcgagttacgacttgctcacgcaggagaagtgtaagcgttgcaactgtggtcgaatgctcaacggcaaaggaagggtttccgcaaacaagggaatagatcgtctatcgcgcccttgagcccaagagagaggctactagccgagcttgctgccaagacccttggaaaagaaccgaaattataccatcggaatcatcacccagatgtaagcaacgagtttctcgaatcattgtccttgaagtgggacacagactctacggagcaggctatactcgatatctgcatactggcaacgacccgctgcgcgagaaaaatacagcaggacatgatgcagcgcaatgtcgacggacttgtgtggctggagggaaacttcggcatctcggagctcaggccattccatcctctgtcccactatgtgctattgacgccaatagcagcaactagcagcatgttcaagggaagctgcgctctcgtggggaaatgatgtcagatctactgcccacgattgacctgctatttctggcacagccagggctgccagcgcaagacctttatcatctcacgaagggaggggtcatagccactgagaacaccgagtacggatggggctacctcgatgcaatgatatgactgcgcggtaggatttggattaagaacctcatacttggggggtcactcacgcaatgggagcagccagtgccggagcggacagcagatcgttgcagacagctccagcgaagaacattgagaggaggcattgttgcgatgggcgaccgcgtcgcctcggcgctgtcgaggagctgcgtgccggcacattgcatcggaacagagtgtcaagattatggcaatggacaactctccatatgcggcgatctgccgtccaagcaaactacgcgcgacagggcacaaaacgtatggccaaacgaagcggtccgagttctattaggctgcatcgaaaaaagaaacgaaatttctggacttctcaagttacggttcccatgcattattgaacggagacaaacgatgggcccatacagaatcttccattcaacgttagatagagattcaattgtttggcaaacctggttacaagcaacaaatgtcgttagaaatctgtcaacagaatcttcgtactggcatgaacggatattgttgcgctgccatcatcctccaatggcctccatcacaagcaattcagaaactgaatgcagcgcaacgatagtgaaaagcaacccgtttcaaaagcagtctagtctcctgtggtatcaggtgccgactacctcggacgcgaaattgataaccgttcg

SEQ ID NO: 392 - DNA, 28274 bp, Unknown
  Metagenome-assembled genome
tctgtggagaatagtaatactccaacaagctataggtggagtcatgcttgtgttaacgccgggagataatcgccacctagcgccgggggattctggccgtttccagccggacgatattcgccaatgtaccggcatccggaaatgctatctatgactgcgcaaggggccccgaagcctctgcactagaggcctatcgtgccggagcccctctgcctcactgcctccacagaataggtgtcgagcccgtatcccctgtagctggggccccgcatcatgaagactgaggcatcgtcgaagagccggtcgaaggcgcacagcagcgcatcctcgcccgtgaatgagcccttccagtcgcccgggggcatgttgctggtgagtatcatcgtgctcgggccatccttctcgtagcggcgctcgacgcgaagaacatgtcggtgcatgccctgtcgaatgtgcacctgccgatctcgtccacgatgaggcacgacggcttgacgagggctgccacctcccgctggacggacccgcgcccggctgccctggagagcctgtcgcgcagctcgcttgccttgagacagtaggtcttcagccccttcatgcagcattcgcgctcatatgcctgtgcgaggtgtgtcttgccgatgccctcggggcctatgaaggcgatgttcctgtgcgcagggagcctgtagagcatgtccgcatcgcgcccctgtatccttgtgaagtcaaagcctgtgaacgtcttcggctccctcgatggcagcctgctgaggcgcagcagcgtctctaccgtcttctgcctcttccgctcggcgagataggagaagagcgtcctgaccgcagcgatctcgctctcgcccatgccccttctcggatgcgagcgtggcaagctcctgcgccgggacatggatgcagcggcctcggccgcctcgccatgcccgaaagcattcgatattcggttctcaagctgcaacatgtcaacaaatcgaatgttcggaaaacctacggtctagcccttgacttcatatagctggtctcctttcgaagtcgaaccttacgaaggcgggatctgctgcagggacggctgcctgcctgatcgtcggaaagggcggctgcgtcggcagctctgccgggcctttggcatccgcccactggccctcgcagcagctgtcgtgccggtcccagctgaccgcatgtgccacgagctgctgcgagaggtcgtcgctgtatatgtgaagcacgcgcctctcgcggcccacgcggcactccccgcgcgcataccagaagggagtgccgaagcgcctaccctcgtagctcacgaagccgtcgaacgatatcttcctcttcgggcagagccagcgctccgcttcctacgtgaaggtgaatgggcgcgcatgctgcatgcatgcgtccctgtgctcgtctgcgggcacgcatgcgactgcacggcggtatctgtccgactgctcccggcaccactggcgtgcctccccgttgagctgggttatgtcgacgaactcctcgccctggagaaagctctccttcacgaaccgtatgagccgctccaccttgcccttcgtccatggatgtctgggcttgcagagcctcgtttggaagcctgtcgagtccatgaacgcctcgtagtccctctgccagacgggattgccctctgcattcctcctgacgacgatgctcttcatgttgtccgtgagcacccgctccgggatgccgagctccatgaagccatggagcatgcctatgaagaggttctcctgcctcgcattcgggaagaactcgatgtagggcatgccgcagtggtggcaagccatcgcgaagcacgcgatcctggagacggtgccgtcagccgcctccacgctggagaatccccagtccatctggtatgcctcgcccggagccgtcctgtaccgcctaccgcgcgggccctggggatccgcctgcctcctcggcgcgctcacgagcgagctgctgtgcggcgatgtagtccttgaccgacatgatggcgcctgcatagccatgctccttcagccggtcgaagatcgtctgggagttcgttgcccccttgcggagctggtcgtcgacgatgcccgtatatcctgtgaggaccgtcgtctctgccttcctacccgcattgccgtgcgggccggcatggaatcccttcttctggagcgtcttagccttcgatctcgagaggcctgtcctcctgcagaactctgcgaggttcgccctctttggagaggatccggggcctgcctcggctgccatcgccgagagcgcctcgtctataatcttctgcaggtcatcgtatctgctgtccatctttgtctatattcctcctatcgccggcacattggcacatccagcataggagagatgcagcggtacggtggccattttcttccgactgcgattggctattctgtttcggctatctgtggccaaagtcgcctggcgtcaaacaccttactgagacctttgtagaactgcttcagagcggattgacgtggctgccggttttgagacacggattgtaagagtggcaatgtcaaagatgacaaggaagacctacagcccacagttcaagatgaaggtggcgcttgaggtcgaaaaggagcaggagacactcttccaggtagcggcgaagtacggtgtagagtccgtcgctggcggccagctgaaaagacgagctgctggcgggcgccgacgacatattcggcaaggcaagaacgaagtgcgcaagcaaggagcaggcgaaggtatgacgatgctctcaagacgatcaggcagctttagcgttaagtgcaacttcctctaggaaaacgatgattaactcccaataatgtgccaaagaggatcagccacgtggcctttcgcagccggcatgggcattaatcatcgttttcctagcagttttgtgacgacaacgcatatagctccaaggcgtaaggcagctgcaggtaagcttttgggcatgagcagggccatagcatagcgcgacatcgccagaggtcccgcagaggggtccatggaggatgagcagatctggttgggcgaggataagaggcttttttgcactgatcggcgccatacacatcggctgccccgccttatggggcaaggaagatatagaagatgctgcaaaagcaaggagaggcacatgccacccgctacagggtgtcttaaggctgatagagcttgcaggcatctgcccatgctgtacgctgccgtctcctccggtaccctcctgggcatccagaaggttcctctatctcttgaaaggcaaggtgtcctgttccccaaccaggtgtggtccgccgacatccacctgtgcccagatcgaagggaagcaccttgtatcttaagctcgctcatcgactggtttagccgctgtatcgtctgctggaaggctctttgacaccatgcagagcacaggagatcgctacatgcgccaagcagactttcagggagcatggggcaccctttaccatgaacttcgagcaggggagcgttctttggctctaaggaatacgtctttctgctcgcatccaaagggatatcccagagcatggacgaaagggcgagatagaaggacaacgctttggtagagagatggtttcagaccctcaagagcgaatgcctaaaggcagacggattcaccatacgcgtagctgcgacacgccggaagaatggtacgtaagtaaggtcaaaaggataagctggcaaggctttcgaaggaggggcttacaggcaaagcccgcgcgctcaagcacttcaagtatatccttatgtcttgcacggacaccagggacagagaagagcgcgacgtccttgtcgggcgagctcgtctccaggggaatgctcttttcggcaatgagctggccatgcagaagggcgactccctgaagcactacgaggacctcatatccaaaaaacgagctgccttccgcctgtgacaatcgcggatgagatgctcgtgcaggcctacttgtacacgcaggagcaggacatgcgcacagcgattcgccagggttgcccgcctcgcagagaggcacagggaggggatcgtcacccacgcccgccgccatatcagcagcggcagggtcgaagggaccaattgcatgatcaagacgctcaggagggcaggctagggataccctaacgacgagtacttcttcctcaagatattcgattgccagcaggcgctactcgaggctttccgggactgcggcgtcataggggttacacacaggtttcaggactgagccctttttctgtttgtcttaagggtggctgccatcttcttgatacaagcagagacagatttaacattcacgatttcagttcatagtggagacacttgcttttgacgtgatccttctcttagctgccaatccctatcttacgagacccatttgcggcattatcacatcagattactatcccataacttactatgaattacgagggtctacgagttgggcgatgaattttcaccagcgccacaggtaggtcccgcttgaaagggcgagatggcgtacgaccctttcccggacaggccagcgctccttatccttgtgcacccggtggagatagatgaaccactcgagatagtaggcctggaggttctccgacttcatgcagacgaagcgctcggcatatctttggacccaggagcccgggttggccttgtaacgctcatctgcgagcttcagatccctcacgagggcattgtgcgccttcctacagtcgtggactagcgccgagccctcctcgatatgggcgagccttgctgatgcgcttggccggtggcttgccgttctacagccccacgagtcgatagccacaatgatgcagaccttgtccttgggacagaccccgccttcctcgtgctcgaccctggtgttgaagaactacatctcgtctatccatacacgtcccgaaaggatcacccagtccttccagtcgctgacggcgcaaaagatcttgtggggccagaaggaaggttgtcgaatggctgaccttacaggtcagctcgatgagcctgggcgatgcgctgtgccacatcacctcgacgatctttatgatcttgtagagcgtcagcttcacattcgtaaagaccgtcccggcgagtgctccatatctcagatgggcactttgggcatctgtgtgcgctcggtgctggaagtttcgtccagccaggtattctgcatcgcgggcacgaaggcttccacccccatttggcaagcaggccctccagcgtgtctgcaccgtagttcttacggcatagccgcacggtgagtgcgcccctgagctcggcaagctcctcttccgggaggctgtcaacaaaggagcacaaggtcgttggctgcgcactccatgcgccctccgacatcttggttttgcctggtcggccatcttcctaagatgtcgccaaacaaagtagaagatagcctttcaggcgactttgtttggcgggggcaatcatatcatggatacatctgcagctggccttcgaccatcactcaactcgtagaccctcgtaactatgaaataaaggctgcctggcgttattcccgacagtggctccgactcgcttgttagcctcatggctctataaggtgtgtgtcgcttttttaacgtcccaagaaaacatctagtatgaagctgagcacgacttcacgtacgtacttgttaactaacgtctcgctttggcaagaggactagaaagggaacagcatgaggcaccctaaaggatttatcgtcgtgttagttgccgttgcgctggtctgtatattttgcataggccacggtagtgcactgatgccatctgagacgaaagaggaattgcagcaggtgcagggggagaaccagaaacagcaagaagaacaggatgcacaggcatcaaaaccttcttctcgaaaatcagtgggttcagtcacagccattggtgattccgttatgctcggtgccgcccctgctattcaagagacgatccctgactgtgttgttgatgccaaggagtcccgccaggtcaaagaagctatcgaaatcgtgaagtcccttgaacagcaagatacattgggtgacacggtcattattgctctcggaaccaacggaccctttgatgtatccaccggacaggatcttattgatcagattggtaaggatcggactatctattgggtaactgtatacggagaatatctccaatggcaggatgaatctaatgatgctattaatgcgttagcgaaacaaaattacaatgtgtacatcatagattgggcaggagcagcggttgaccatccagaatggttttggaaggacggtattcacttgaggccggaagggcaaaaagcctatgctcaattgctcctcacatcaatttcgtaaggttcttaaatactaccaataacgccagtccatctgctgatagaattcatatgctacactggcagataggtggattagtaatcctcttttggttgatcgtgttcataaaggtggagtattgagcgatacgctggtctgtatgtctgatggacggttttgttagcaggatcgaactatgtgctgtcaaatgagactacacaagagataattttcaacactttcaagatgaatctacgctctgagtgcaacaactaattacgagataacgacctacgtacgacctaagatggtacttgcaaagacatcaccttggaggcaggcatgggccgctacagccatcttagcatcgagaagcgcgaggacatcatggtttgctggagggaccaagagggcataaagtcagatcgcgagggaggtcggccgtctccaggcagatcaagtgcaacaacagcgtgacgagcggcggtgctggtacagggcctccccggcaagcgcagggccgacgccaggaggcgctcgaggtggcaaaggctcatggacgaccctaaggaaacgatgattaattcggctcgatgaggtcgctggggccacacgctgtatgacatcggctcaaaatgtctcgaaccacgcagtgtccatatccacatagatgcctatctgcctgcggatatgttataattacagtaacgtattccagcatatccaaaaggcagatatggacagatagatgagcttttaggaccttaaatcctaaggtcttaggaagaagacccggcgagaggcattcctggagcaaatggatgtaatcgttgtgtgggacagctggattgttctggtagataccagctaccacggacatgctcttgtcaggcatgtgcgcgctgcaaagacgatactttaggatgtatcctgctttaggttatgtttgggctcttaagacgaggaaacctaaggatgctatcctgggttgccactcctggcagcacttctgtgcacgtagacctcatgcaggcgcaggtgccagatgcaacgacacttgcgaagatgcgccatagccttaaagcgagaggagttcggtaaagcttgtgctttgcgcctggacttagaagcttgaaaaggcagggatcacggggcggggcggctccattgtggatgcgaccttcacctgggccctaaagcttcacgaagaacaaggaccatgcgcataacccttaaagcgcaccagtccaagaaaaggggagcctggcgtatcagatacaaggcgcatatcggcgtggataccgcaggtggccttgtgcatggtgtggagacgatcgcctagaatgtatctgacatatcctgtggcacatgcactcgtaagggaagatgacaggttctgctatgcagattccggttataccggtatagcgaagcgcccttaaggtcacataaagacccacacctctcatctatgtgctaaagcgttgcaaggaagccttcgactacagagggccttgcctgtgcgctctttaccgagaagggcatcgagtccaggaaggcatccgttcgctcaaaggtagagcatcccttccttatcgtgaagcggcgcttcgatccccttaaggaagcgctaccggggatagagaagatgcctgcacactcgagtctctctcacccttgcaaaccttacccatgtgcatcttttgccagcaggctgcacctcccggctcccagagtcgcttgatctgtcttggagccttcttgcggtgcatggggcagaacggatgtaaggatggcggctcctgtacatgctggatgagcattcttccctgcctttcccgcataccggccgcgaaaaatcgtgtggtcggtcccctctggcacgtcatagggcattaatcatcgtttctctagcgggctgtggagtcgggttcactcggctgtgagcttgtcgaccacctcaagactgcaaggctgcttaagcaccatggcaagcgcaggtgcaggaagggttttgaggagagaggcggggcaaagagttcgaatgcgccgagggactccaggaggtgcttagggtctccgtcttcttctgcctgccccaccacccctgggagcggggtaccaatgagaataccgacgggttcttcagggactggctccccaaggacaaaagcctcgatgacgccataggtgccgaggttcagaaggcctacaattcactcaaccgagggctgtgcaagcgcctgagttggaagtgccctgggaggtccactaccacaagacgttgcacttgctctgaggttttaccagggtaaatgttctcggtagtagatactatcaaataaggtacgtcagtccagctaataaggaatcttggggaggcagatcgctatggcagtcgatcaaaaagttttagatgctgttcaacagatgtggcacgactggaaggaaagcgatgatagacgtgacagcggcttgccacacgtttatgaaggcgtgacgtgccacgacaatctctagtatggcaaagacccgaagtggaatgcgttcgacatctacaccccgaatgatgttcaagatgaaattcccgtgattatcgagattcacggcggctgggtctatggtacaaaagagacgtaccaatattacgggatgggcatggctcaacgtggctttgcatttgtcaatccttcgtatgtgcttggtcctgacgtaacgtatcccggtgaagtggatcaggtgatggaatatatcggttgggtagaccaacatgccaacgattacaacttggatcggaacaatgtctttgttgagggtggctcagcgtgcggacagatggctgaacaattagatgccttggttaccaatcctgaatatatgaagaaaatgggctacacaatgtccagcctaacgttcaaagctttcttactgaattgcgcaaacacttagtcaaataggagacggagccatggggaagaagagaccaacaagggttcaggataccgttatcttcaaagtttcattactgtcaatctcactgttcctgattatggctccggccgtatcaccggctctgccgttaatgtacaatgcctttcccggggttgatcaagcaggcgtagagattctggtaacgattcccaatctcggtatcattatcggtctgatcatcagtccttttttaatagcggcgatcggtgaaaaagcaacggttttggccggcctcattggtacgttgctgacaggcaccttccccatgtatgtttctgcctatataccgatcttgatctccagactcttgattggtgtgagtatcgggctatacaactcacttgctttgtcgttgatcccacggttttaccgtgatgataaaggcgaacttgcaacgatggttggttttcaaaatgttacagggagtttgggagctgcgattgcttcgtttttgatcagttggttgatcactatcagctggcatgcagcgtttgctgttttcttcttagtgattccggtatttattgtattcgccctcttcgttccgcttccgaaagataagaaccaagagcaaggctcagcccaacccaaaaagaagcaacatatcacgagcgagattgttttaatcgcggtattgatgttcctcttctatctgttttacatgccagtctcatataaattgccagcctttgttatcgctgagcatcttgggagcatcagtaatgtatcaacgctcaccggcgtttttaatctgatctctattccaattggtgcatcattcggtttcttctttaagagattgcacgataaactgtttccgcttggctgtgcaacgatagctttaggcttcttcatcactacgttcagcgttaacttcgcgatgctgatcgtcggcaccctcatcattggcattggctttggctcgacgaccccatacctgtataattggcttgatctggcggctcccaaagattctgttaatctggcaaccacgattgttttgatcgttgtcaatatcggctgtggcatttcaccaatggtcatcaacgtgatgtcttcagaccctaaacaggacttgctgatatcagcttgcttttttgcgttgggcactatctatggcctgatccactactttcatgttcgtaagagcacggttaacatcattatttaactcggtgaattagcattctgagtgcaaacaggatagcgccaggcagaggtcgtggcgcactcccgaaagctgcgatgttggttgtataagccatcatcgaacgtcgagggaaaatgcatcactacacttatcttagcgccgctgagcacaacaagatcgcaaagatacacgtcaggtactactcacccagcagcatcgcaaaggcatcagacaaaagacagctccagtgtgagccgcaagcttgaaaggaacagcccacaggagaggctatggtgcctgcacggccccaaaggagggcaagtgcgcactgcgatacctgcagggcgcacaagaggctgtccgaccccggacaggctgcacaggtaaggccacttcatcgtggataagcattggtcacccgagcaggtggtgggcaggatcttggcgtcgtgaactttgcgaccatctagcgcgcgactttggcgccctggactctccccgcacccgaccaaacgagcgactggaaggggaagcgcccacaaaaaagaggggtaagatctaggtctcccagaaactcttagaaaggctaagggaggccttctgagcgcttctgtctgggtaagtgggcaaaccgacactgtcgtggggccaacctctgtgtgcctgtaggtcctgcccaagcactcctttgcggctgctcgtgggcagcaagggcgtgtgcactacccagctcagcgtccttgaggggtttccgctcaagacactcacgcctgattgcaccaagcagctctcccggcagggctaaggtcgcaaaagccttgggaggtgtacagttttgcttctgcgagccacagcgcctgtggcagaagccgatagttaagaacaccgatgtcctcatctgtgagttcttcccctaagggcagtgacttttcctaggtctcacacaaggaggtacaacatgtcttggatctgatctgcgacaggacaaggaaggtattaggctacaggacagccaacgaggtctttagggagatggtgcactcagcttgacaatctgcctctttattgtggtattgatcgtttcctatctgtctattctcggaataacgaagtgacaaactggagacgtctatgtccggagaagccgtgatcgtgcttatcactatggtggcgttcattgcgttatacgtgggcatcggggtctacatgatcgtgataggtagacctaaattgctgtatgggtatctctatggaaacgctgacgatagggatctgccaaagctggcgcgtctgtgtgggtatggtgtactgttggagacactgggtattgcgttctttttgtcaataggggagctacaacgatgccctggattcccgtatggatgggaagcggcggcatcctcgttgtcgcagggattgtgtttgccggttaccttggtgtgcagctcggcgcgattattcactacaacgggtctttgatcccctgatcggtatatcagtcttatcgattcaccgttgcgtgcatgagcggtttggcagcacgtgagatatcgtatcgctgtgctgatacttcacagcctcaaggacataagttgccttccgtctattgctcgtagatagaaggcaactcgacagagagcctgggagctcatcaattgcgagagtagtgcctcttcgactggggcttaagtctcttgacaatcagaggaaggtcacttcgcgctccggatccttgtggatataggccgctttcgcaaagcttacaaggatgaggtagaggaccatgatacccgcgactgccacaagataccagccgggtagggggccgaaatcgagtgcctctgccagatcggagtagggcagaaccgtccccaagacggacatcccgaaggttgcccagaggacaggtggtgcggcatgctgaccaataaaagggagccccggctcacgcagtgcatggatcaccatctcctgtgtccacagcgattcgatgaaccaacccgcatggaataccgcaataaagagggcacgctgactgagcgtagcgccaacccactctgcaccgacaaccatcgggcagacatacctgaatagaagcgcaaaagtcacgatgtccatcagcgaggagaccgggccgaagacgaacatgaaggggagcaatcccttagttgtccagggacgtggctgctcacaagctctctcagagaccgtgtcaaaggggatcgacacgcaggagatcccgtacatcaggtcgagtacgagcaactgcagcggtagcatcgggataaagggcaggaagatcgatgcgatcaagaccgagaggatattgccaaagttggagctcagggtgatcttgatgtatttcatcgtgttcacaaagacctggcgaccgagcagtactccttcctccagaatctcgaggtcactcttcaggagaatgatatccgcagcttgctttgcgacgtcgacggcggtattcaccgagacggagacatccgcagcacgcattgcgggggcgtcgttgattccatctcccataaaggccactgtatgccctgccttacggagggcgcgtatgacctgtgttttgccttccggcgtgagctttacgaagatgtcgcatcggtcaaccttctgcgtgagctcctctgcgctcatcgactctacttcgcttccgtcgagtaccgtattagtgggaatacctacctcccggcagaccgccttggtgaccgcttcattgtctccggtcagcactttgaccctcaggccctgcctgaccatgcttgcaaccgtttccttagcaaactgtttgggtggatccaagaaggcgagatagccgatcagagtcagttcggattcatcccgcgcattgagttcgccggcaacgcgggggttgtccttgtaagagatcaggatgaccctaagtccctgggagttcaactttttgacctcggcgagggtctgctgacggtccgagccagtcagcggcgacgccgtgccctgtacttgcttatgggttgaacaggcgagcatctcttctgcggcgcctttggtgatgagaacccggtgtccgtcggtgtgacggactaccacggacatccgacgccgctcaaagtcgaaggggatttcatcgaccttctcgtaggccttgccgattgtctttatatcgagccgttttgttgcctcagagacgattgccttatccgtcagatttcgcatcccggtctggtagaaggagttgaggtaggaataggtaagtacctcatcggattcctcaagcttcatattcagatgtttctccaacacgatacgattctcggtcaaggtaccggtcttgtcagtcgcgaggacgtcagcggatccgaagtcctggatcgctcccatgcgcttcacgatagtgccggcatggctcatgagaatcgagccccgcaccagattgctcgtgacaatgactggcagcatctccggagtcagaccgaccgctgtggcgatagcaaagagcagggcatcagtccagctccctttgctgaatccgttgattagaaagacgagtggtaccacggcagcagttaagccgagcagcagttttgagaccgaggcgataccggtgtcgaaggcagtctgtgaagattcatcctttgagagcgattgggcaagtgccccaaagaccgaatcatcaccgaccgcaaagacgacgcccgtgccggagccggaaacgacggtggtcccgccataaaccacatccgggtaatccagataggtctcaccctctctagatgaccccagcggtgtcgcggtcttctcgaccggagcggactccccgttgagcgagcttgtggagcagaagagatccttgctggcgaccagccgcatatccgcagggaccatatctcctgcggctacagtgaccacatcgcctggtacgatctcatcggttggaatctcggttgtctccccgttccgggtgaccgccgcggtaatctgaatcttgtccagcaggctctcgactgcatcggagctgcgtgaggactggacaaaggagatgatagaagacgccacgatcatcgtgaggatgataatgaaggtgctgggatcgcgctggtcggcgggtgctgagagcacgtccgttacgaatgacataactgccagaatcagaaggacgagattaaatggcgttgcaacggcgcgccacagcagcttcagcttggaatctttgtgaggcccggtgatccggttgacctgccccttctcgcggagtgcttgtgcctcctcgtcggtaagtccggtggggcaggaatcaagttttcgatagacgatctgtttgggtttgcgtgtcaactccgctgccgtctgtgctgacctgggagtctgccgcattagtttggcggtccggttggtgtgcctgatgggcgtgagcttcttgctggccataatcactctcactccttccttttgaaaatcaacctcgcatgcgttgtctgcgcgaggtgatccccacaggtgtttgaagtgggatcccagatcgttgtacggagaggttgcgtcatatgacaagcgatgtgtccgaacggaaacgaaatgacatccctgttttgatagatgggtgctctacgtagctgaatcagtttatcacaggcgaattctcattgctagtgcaacggcgaggatgaaagaatagcaacccggggtctctcacaatataaaggggcggattagtattctgagtgcaacaggatagtcccgctccacagagacgtgacgcgcttctgaaggctacgacattggttgtctcaatcaacgtcgaaagctggaaggaatgtgccactacaagcatcgtatgcccacaggagaggaactgcatagtcgagctgcgtgtggcacaagggaagctccatcggctgcatcgcacgcaagacaggtaaggacagatccagcgtttgccacaagatcgcgaaaaacgagcggcacaaacgctttagcgcctgtgcgacccaaaaggagggcagctgcccgcccacggcagggaaaagccgaaaagggggcactcagactctgcgctcgctcatcgtaagacgagcgttggttccccaagcaggcagacgacatctcaggctcgagtatggtgtcagctgcgtcgttgagcttctcgactattctgcaggcaggcccaggccaccaccctcgagttgccaggtgtgtcaccatctgcgcaggaaggggaagcgaatctgcagcaagaggcctaagacccaaggcaaggtcgagatctcacacagcctaaaggataggcccaagcaggcagatgtaggctcgcacctcggtgactgggtagacgacacgcttatagaagtagggcctgtatgcctgtttgcgcttgccaacagagcgtccaggctccttgtcgcgagaagatggcaccacgacagcgccgatgtcttgaaggccgagctcgggcatttgctgggccgtcccttcgagacaatcacccctgagcggggcaagcagttcgcaaggtatggctaagctcacaaaggccctttgaggcgtgcagctctacttctgcgacccccaccatctatggcagaaaccgacggttaagaacactgacggcctcatccgcgagttcttcttgaaggggacagacttcggcaaggttacggacgaggaggtgcagcatgcagtggagctgatctgcgacagggcgaggaaggtcctggaatacaagacagccaacgaggtctacaaggggatggtgcgctcagtttgacaatctgccggtacaaaagtcaaacgttccaatagggttacagctgagaaatccctgatatcactccaacgtatggttcgttgtctgcgtctgcacagccattgttcttgtaatgtctccgacagattttaaatgtttcgtggagataaaaatctagctattttgcctgattacaccgctggtggcgtttatgtgatgtatagtcaacgcatgcataaattagcattgcatatgctccatatatgcatattcaaaaggggattagacatgggtatcgaagtaggcatcattggggcgggcggctatgcaggcattgagctcgtgcacctcctgttagggcaccctaccttcaccctcaccgctattgccgacaacactctgacaggtcagcggctcgacgaagcatttccggcgttcgtaggacagagcgatctgaccttcacccatcgcgatgatccgatcctcgacacctgtgacatggtgtttttggcggtgccccataccgcatccttagcgatcacgccgcacttcatcgcctccggtgtcaccgtgattgacctctccgccgactaccgcctgcgtgaccctaaggtctacgagcagtggtacggcgtgccgcatacctctcctgatctgcttggccaggcagccttcggcctgcccgagatcaccggagatcagcttgcagctgcagcggaaaagcatgctgcgggtaactcggtgctcgttgcctgtgcgggctgttatccgacggcaacttcgttatccgcctatcctgcggtttcacagggattggcaataggtgatgtcttcgttcaggccatctcaggcgtgaccggagccggcaagaagcctacggcacggacccatttttgcaatgcggatgaaaatgtcgaggcctacggtgtcaaagggcaccgccataccccggagattgagcagatcctgaatctcccgggacatgttgtctttatcccgcatctggcaccgctcaagcgcggcttgctctcaaccgttacgatcaagcttgcacatcctgttgagttggatgaggtatatgcgctgtacacgaagttctattcacagagcccgtttgtgcatgtattgccccaaggcgtccagcccaagacctcgagtgtagttggcacgaacaacgcccacataggcctcgaactcatacgacgatcgggtgtgctggtagcgacatgcgtcatcgacaacctgacgaaaggtgccgcgggacaggccgtgcagtgcgccaatatcgtctgcgggcttagccaagacgaaggactctcccagcaggccgtgcccgtgtagcacaccgaacacgtttcgaagataatctctcaatatcagctatcacacctataaccgttaccacagcgatgggtgatagatgcataaaactatgccattcatgaataacctggaactggattcaatacctatttgaagcctacgaaaggacaaatttcttatgaatataacgcatgtgggacatgggggagtgacgagcgcacagggctttgctgctggtggcatccacgccggactgcggaagaaccccagacgcctcgatctcgccctggtggaatccgatagcccgtgcaccaccgcaatgaccgccaccaagaacaagtttgctgcagctccggttcagcttgatcgtcaggctctgggaaccccgagtgtcggcactgcgcaagccattctgatcaattccggtatcgcgaatgccgccactggacaggagggcctcgagaatgctgcaaagatccgcaagcttaccgctgacacgatcggttgttgcgaggacgatgtgcttgtggcctcgaccggcgtgatcggtgagcagctcaatgtggcgccgttcgcaacgggggtgcctaagctgcagaaaactatctctgcagaccaaaaaggtgggcacgatgcggcgtgcgcgatcatgacaacggatacgcatcccaaagagttcgcggtgagctatagcgattcagggctagacaccacaatcaccgttggtggcatggtcaaaggctccggcatgattcagccgaacatggcgacaatgattgccgtcatcacgaccgatctgccgatgtctgagggcgctgcctaccaagcgctcgccgaagccgtgggccacagctttaacaaggtcacggttgattcggatacctcgactaatgacacctgcgtgctgatggcaagcggggaggcttgccccaagaatacggtgccgatcgaagcgaactcgaagtcatatgcacagtttgcccaggcgctcgaccaggtcacacagcatcttgcccgggagatcgccgcagacggggaaggctccaccaagcttgtcacggtcaatgtgtacggggcggccaacgatcaggatgcagataaggctgcgcgggcagtcgcaaattcaccgcttgtcaaaaccgcgatcgctggccgcgatgccaactggggccgtatcgccggagcgctcggtaagagcggggctgcgtttgacagttccaaggtcgacatcgatatgatgtcgattccagtaatgcggagtggtatggctgtcgagttcgatgaggacaaggccgcaaaggctttcgaggacccggagatcgtcctcgatatcaacctgcgcgcaggatctgcctccaccacggtgtggacgtgtgatttgacccacggctacatcacgatcaatgcggactatagatcatgaggatggcaagggacatccgcgcttccaaagagcggcacagcagagtcgggcaggttctggcggaagctctgccttggatccggtctgcgaccggcaagacgattgtgatcaaatacggcggctccgcaatggtggacgagcagctgcgcgcccaggtgatggctgatgtggtgctcctcaagatcatcgggatgaaccctgtgattgtgcacggtggcgggaaagccatctccaaggcgatgaagcggctcaatctgccggtctccttcaaggatggcctcagggtcaccgacgacgaggcgatggaagttgtgcgggcggtgctcgtagggcaggttaaccaggatctggtccgcgacctcaaccgccacgggaatctggcggttggactttcaggggtcgacggtggcaccgtgatgacggaaccgctttcgcccgagctcggacacgtcggacgtgtaaccgcagtcaatgcgggactcattaacgatatcgtggcggatgcctacatcccagtcattgccagtatcggtatgggccaagacggcacctactacaacatcaacgccgacatcgtagctggagaggtagcggcggcgattggagcccacaagatcgtcttcctgaccgatgtcgacggcctgtacgaggacttctctgacaagaattcgcttatctcacgtctcacagaggacgaggcgaaagcgatgctcacaagtggcaacgtcgggaagggcatgatcccgaaggtgcgcagctgcatcacggcgctcgatgccggggtgccgcgcgcccacatcgtaaacggcaccatcccccatgtcttactgcttgagcttttgactgacgaaggtgctggcacagtatttgtgggcgacgaggctgaccagaatctggacctgcatccactcgggaagttcgctgagaagctggtagacaacgccgacgaccgcaccgtgccttcaagtggagtggcagcgggcgcctcactcggcgcggatgctccaacgcccacacagtcgaaacctgacatcaaagaataggagcgagcgatgtcattagaagaacaacagaagcttgaagacaaatatctgatgcatacaatcaaccgactccccgttgagttcgtgcgagggtctggcatgcatctgtgggatgacaaaggaaaacagtacaccgatttcctcggggggatcgccgtgtgcagtttggggcactgtgatccggatgtcgtgaaggcggtgcaggatcaagccgcacagctcatgcacgtgtcgaactacttctatatcgagcataggggtgaggtagccaaagaactgagcgacctgctggatcgggaggcacccgccgacaaggcgaccggatggaggaccttctttgccaactccggcgccgaagctaacgagtgtgcgatcaaattggtccgcatgcacgcacacaacacacattctggtgccaccaagatcgtggtcctcaaaaacagtttccatggccgcacgatggagacgcttgccgccaccgcccagcctgagaaacaggaagcttttcagccgatgcctggtgggtttatcgtaaccccgatcaacgatttagatgctctccagcatctctttgaccaagaaggcaatcagattgcgggtatgctcgtggagtgcatccaaggagaaagtggtgttcacccctgcacgccggagttccttcagaaagccgaagagcttacgcacagtgtgggcggactctttgtgtgcgatgaggtacagtgtgggatgttcagaaccggcaaagcctttggtttccagaactatgggatcgtgcccgatgtggtggcgatggcaaaggcgattgccaacggatttccgatgggtgcctgcgcagcgaggggtgaggcagccgatgacttcggcccgggcgaccatggctccaccttcggcggcagcaatctcgctatcgccgcctgtgcagcaacgcttcccaagctcgccgatcctgcccttgctaaaaatgtacagatgactggtgcctatctgcgcgagcagcttgcaaaactgccagcagtagtccaggtccgtggtttgggtctgatggtcggctgtgatctcgatgagaagtacaatgcctgtgaggtagtgtccaaagcgctcgatgaggggttcgtcctcaacgcgaccggaccttcgacgttacgcttcgttccgccactgatctgttcgatatccgatattgatgagctgattgttgcactggggaagatgcttgtatgagccgaagaagtgagcgccaacgcgccatacgtcagttggtccgcacacaacagatacatacgcaaaacgaaatcgtgaggaatctaggcgagcttggctttgactgcacccagacgacgatttcgcgtgacattgccgatatgggtcttctgaaatcggatagggacttttaccagctaccggaggataaaaagctctcgcagctggtctctaacatggtgaaaaccgtggagtgcgccaaaaacatcatcgtggtgcatacctacccgggcagtgccccggcggtagccggggcaatcgacgcagcagcgcttgaccatgtattgggtacgatagccggagacgacaccatctttatcctggcaaacgatgcagcttccgcccgtcaagtgggtagcctgatcgatactctcgtgccacagcactgagcctgtggcacgaggagtgttcgattcgaatgtctggatagaacgtccctattgttagaactgattttactgcacagtcgttgaaaacatgaccgaaggatttcctcatgtatcagaggtgcctccggttctgtgaagtgtccgaacctgtaagatagggaaagcctgatcctttctgaatcccttcccgtccgggcagcaccattgaagggcatgcagcctcgcagatgatactcctataccattgtgccggcgtgtcgcagctaagcgcatagtggatccgctctttgttgtaccatgtgacgagcttctcgatggtcacccttaagctctgcaggtgtgctgtactcctcctgccacaggcatttgcccttgagcgtgccgaaccacctttgcatgagggcgtcgtccctccatctgaccctttctgttcaggttctgctctaccagcgcttcccttcccaaagttcatggtggaagagcaacccgttctttatgaaggcctgcctggcgcaggtggcgacctcctgggcacgcatggcgccaaagggcctccaggagacgatgtagcggctgaactaatcgatgacggctaccaaggtaggtgtgcctttcccctgtctggacataggtgatgtttgtggagcagagttggttggggaagaagaccttcctgcccttccgcagatacggggaccgtctcgactccctgctgggtgctgagagcaggcagcaggggcagatctccatgggctttcctagcctgtaagcgggtagtgcatgcctcgccctgcctctctagggaaacgatgactaatgcctatgccgcccgcgaaaggccacgtgactggtcctttctggcatatcattgggaattaatcattgtttccctagggaaacgatgattaattcgcctcgatgaggtcactggggccacacgctgtatgacatcggctcaaaatgtctcgaaccacacagctcccatacccacatagatgcctatctgcctgcggatatgttataattacagcaacgtattccagcatatccaaaaggaagatatggacagatagatgagcttttaggaccttaaatcctaaggtctgaggagaaagacccggcgagaggcattcctggagcaaatggatacaatcgttgtgtgggatagctggattgttctggtagataccagctaccactgacaggctcttgtcaggcatgtgcgcgctgcaaagacgatgcataaggatgtatctgttgcaggtcatgtttgctctcttaagacgagggaacttaaagatgctatcctggattgtcggtcctatcagcgcttctgtgcacatagacctcatgcaagcgcaggtgccagatgcaacgacgagcgcgaagatgcgccatagccttaaagcggcagggatcacggcgcggggtggctccatggtggatgcgaccttcacctgggccttaaagctccacaaagaacaaggaccacacgcgcgacccttaaagcgcaccagtccaagaaaaggggagcctggcgtatctgatacaaggcgcatatcggcgtggatgccgcaggtggccttgtgcatggtatggagacgatcgcctagaatgtatctgacatatcctgtggcacacacactcgtaagggaagatgataggttctgctgcgcagactttaggctatataggtatagcgaagcgcccttaaggacgcataaagacccacacctctcatctatgcgctaaagcgttgctaaggaagccttcgactagagaaggccttgcctgtgcgctttcagccgagaagggtatcgagtccaggaaggcatccggccgcttaaaggtagaagcatcccttccttatcgtgaagcggcgcttcgaccccttaaggaagcgctacagaaggatagagaagatgcctgcacactcaagtctttctcgcccttgcaaaccttacccatgtgcatcttttgccggcaggctgcacctcccggctctcagcgtcgtttgatctgtcttggagccttattgcggtgcatgcggcaggataaatgtcaggatggcggctcctgcacgtgctggatgagcatccttccctgcctttcccgcataccagccgcgaaaagtcgtgtggtcggtcccctctaacacgttatggggcattaatcatcgtttccctagggagcagcgatggtccttgaccggacaatgtgtctctcccgaatacgcttgaataccgtgattgctgcggacagagaccccgctcagacgaataggcgacagccggattatcaacgcactgcaagaggggatttagcgtggttatatatgttgtgttcagatgggtattctatactcaatctgtatgtataaaccagaaatgagaggacgagtcatggctgaggaggcaaagcaaaggacccgaagaaactcttcaatatgtatgtagcgcacgttgtgggcatcaacgcttcgaccgacggaagtaagtagagtccatttgatgagttccgacgctgatggggcttaacacgcacagaagtcactccggcctcactggtttgccgatcactttattgaagttatgcgacccggcgtggccgcggtgagaaggccacatcggcttccacgtggacatgtcgcgaggccacgaaaaaaaaaacaaaaggtggttagagaaggcggctttgagataatgaggattcagcgtggacgtatgaagaatccacaggcctcgacgcttttggtattttcaaccatgatattgcagcttgcaattcacctgtactgtcagaagtagtgggagtttttaatctttgattgtaactcgcagagaataacaaaatcattgcgagccgcgtcctctacgcggcgctaccttgcagctcaacgcaggagggagcgctgggtctcgttggtccacacagcgggcagacgacctttgcaattctgagtgggtcggaggacccctgatgagtggggaccgtgtctttgcaaaggcaccccagcggctaactgagcaggaacggagaatctcgggagacaagtacagcactacaggaggttatcgactcgctccaagagagtcaagcaactgggagaggaaaagtaaccagaactgaaacaacgatctcggtggaaccgaaggcgtacgcgctccaccacatgcttgaggactatgcgcacgcccaaggagcgctttgagtgaggacgctcagcggcttacgagctggatttcccgcgccgccagacctcactggtctcggattcccggtggaggatctcgataaacgctgcaaaaggatttctccggtgggtctggcaatgccatttgtggctcatcgaagctgtgttgctgatgaatcggaatctgttgctgctgacgaagccgaccaaccaatctggacttggaaagtgtccagtgtgtttgaaaagttccttcctcacctctacagaggtgctgttcctgattgtctacacacgatcgtgccttatggacgtccttgcttctctcatgtagccgcttcgaaaccggtgtataccacctaccaggggcaaacgtacaagaagctacactcaagcagcgttgaggataacctggatcagagcgacgccaacgtgctgcctcatgaacgtgaaagtgcccacaatggcaggtctttgtggacagttccgcatagagccgaagaaggctgcccaggcgcatgaagcatgaagcgtatacgagcagattcaaaaaggaagctcgtgatcctgcttgagggcaccaaacacgtacaattcagtcccggatctcccaggaccggcgattaagtagtttcgcctcaaggaggtcccaagttcctttgggacaaaccatatgttaaaagattgtgaatctctctccttctaccggggagatcatggcgacgctggtggggtcccaacgggcggtaaagtcaacgctgaataagttgatactgcgggatcttcaagcctgcacggaacatccgttggggcaaaatgccacctgcgcctattatgcgcagcaccagcttggagaagagtctgcactccggcaaacaccgtgatgccaggagatcgactcgcccgcccgggtggacgagctcgcaggagcggcaagctcttgggtgccttcctcttccacggggacgatgtggacaagcgggtgctcagtccttccgcggcgagaaggcacgacttgctacttgccagattgctcgtcggccggcgcaactctgtctcttcgatgagccgaccaaccacttggatacgactcggtcgatatcctggaggatgccctcaaggatttcccgggcacatatcctgatcagccacgcatgaacacctggtgcgcaccatcggcaaacaaggtgtggaatagtccgtgaccacaaggggacgctcttacgatggggactacgatgataccagttggaagcgcactgagctggaagcccggcgcagggttgacagtacaaaatccctattcctgaaagaaaacgcccgaaagttgagagctcaggtagcagaacgtgcggaggtcgagtcccgccatcacgccagaaagcgttgcgcaaggacaagaagcggctcgcggaaattgaagctgcgctcgatccgtgcgcatgagcgctaccatcgagctgatgaagcagatggcggacgagaagctctacaaacgaacaccgacaaacaatcagtgtatgcagggagtacaggcactgagcaaaaagatccgagcagctcgaagagagtgggtggactttcgaccaaattgaggaagctatccaaaagcataataacagccaaataatgccttctctcccgggtagcttttgtgctgtggcatttacctggtttgtgatgggtcgtgatcgtagctgttctacagcgggtacatcacgtttgtgatcgtcaaccttaccgaatgtccctgtcacatctcctgattccccgccctaagggatggttatgctggtataccgattgccgtttggggagcgtagccgcgcggtgactttcattatgctgggtgtaatcctgatgattatctagtaaactgtgggctactatgccgatcgtggcaccagcctgaggaagataggacttgtagcacttcgtttcttattgctctgatcagcgccgtcattgaggtggcgctttttgatggtcctcctcgcatcgtgcacatgagttgcccatgcatggacccgcagataaaactgggcgacccgaccgcagggaagcggggggagactcctcatccgcttaagcacatcgatccctttggctcgatcatcctgccgctgaatgttggtgagtgacccgtggccgcgtcctcgcttactcaaagactgtccaatacagtcacctaccggactggcgcaatcccggccgtgatgacgcgcttgtcgcggcagcgggcccgatctcgaacatgatccaggcgctcgtcggtgccctgatctttcgcatcaacgatgcgaatgtgggtttttaccggttacaccggctggtttctggttgctctactgttcctttcgcctatgtggggtcacctgattggccttcttcaatattcgtccgttgccatccgctggacggctcaagctgatcctgccgctgctgacgcttgaggtgcccgtgaccgctaggtaccagatccaggctatgcgcgcgatcctctttatccctgcctactacctgttgccgtcatctttccatggaccccttgggcatctactcaaccttactgtcgacaacctctccaatttggggctcttggggcctgatcgagcatggcatcgttatcgtgtccacacgcaggggatactggcaccgttttacctgttgctgcaagcttgtcacccgtagcgttatcgcaaattggcgtcgatctcgatcgccgaggtgaccgacagtactcgcgaagagatccaaccgcatgcaggtcttgacttggaaagtcgcgagcgacttcgtgctcgtggcttctatgtgcatggcaatcaaagcggcctcactggtcccagatgaatcggtggagaggattccaggagaaggacgggacgacgcggttttcgaaatgacgaccagggcagtcgggaagtctgatcagcgactgatgtcgacagacagtaccgcaatgctgcagcggcaatggggagccggaggagccacctcacagatgattcccgaggaacggtgggcgggaacctgaattacctgaacctgatgcccgaactatacgaggggaatcacaatacctcacttgctgtgattgtgcagatctgctctcaatacggccagcattccctgactggaggcagaggctattcgctttaagcgagtccccttctctcgttatggccttacgtcgacagtttcaccgccttcccgtggaaagttttggtcaccttcgaggagttgtctgtcaaggtgaggatactcttataatcactgcctcacccttgaggccaattgtttgttctcttttgccttctctttttatcatttcctctactcatccttttcatctttttccctcac

SEQ ID NO: 393 - DNA, 9334 bp, Unknown
  Metagenome-assembled genome
gggcgatcgagcgcatcggaaacagaatataaaaaatctttgctttgcaaaaccgtcgcgatgaatctcttcatctcgatgatcctggtagcaacatcagtatccgcactgtgcaggcggtgccaccgcacttttattgagattgctgacgtcaaagcacatgaggactgatgcaggccggaccccgacacgccccaggtgatcatttcctaccaagggagctatgctggagcctacccagctctgtgtttggttgcaccacctcttaggtctagccttcaagaggagaaagtggaaccgtcaggaatccatggtacgcaaaagtccttctacacccgcagtgccacaagccgaaagataccaagaatctgcccgcactaagaagtaccacacagctgagtagtgctgctgaagacacataggcttttgctacaccttcgctgactaagtgccaagatgggagtgtcctgactgcagggcccagcagtacagcactcgcttacaggaacaatctttaagcacaaccagtcacacaccccatcgaagtgggtatcaaaaccctcaggctcatcgctacagtgctgccccttaactgccctagacacagcgcctcatataatcgccatcaaaacgccctggaatggcggcattgacggtcatttcactgtcctcaagcgtgcttctggaatcagacaaggtccctacatcggctgatgcgaccactcttcctgccctatcggtcagcgagcaagtatgccctgtcagaaggttggcacgacggtccacacgagcccctataccgttctgtggtgccacaaagaagcctccaccgtgaaagggctcacagggggacttgcgtcgccctgcgctagaaggcacaagtgcaccccacaatagtggccggatgaggtattcgggggctgtcgctaatcctacaaggccattgtgagcgcgatccgcactaatctagagacagcatggcgcttgtgtaaccatctcttcttttggctccaagagatacacctgtgaacacctcacagggaacatgtccaagaccacatgacaaaactaccactcaactgttaggtctggctgtctccgcaccaacaggcaaaggacatatgggttgaaactggccagggcagaccatattcttgtggccgatgcgagtcttcgcattcggcataggtctaggacggcccctcatttactttactgttagggaataagtaaaaataagaacaactaactccccatcgcttgttggagacaatgggaatctttgggctgattatttgtccctgttctcggattcgtaggcttcggtcaccgttgcccgccaggtcttgatggtctctgcctggacgaaggagcggaagggtttgaggtctcccttttcgtcgaaggcctgcaaagcttcaaagtaggctttgcggtctgtagcgaagaccgtgcagggagggttgccacctgcgagcagtacatagttcatcagaaggcggccggagataccgttaccgtccgcaaacggatggatcgtctcatagctcgcatgcatgaaacttgcggcggtcaggacgcgcttagcggtcgggtcctgcagggcgtcacgcacctgctcgcagaggtcgttgacaaggccgggtaccctatctgcagcagctcccacctcgttggagtcggggataatgtagtcgccgagacgataggttcccggacgctctccgtcggcaaataggcgctctgaataggttgcggcgcacagggtctggtggagatccataacgagggatttatcgaccggacgctggtcttgaaggtattgtcgggcgcgtacccaggcacggcgttggttgaagacctgtacgagcggtttcagggcaccggtgtagttcttcacagcgttgtggtcgaagatctgctgtgccacctctttggtggtgtgtcccttttcgatctgcgctgaattgagtgagaagttcagtgcgaagtcatcgagcatagcatcctgcacggcaggatgctgatcgtgccaccagtcatatattccggcatagagctgatcgagattcatgattgttacccctttgccacataagagtcgtggaattcgcgcgccttcatcttacccaatagcgtagggcatacaagggatcactgcggtggaattgcagctaaaacggtaaaagcaggtgtagagttgatggactctacagtgacaaacaattcaaaatagtagacataaaaataaaatgcaagatattttcgtcagaatgcacaataattcgaggaaatgtgttaatatgaagttactttttaaaaggaggattgttgcgcatgtataaggttggagaatatgttgtacatccggggcaaggcgtctgcgaaatcaagaagatatcggagggtgaccggcctttttacatgcttatgccagtaggacagcgtaatccgatgctgatcagcttcccggtagcggcacaggaccggcttcgtccggtactctcccgccaagaggcagagaatctgatcgccgagtatcccaccatgccggttgagcactataaggacagaagcaccgcacttgaggaagagcacttcaagcgtgaaatcagaaacggcagctgcgaggatactgttagaattgtaaagaccttcagaaagcgtatcgcggatgtgaaggcccgcaacaagaagccccctgttgtctttgagcggatcttgaagaaggcttctgaacgttcactgtgtgagatggcagtggctctggatacgacgtccgacgctgtggaggaacagttcaaggagagcgtcgacaacgcccaaaactgataagaaagatcctagagcatgaatctgtggcagttggaatacttcgtggcaatcgctgaagaataccaggccctcgctgcagccaaacggtttcatattagatagctccctctttcttacgagcttccagttcttgagaaagaactggggtgcaaacttatagaatgaggccccagaaatgttgagctgacggaagtgggcaagctcatgtgagggcggagtgcattctatcacccaccaatacgattgaacgtgaactgcagagcttcgggcaggggatgaacgggattctgactgtagggagtgtcttttttgcctgtgggctgtgcccgactccctcgatgtagtagctgtgctgcaactatcccccgctgcacatagaggtgcacaaaggggggcccgctgagatcatctctatgctcaaacagggagaagtcgatgtcagcgtagtgcggatgcccttctctgaggatggcttggatgggtgctatgcgccggcagatccgatggcagccttgatccctgcggtatccactgtgacagagaaaagacgacgctgatgctctcagagctttccagacagtctctcgtgtaataccgaagctacgaggagatactgaagcagatctttgagactcacaaactgaacttcctctgtgtctgtgtcgcggataccgtgaaccgagccctacctatcattgtttgttatagggtagtgatcatcgggatggtgcccgttgtcgggaccgtatccgccctcagaacggtatccaccgcgattggatccacggtgtggaccacggtcagatccatgatgcggtcctctataactgccacggttcgagctgtgataacctcctcgtccatggaagtggtcatcgcgaccatggtagccgctgccacgacggtcctcatggccgttacgctcatgggggcgtgccttcttgatcggggcgtccggatcatcaccgagcgccaagagcttgctcctaaggtcgtctgagacggtatcgaccatattttcaaaggagatacactcatcttcggtgagtgagctgaagacctcttcgtcggggtccatctcatcgaggtcggggaccgctgctgtgccttccggggtcagtgtcacattgatcacgcggccgtcctcttctgactttttacgggtgatgtagcccttctcttccagcttgcgcaggagttcggagagggattgctgacgcatgccgagtaggaagcagagttccttctgggtgatctgaggctttgcggcgagcattgcgagtacgcggccctgacctcggagcgggtcacccaacccaccgtgagcttcggcggtgtgcttgacgtagcggtgcatgaggcgtgtcatgcgccccgtcttctcaactaaactcatctcctcgggggtagcggtagccggctggtcctgttcatatgattcattgtccatcctgttttcctttcactaggtggatagcgtatgtcctgtatggcatagaccttactgtaaaggtgaaaaatactgaacccctgcgtaggtatcttcaccaagcgaccacaatatacaggtacctgtacattactgtgtatatccgatgcagcgctgcggtatccttaccacttgtgacactcacaactgagataagacggtacctgatgttgacgtgcaatcacacagccctacatatctttgattttgatacgacgatcaactacgagagcacccacgaacttgatttcgataacaaagcggtacgctcttatgtgacacgcatcgtgagaaaagcgctcttctttgcggataaccagagcgatcagttcactggcaatagcgcgttgccgagtggatcaaactctatcatcaatcgcagctcgacttggctgccttctcctgtgagatcgctgacttcttcttcgggagctcagactcagcgaggataaggctccctacgatttacttgtcgtggacgccaccgactcaggcaaacccaagaaagaagaagcggaagctgaggacctagcggtggaccataaggcaccggcggaccatctgtttgcgatcatcttactcgtgagaaagcagggctatgtacacgaggtgctgtttggcaacgtgaacaacgtcgagaaaaccgatgcactgctgccggaccctacgcagaaactcggcacctacgcaatcatttacctctctggtctctcaatcgtctttgcggacaggaggcgcacgattgcagggcaggagtcgatgatcattccggatgggctgctgcagtgctccaaggtcgcatctcccaaggaggttatcggaatggtgacgatgatggtggaagatgtggcagaggaatacggattgaccctagcggtcgaggtctcaaagccaaggcctgcgtgtccgggcaggcggatgagacacgaagtgtgggcccctcgatgtgggcaagaagatctttgaaaaccatcctgaggcgcaggggcgctacggggagaagattgagcatgcagtccggtggcggtttcccgtgaagtggccgtgaagccttcagcggtacatagaatggcgaagaatcactggatctgtatcgataccggcatcgagatcattttcccgagtgagtacaccaacaacggccaacatatagagttcacaaatctgctcgaccgccatatcgcaatcacgatcaaaagggtcgagtatatcgaaaaccgttaatcgtcgtgttcggtctcctgattgtcctgttcagcgtcttcttcctgggtctcaggggagggcgctgtttctgtatctgaggtatcggaagcttctttgctctcgtcttcggattcctggtcggctgactcgtcagcttctgcaggcgcgttgtcgttctcctctggttcagcgtcttcgctatccgaagctccctcagtcttatcggaggcctcagagtcctccgcgaattctgaaacagccgcctcagtatcctgagcgtctgtttcagttgcatcagactcggactctgctgtacctgaggtatcgctctgctcctcggatgtcttgttgccatcagaggtttgtggctgctcttcggagcgcgcagtgtcagttgactcggcagcattgtctcccgctttgtccgtgtcccctgacttagattccgtgtcagaagatttgtctgcatcgggttcagatgccgcagcgtcctcaggctttgctttcggtttgggggctaatgatttggtccaattaacaaagagggcaaagaaaggctgcttgtttgtatccttctgtttgtcttcctgctcatccgtcggttcatcttccggtttggggagcatcgtgaagtggaaacggcaggcgggatcgcctgtcccgaggcacatggactgcttaaccttgatgccgccgagctctccccagatattcgggaatcggcacaccgcatacatgagctccgggatgcccatctcctgatagaggcgcaggattccgcagcgtctgacggtgaggcggaaatcatcgtgcccgtcaccagccatatatgtgtaagcccaaccataggcggggatggggcttctcatatttgagcgcagtgcgctgtgctccaccgtcgcttgtccttcaggtgtgaagaaacggcgcatacgtggggcgcgggagcgcatgaaggcgttgtttcgtgtggcgtctgcaaagagtgccgcaatctctgcagggctgggagtgaaatcctttcctaaaacttttgatccgagatagatggcggccagcaggcttgccctgagcagtgcgtaatcaaacattggcccctgttcggggcttttgatgctggcaatggtctgccgatagtatgaatggcttgcacgtaatacgaggtccgcctgggttttcccgtagcggcgtgtgagttcttgtttaagggtggggtgatagatgccccagtatagatggggaacaataccgtaatgcattatgggttcttggctccttgagtttatctgaagtgctttaaggatactatgtcttaggcttcttaaagcgtacaaaatatgaagaccatctcactaacaaggagggtaaggctgtgagcgcaacctttatcaatcttgcgattgtcatggcaatcgcaggtatatccccctatattgcctcgctgatccctggcagggcgattccggaagtcgtctttctggtttttgcaggagccttgctcggtcccaatatggcgggagccctcaccgtttcgggggatgcggtccagtttttagcccagttgggcatggcattcctgttcttaaacgccggatatcagatcgatatagacgatctgaaggggaggtccggcggctttgcgatcggcgcctggttcgtctcctttgcgctcgcgatgctcgtgaccacaacgcttgtagctcaggagtttgccggacaggcagagcttgcttttgcgatctgtttgacgaccaccgcctacggtacgctcgccccgattatggaggacagaaacctgacggggacccgggtcggcaaggcgaccacggtctacgcagcctacggtgagctactgcccgtgattgcgctctcgctgttgctttcagcccgtggggcgcacacgacgctccttgctttctttatttttatcgctgtaattctcttgatcatcgcactaccgaagcttgctcctcgtaccgtgaaacaactgcagacttacttacagaagaatgcctggggcggttcaaggccgatgctcagggtcgcgatcttcctcttggtgctaatggccatggtggcctcggtgctggatttggatgttgtgctgggtgcatttgtagcaggtttcttactcgataagtttgccccggacaataaggtgctcaaagagaagctctccgatatcggggatggctttctgaccccgatctactttgtggtgtccggcgcccagatttcgttatgggcggcggccagcaatgccggcttgctcctcttctttatcctgcttcttatcgttatccgcggtggtgtggttgccctctcactcaagttcaaccccgacacccgtgacctgcctccccaggagacctatgtagtctcggcgtattgcactatggcactgccgctcatcgtggcagtgacctccacggcggtctcctcgcacatcatgagtacgacgacggcttcggtgctggtctgcggcggtgcgatcaccgtgctgctgattccgatcgtcacgagctttgtgcgtatctcgactgaggcccacccggtggaagcggtgagggaatatgcggatgcccgaggtgagaagagttgggagagcatttgggcaccgcaccggcagcatctgcgtatctcggagcggctcttcaatcaggcggtgcggcagcagcgccaatgcgggcacaaactcgactcggtcgagtatatcgtgaagcacgatgcgcggctccgcgagaatcaagagcagccacatagccaaggttctgagggcatacatataaagaaaacaaacacccgctaagggatgcccgtcgacttcttgattgcgggctgttgcctttatgcgaactccgtgtggatgcgggagcgctcaaagtgtttcggtccggtggccgcctgttggtgtgcggggtggccggctgcgatgagggagaaggggaccaggttgtctgagttggtcagcctgattgcggaggcaacttttcccatccgtttcgcatcaggatacgtcgcctgccacacagcgcccaagccgaggcgagtcgcttcgagcaggatgttctcacagcaggctcccatgtcctgtggcgccatctccggcatgcgtatgttggcggtcttcatacaggtgacgattacgaggggagcacgcccgcagggttgcgcgtagggggagctgttggcgagcaaggctctgcgctcagggtctctgacaacccaaaactcccacggctgttggttcattgcggatggggcggccatccctgcagcgaggatatccctcacgtctgattccgacacatcctcgtcggtataatttcgcacgcttgtgcgcgcaaaaatgatgtcgctgtccatcttgagagctcctttgtccatatatagtgactttattgtattccaccgggataaagatacacaatatcgattttcttaccggagtttctcagggtgaagtgtataggaggatgggatgacccttcagcagcttcgctagtgatcgagattgctagcgtcggtttcatgtcggctgtggcggcccatctctatgtggtgcagccttcactttctaaggcagtggctgagctggaagcagagatgggtactacgatctttgaacgctcccagcgcagcgtcaccctgactgaagaggggactcggtttctctcctatgcccggcaggtggtggagctcgtggacctgttggagagacagtaccagcctggggcaaagctgctgtgtcgggtctttgcagtgtctgcacagcactacgcctttgtcgtgaatacctttgta

SEQ ID NO: 394 - DNA, 11391 bp, Unknown
  Metagenome-assembled genome
aggtcctctcgcgtctgccacaggtgctacagcgcctgtggccgaccgggctcaccacttacctggccctggcgtgtaccaccctcacatgcaggatgtcctgcgctcatctgcgctcctcaaaccagacatcgaagagctcccttccgtccctaatctccatgggacctcttaaagagccttgccagcatgcctgccttaagcatccatatcgcaccttagaaccggagcctttcctttccggaaatcctatcgttcaaaggccacgccttcaaggggatgcgggtgtgctacccaccataagtagcgaagagccttttttattagttctgcacgttcctcaggcgtatgcagaaatgcccgtcgggaccattgaacgacggcaagcaggcaaagcaaccttccggtgtgacccatttattcagctcttgcttccctgcctcatcgagcagtaccacgcccggcgccttcagcactgactcgacttcaaagtgctttcccacatcgcttgcgaggaactctttgacaatcgcttcgtcttcttccttgaataccgagcacgtggcgtaacacaggagcccaccgcacttgacgcgtgtagcagccacattcaataaagcaatctgtaactgtggcagagaatctgtctgtttgcgatcaagcgacttaggatcaagcccccacacgatttcagggtgtctgcgcaaagttccggttcctgagcaaggggcatccacgaacacttcgtcgaacttcccctgcagctctttagggcagtctcctgtatctacaagcttcagtccatcgacggcaaagctcttcgtctgcccctcccagccgtactttaagcgctctcgggaaaccttgactttgaatgcttcggaatcaattccgatgaatgggatatctgattctgatgccagggattggttcgtctgtagcatcagccgatcattgaggaagagctccgtcttggtgcctctcccctgtccgacttcgagaaaggatactccgggctgaggggcgcagaggagcgctacacactgtgctgaagcgtcgcatgggatgatctctcctgtctgcactaaaccgcttgtagagagtctctgagggcacccaagagcatagcagttgggtagttcgcacacgtgaggcatcagcttagcttgagaaagaagattttctgtctcctgtactgtatggagccccagattgcctgccacaaagaccggcgcaggctccatctgtgcctgcataaagttcctcacagcctgatctccatgagcacttctgatacgcgcgacaagccaggtggggcaaccgatcgcccaaccgagctcttgatcgctcagggtactctgcatgttcaggagcttcttttggagctctttatgctgtggcctatcgatctgggtaacctggtacaacacagcattagccagcccccgtgcacggggactcacactgcccaccagctcgacgccctgactcaccgcaaccggcactggagtatcgagaaacaacagttcataggttgcgagttcaagcgcatcgcccaccttaggctctatatgggatttggatctgagatgggacttcaggacccgctgcagttcccctttggtagcgacaacgccgagtgcaagccgtgtagcaagcgctctatcccgtgcagacagtgccgcaaaggctttggaagaccgcaacagatcacgcatatgtgcggacctgagccgttgctcacggattgcctcaagtgcggccctacgtgccggtgctatcgcagaggatctcttcttaccgctcacgaaagacttgcccattcagtcggaagctgatgctgcccctgcagccaaaccttcgtctccagctccttttttccatcgctcttcaggctcaagacttcaaggctggtttcattcctacagccgagatagagttggtcgtcttccacacgcaccgtgcctgcagcaatcgttttgtcagagacatgagctttcgtgatacgggtaccttttccggcaagcaacatccgggcgggagccgcatcgctggaagcctgcaccttccgtgcattggttattgcattgtccttagggttgaggtgcatctcctgcttcttgattttcgtggcaagcgtcacctttgaggcatcctgctcagtccaggtcgccttcccctcgtcgagatcgttgattgcgctgactaactcacaggcaccgaggcatgccaactcctgggtgagcaccgcgtcggatttctctccgatcaccgtggacacctgcctgcagtaggctccggcatccaggtcatgagcgatgcgcatgatggagacgcccgcacgttcatcccccgcgaggatggcccgctgaatcggggcagccccacgccagcgcggcaacagggaggcatgcacgttgaggcaacccaaccgtgcgatcgggaagattgcgtccggcaggatcgcgccgaacgctgcgacgcagatcacatctggtttcgcacctttgatctgatccagtacctgcggcgtaatccttctggtctcgagcaccggaatgttctctttgagggcctctgctttaaccggtgagggctccagcttcttgccgcgggaacgcaccgtgtccggtctggttaatgccagcactacatcgaaggcatggttgagcgccactagtgagggaaccgcgaaatcgggggttcccataaagacaacacgcatctattccccaatctctcccggacgggcgccgtttgccagagcgatctggtactcctgtagcgccttaatcttgttggcaggggtcagatggtcgagcatcgtaatcccgtgcagatgatcgatctcatgctgcaggcataccgccatgagatcctccgtagcctcatactgcatcaggttccccttgaggtcgtaagcatatacgaccacgtggctcggccgctccacatcgaccgtgatgcctgggaaagataggcagccttctccggtggtgcgcaccgggccgtctgcagtgataaccttcgggttgatcaacacgtagggcttgttctgctcgagcgtgacgtcgataacgacaatctgcttcattacgccaacctgtgggcctgccaggccacagccgtccgccgcatacatatcgtccagcatgcgcttggcaactttttttgtctccctgccgatgttagcgacatcgatcaggctgcactcctgctgcaggcgctcatcgggagatacgacaatatcgttcaagagtttttccttgcagggcatagaacctctcattcatagatcattcagggggatcccctatatcgtacccaaaccgctacatcaggtcataggcgtccacatcgatcgccacgttaaccccacggggtttcttcaggtcgttcacaatcggggcgatcaattgtcccacctccgcatcgagcggggatttaacaatgatatgcatgcggtagcggtcctggatctttgacttcacacagcccgcgggtcccaggacataccatccggatcggccagagagtttctttctgacttctgaggcaatcatgttgatcacctgcgtgacctgattcttatacttcccccatacaaggacgttggtgaggcgagtatagggcggatagttggcctctctgcgctcctcgagctctgaggcgacataggatctgcggtcgtgggtcttgaccgcctggatcgccggatccgtggcccagtaggtttggataatgacttgaccggcttcctctccacggcctgcccggcccgccacctgttccagcagatcgtaggtccgctcagaggcccggaaatccggcagcttcagtgtcgtgtccgcattgattacaccgacgagcgtcacttccgggaagtcgagcccctttgcaatcatctgggtaccgatcagcactgcggtaggggctgcatcgaattcctccaggagccgccggtggtctcccttgcctttggtggtatccgcatccatgcggatgatcaaggtatcaggcagcaggttcttaagctcatcctccacccgttgggttcctacaccgaactgcgccagatacctgcttccgcagttggggcagcgcgtcgtaggatccggataggccctgataggccagcttcttccacagctgtggcacacgagtgaatgggtgcgctcatgataggtcagcgcggtattgcagtgcgggcactgtggcacgcagccgcactcccgacacatcaggaagttcgcaaagccgcggcggttcaacagcagcactgccttgtggtggtgctccaccgttgagagcagcgcatcctgcagacgcttcgaaaagattgagcgatggccactggtgaattcctggcgcatatcgacaatgtgaacctcgggcaaggtagccctgcccggacgctcgggcatcggaacgcgcgtccagcggacgccattgaacgtaccttgctcacagcgggtgaggctctccagcgaaggcgtcgccgaacctaagacaagtgcggcatggttgagcttgaccaactgcgccgccacctcacgcgcgtggtagcgaggcgctgaatcctgtttgtaggaagtctcatgctcctcgtcgatgattacaagcccgaggttgtgaaccggagcaaagagcgcagagcgggcgcccacgacgacccgggccttcccctgtctcacgagatcccactggtcgaagcgctcaccgaccgagaggcgcgaatgcaacagtgccacttgctccccaaaacgggagcggaaccgccccaccgtctgcgcggtcagcgcgatctccgggacgagtacaatcgcccctttgccttccctgagggcctgttcgatcgcctcaagatatacctcagtcttgccggagctggtgactccgtcgagcagcacgacatctccctgggctgcagcgcaagcttcctgaatcgccttcagtgcctgctgctgtccctgagtcaaatgctcaggtctaaccgagcgtgcagagcttaaggtcgtggtcccgaggcttctgaactcacgccggttccagacccgtaccaccccatatttttccaaggtcttcacggcctgtgaagcccccggcagaagagcattgagctccacgaggcgcatcgcgccgtcagagagtgcccacagcaccccacgctgcttggaagcctgcggacggggcttgaaagagacagcctgatcggtgagcccgacccaacggacatcgagcggccccgcagagcgctggaccaactcccacgaaccatcctccaccttcttcacttttacggtctgccccggagccaaaaagaggcgaaccgcctcacacaccggacaggcatacttctccgcaatccagaacgctaattgagcggacctttcatcgaaggcggagggcgccaagattgcgtcgatcgatttgatcttgttgagggcaagcccctcaggaggttctctatgtacgtccatcacatagcccacggcacgccgccccgagaacggtacgagaactgtcatgccaatcagatagcgcgcaggatcctgccgcaccttctcggtcgtgagcagccgatcctccactgcatagtcaaaggaggctaagagcgcacgggtggggatatcgacgacgacactcacaaagatcatatacgctcccctctcaacacaatcaaagccagtgaggacatcgtatccccactggctttattacagtaccactctattcgagcaaacaggcttactgaagctcagcgacagccttcttgagctcatcgactctgtcagtgttctcccaggtgaagtccggatccttacgaccgaagtggccataggccgcggtcttctggtagatcgggcggcgcagcttgaggtcgcggatgatcgcacccggacgcaggtcgaagaccttctcgacggccttctcgatgatatcgtcgtccacctcagcggtaccgaaggtgtcagccatgatggacagcggctgcggaatgccgattgcgtaggcaagctcgatctcgcagcggtgtgccaagccggcagccacgacgttcttagcgacccaacgtgctgcataggcagcggagcgatcaaccttggtaggatccttgccggagaagcagccaccgccgtgacggcccatgccgccgtaggtgtcgacgatgatcttgcggccggtcaggccggtatcgcccataggtccgccgacaacaaagcggccggtcgggttcacgtagatggtagcgtcatcccacttgatgccaacctcgtccaagaccggacggatcacgtgctcgatcatatcctcacgcacctgtgagagcgcgacatctgccgcatgctgcgtggagacgacgattgcggttacctcaactggcttgtcgtcctcgtagcggacggtgacctgggtcttgccatccggacgtaggtatgtgagggagccgctctttctcatgaaggccaggcgctctgccagacgatgtgccaagtagatcggcatcggcatcagcacgtcagtctcgtcggaagcgtagccgaacatcatgccctgatcgccggcgccaatcttgtcgatctcgtcctcattggcgcgagcaaaagtaccatcaacgccctgggcgatatccggggactgggagtggatcaggttcatcacaccgcaggtctcagcgtcgaagccgtacttggcgcgggtgtagccgatcttggctaccgtgtcacggacgatctgctgtacgtcgacgtaggcctcggttctgacttcgcccataacgacaatggtaccggtcgtggtgaaggtctcaatagcgcagcggacgttgttcacgtcagccctgtggccctgagcatccacatagccctgcttctgcagctcagcctcttttgcgaaaatcgcgtcgacgattgcatccgagatctggtcgcacatcttgtcaggatggccctcagtcacggactcagaggtgaataggtaattcttgtgcgacattacactcctcgctttccctcgatcctatgttcggagcttcatgaaaaaagcccccgtctttccaggggactttatgagcgacacacacatattgtccccgtcttccaggctctaagcctgccgagaattggcacccttcctctacgcgtatgaggcgggttgccggagcgtcatcgggctcggtccctcggctcttaagcactgcacctttgcatgcggtgcctctcgacgagcgatttgtgcggtaatacattacaccaccgcgcagacacttttttaaatgtagttcaaaaaaataagctgtgaaggcttttactcagtcttcacagcatcacgacaatagagggcttccccacgacagaatcaggaattctgttggagttccctgtcgacatccacatctttcagggagaccccttgcaagatgatgtgcatcagctgtcgggagaattcctcacggtccatcttgccgcggtcgttcaagtatgacatagcggcgaacatgaagacgccgatcacggagttggcgatgagcgatgagtcgaggctcttctcgatcacaccctgatccttgccttgctcgatcaggtagttcgtgaagaagatcatctggctgtagcgggagtcgacatcgtcgatcatctgatagcccttgtggaagaactcagagagcagcgccgagaacccggtcgtattcttggtcagggcatcggagaaggcgtcacagagctcttttaaggctttgatcgttgtatcattgtggaccacggcctcctcgagacagttaattatatcatcgccgatcgaatcatcgattacgctcacgatctgggagcggtccttgaagtagtagtagagggcgccctttgacatgttgcagcgctccgccacctcgctcatctggaaatcgatgctgccgcgctcgtagatgatctcacgagctgcctcaatgatccgctgccgggtccgggtacttttgcgcgttttcatgcgggagccggccgtatttgactgttttctctgttttattctggcctgcaatgcgttgtgcatctccatcatcacgccgacggccacgtctccggtcgcactgtgcgccaattctgccatatgtgaaagaccccttaaagatatatggtgccaggaggcaccagctgtgttttccactatagcatgctgaactataattttgactgaaaatatcgaaatttacatctatgcagttgtttgcatatttaaccggcatttatcttttgaaccgaagtcaattttcccaaatattgtaagtaacttacatacatatctgcaggtcagtccatgctctgtaggccgggaaaactgctcagggcacgcatgatctcaggccttcttatgtgaacaaactgtagctaccgattgggcagtgcctccgcgtttgtctatactggcacaatgaattcattgtccacactgatgcacagatcctgtgtgcatcacccttgtaagaaaggcagcctcgttcgtgagtgatgacaagcgtttggtacgcgtccgctttgccccgtccccaacgggaaaactccatgtgggcggcgcccgtaccgcgattttcaactgggcttttgcccgtgccaaccacggcaccttcatcctgagaatcgacgacactgaccccactcgctccactgaagagaatacgcgggtcattctgcgcgcgatgaggtggctcgggctcgactgggacgagggacccgaggtcggcggcgactttggcccctacaagcagaccgaccggctcgagatctataagaaggccgcccatcagcttgtaaaagagggcaaagcctactactgcttctgctctcctgagaaattggcagctgataaaaaagctgcccaggagcgccacgatcccttccagggctatcccagaacctgccggaacattccgcctgaggttgcccaggcgcgcgtcgataacggagagtcacacacgatccgcatcaaggtaccactggaccgcggggacgttgtggcccacgacgtaatccacggcgacgtggtcttcaaggccaatgagctcgacgactttatcatctttcgctctgacgggaccccaacctacaacttcgctacggtggtggacgactcgatgatggggatcacccatgtgatccgcggcgacgaccacctctccaatacccccagacagatgatggtgtacgaggcgctcgacaggccggtgcccacctttgcgcacatctcgatgatcttaggcccggacggcaagaagctctccaagcgccacggcgctacctcggtagaggagtaccgcgatgcgggctatctctccgacgccttcgtgaactacctggcactgctcggttggtccccggacggctcgaccacgatcgtgccacgcaagaccttagcctcagagttctcgcttgaccacgtgagcaagaatcctgccacgttcgatatcaagaagctcaactcgatcaaccagacctatatcatggcaatgagcgatagtgaattcgccgacaagatcctgattccggagctcaggagcgccaggcttgagcctgaggattccaccctgcacgagcacacgtggtatgagatcttagcgaacgtccttaagccccgcaccgtcgtgatgcccgatgtaatcgacaagagccgcttcctctatgtcggcaacgttattgagttggacgaaaagtccgtcaagagaaacatcgcgaagcccaacaccaagtcctatctgaccgccgcaaagcgagcgctcgagagcgtaagcgaggagaactggcacgcagagcagatcaacgctgcattggcgccgctccctgaccaactcgacacctccaagcgcaagttctacggagcacttcgtgtcgcggtctgcggcaaccaggtctcccctccgatgggtgagtccctggagctgctcagcaagccctgtgcccttgcccgcatcgacaacgcgatgccgcttgcccaataagcaacgactacagcattgttttaaagcctggtatattactcggttttctgtttgtttaacggggcttttcatagcgatctttatgttggcagaaacaatcctagggacagcacaccccctgtcccataggcttggaaggaatgtcaaaccacagggaaaagggaccactgatgagttatggcaacctctgcatttgaagatcgtcggcaaatatggtcggcacaaatccttttcccaataccgcaggggcggtgcgtatcgccctaacagcccgctcactgagaaggggctccttacttaccagtcgtcgagatcattcctctacaactcattttcgccagaactgcatcttcgggggcacggcacgtaagagcgctcattgcagggtgttggggtctgccgggacgataccctgggtgtggaagggatgcgctggacttgggcgacgatacagagaacgtggcctcaccctttaagattcacgaaggacgcgggggacgggggccaaacccccccaaccacacggtcttctgtctaatcagacgaggcatcaaaactaaaggacagccggaaaactggattccatgttgtgcggcgaatcacctaggaggggggccggctcggggcccgatcctggatctctgatgaaatcaatgggtcgtcggaatgaaaagatccacctggggactacccggacctcttcgtggacagcaaaccagataaaccagggcgtatgcctcctgacttgacgggaaaatcttggacaaaggagcactcaacatcggagggacaagcgcacttcagaaagaagaaaggacccgggggttgagcgtataccgaatcttagaccgatgaacggattcagacacggacccacccccccccacaccgtctaccccaacgccccccgtgcaccgggcgtggacactcgtgtacctaaccggctggtggctgaagttgcagagggtgcttcatgtacacagtttgcaagcatcgtcaattattactggcgccaatgccccctcaaaggccctagggtcaaactcaaattatggactttgcagcgcccgacggcttatggagctttgccgcaaaaacagtgagcatcgccggaatgatgcggatgcgggatacagaagctgcggcttagcaaagaaaaaatccccgataagctgagaagaaaaatcatcgatttacgatttgccgcgcccaaaacccattgaggccccttggcgcctgagaattcactggggaggcttttctctacggggaaggccaaagcgcgtcgcggaaaaccactacggccgttcatcaggcgcatcaaagctaggcgctcgatgaacatacgcgatggacacaaagattgaaacgctttatgactaatggggcgtgattgttgcgga

SEQ ID NO: 395 - DNA, 6859 bp, Unknown
  Metagenome-assembled genome
gtgaagctatgaaatgggccctatctaatagtactcccaagtgtactagctttcctttatgcccggttcctatctgaagtcagacagagcctctataacgaatgctaccaacctaagaccggaatagatgccctccgctaacaagtacacaccctggacgtctttcactttgccgacgtttttgcaagtctgatagggggaattcgaggcgggaaagctttagacagacatcagtagagttattttgcatctgagctgcacatccgaattaaccggaatcgctggaattattgaatccgaattcgtttgaatcgcccgagtcagaatcgcttgagtcccttctccctgagggcttcggcaggaatcaagttctgctcaaataagagcgcctgatacgagttcttcccatcgtcacgcttggccgagtcaagcccaaagagcacgtcgtctttgtccgtgtctcccccgtttgctttggcccaagcattcatcaactcatccgaccagttacgcagccagttacccagggtcgtgatgttgttgatatcgtcgttataggtgccggtcgaggtgtcgatgtcctgaatcttgttgatcaggttgctcaggtcgttggcgtcctgctgtgcggtctggtacccctgcgtatagtcggggttacgcgaatcgagggcatcacgcagactctgctcacttgagtagagcttatccttcaggtccccgaggtcggcatagtagttgttgacctcctcgaagatctgctggtccccatttttggtggcatcgttgatgtcgctgtcctggctcgcgagcttgctgcgctcccccggaaaccccgccatcgacgtatccgccgcctccgtggctttgagcgaataaggatccgggttccaaggctgcgtgatcagcagcaccgcgccaccgaccacgatcaaggctgcgataaacgagacgaggaacaccctccggcgcggcatacgctcattggcggtagtcgcagaatagggatccgaggctgccggaatcgcgctcgccagatggggcttttcctgttgctgctggagctggaccgcagccttttcggcaggctgtatcgcctcttcctcaaccggcatgccgcagttgggacacaccgtagccccttcagggatcagcgcgccgcaactcttgcagtatcgctcagtctgtatcgctgaagcgtccggaaccgctttcgtcagatctgcgtggcatgccgggcagatcgtaaggccgtcagcaatgtgtgttccacaatatgggcaaatcaaaccttcctccaagccccgacacagatgtcctgctcaaagcctaacacgaacctgtgaaggctacgcaagctcttccaacacatacggtaaaattcctccagcgcagatgaagcgtccctcacgcggggtatccacgcgtacggtcaccgtgaagctcacctgagagtcaccctgcttggtggcatgaacctcaaccttagacggattcggcagaccctttgagaggtcgattgcgtcgaccacgtaggtctcgctgccgtcgagccccaggctctgagcattctgtcccccttcatactgcagcgggacaatgcccataccgatcagattcgaacggtggatccgctcgaagctctcagcgatcacagctttaaccccgagcagcgcaggacccttggctgcccaatcacggctggatccggagccgtacattttgccggcaagtacgatctgttcggtgttatgctgcttgtagtccatcgccgcatcatagatgctggtgatctttccggtctcaaagtcacgggtccagctgccgaccttgccttcagccaacgcgttctccagcttcacgttcgcgaaggtaccgcgcatcatcacttcgtggttgccgcggcgagtgccataggtattccaatcttcctgcctcaccccatgctcaagcagatatttggcagccggggaatccggagcgatcgcgcctgccggggagatgtggtcagtggtcacaaagtcaccgagcaacgccagtacacgggcatccttgaccgttgcggtggtctctttgaccgcatcctcaaaatacggaggacggcgtatataggtggactttggatcccaggcatacgtatcagaggggaccgctgggatgtcctgccaggcctttgagccctgatacacattcttgttggactgcgcatagatctcaggctttacgaccatctttacgaccgactggatctcagcattggtcggatagatgtcagagagcatcacaggcttgccgtcagcgccagtgcctagcggatctttggttaggtcggtatcaagggtcccagccagcgaataggcgacgacgagcgccggctgcatcagatagttctgcgcgacatccggggagattctgccgtcgaagttacggttaccggagagcgctgaggtgagctccatgtcctgggcatgctcgtgcattcccggggccaaagggccggagttgccgatgcagctcatgcagccaaagccgcagacaaagaaaccgaggtcttcaagcggttcgacaagccttgcatccttcaggatctgcaaggtcgcatgtgagcccggagccaggatcttcttgacccaacctttcggcttgaggccgtgctcgacagcgtgcctcgctaagaggcctgccgcgatcatcatcgccgggtcggttgcggtcgtgcagcttgtgattgcggcgatcgccactgcgccgtgcttgatctggtaggtatggttgccaagcgtcgcagtgaactcgtggtcaaagtcagcgtggttgtgctctttgctgaccttctcaaaacgggccgggagctctgcgagcgtcacgcggttgtgcggacgggaaggtccggccaggcaggaatcgatggtggagagatcgagggtcagcgtacgggcgtagtgggcctgaggacggtccccaatcatctgctggaccttaaggtatctctgtgcaaaggcgatctccttcggatcgcggcaagtgagtttcaagtaatcgaaggtcttatcatccgctgggaagagcgtggcggtggctccatactcaggggtcatgttcgcgatgcaggcacgctgggtagcggtcagggtcttgacaccgtcgccggtcacctcaaccagggaacctacgacttgcgcctgacggagcagctggcagacgcgcagggccaagtccatgccgctcgcaccctccggcagtttgccagtgagcttcagctctacgacttcaggtacaagcatcgagatcggctggcctaatgcagcagcctcagcctcgatgccgccgacgccccaacccataacggagataccgttgacggtggtggtgtgggagtcggtgccgacgagcgtgtcgaagcacgccatcgttccgtcacccttccacagcgcgtcggtgcccacaaccttggagatgagctccatgttgagttggtggcagataccggacccaggcgggatgattttgacgttctggaaggaggaggatgcccacttcaggaaggagaaacgctcagcgttgcgcttggcctcgatgtgctcgttggtgacgagggcatccgaagtgctcgctttgtctgcgatgacggagtggtcgaccacaagcgtacagggaacgcgggggttgatcttggtcgggtccccaccgcgcttggcaagggcatcacgcattgcggcgaagtcgacgaagaccggcacgccggtgaagtcctggaaaaggacgcgggaaggcatatagtcgatctctttgccggcgtggccctcctcggcggcctcgaagatgcgcagtgcggactcgaccgcctgctcgtcgctgtcggcgcagcggatcacattctcaagcagaatcaccaaggcgcgcgggagtttctccaccccggggatatcggagacgacgatcgcctggcgctgagtgccgtcaacggttactgttttcggcttgcgcgcggctgtgatagcgctggagaagtcctttgtgacgttcatagtttgcctcagctttctttacggccctcatcaaaaggccgttcccatagatgtcatgttggaagtgagtatagagacggttgaaaagtatacaggcaagcgtccctactagtacaagatgtatccccatcgtctctgtggaggcctgaaggaggaaaaagtttccaaaaagcaacgaccctccaacaacgccgatccccacagtgaccaaaagcccgatgcgcaggggtgtcagtggctgcgagatccgatagatgaaagcgatgccgacgatgcaggagagccacacgcacagcgtcgactcccgtgcaaagccccagctgaagatatcctccgcagccatcgtcgccaccaccgcggccacgatcgagatcgaagccggcagcgaccttgtcagcacattgaccaaaaagtccccgtgcaggcgttcatggttcggctccagagcgagcacaaaagagggatagccgataatcaagccagagatgaaggagatctggatcggcatgaacggatagggagggaaaaagatactgatcaggcacagcacgatcgagaagaccgtcttaacgaggaagagcgaggcggagcgctgcaggttgttgatcgagcggcgtccctctgccacgatgtccggcaggtgcgagaagtcgttgtccgccaggaccacctcagccacgttcctcgtcgcagcggaccctgacgccatcgctatcgagcaatccgccttcttgagcgccaggacatcgttgacgccgtcgccggtcatagcgacggtgtggccctcacgttggagctcttcgatgatggcgcgcttctgctgcggggtcacccgcccgaagatgcgcttgtgcctgacgaccttcttcaattccttcgtgttgtggatcgtggagaggtcaacgcagcggtcggcaccaaccacccccacctgctttgcgatctgcgaggcggtccgggcgtcgtcaccggtgatgacgcggacattgacaccctgcctggtgaaatacttgatcgtgtcggcagcataggggcggatctcatcttggatcacgaccaagccgaagggccgaaacgagcccgtgatggagccctccgtggtgaagccggacacctcccccaccacaaggaagcgtgaagccggcgaatagtgcttgcggatcctgtagagcttgttgtagtcgacccccatcacgaactggccggcgcccaacacgtaggcgtgcccgtctttggcgatgcagccagaatacttgcgctccgaggagaacgggaccgtgacccgcaccgcatcgctgtgcgtcgggatctcctcgacgtagctcaaaagtgccttggcggtctcattcgcatcggattcctgggagcggacgatcagggcacagactgactcaatctgccgtttactctcatggttgagcggcacaatatcctctacgctcattctgcctgaggtgatggtgccggtcttgtccagacagatcgtatctacccgcgcgagcgtctccacacagtaactctgctggatcagcactttcttgctacccaaacggatcgtggcgattgcgatcaccgaggacgtcaacaggatcaatccctgcgggatcatggaaaccagagcggcgaccgtgctcagaatggcagcgttgatatccatgtgctcgaagaagacgctgcgcagaaagaggccgacccctaaaggcggcatcaaaaacgtcgagaagcgcacaatcatgtttagggtatcgcggatctgcgatctgatcggcttgatgcatttggcctcagtattgaggcgtgcggcatagccctccttgcccacgcgggtcacacgggccatgaggctccccgaagcgacaaagctgccgcttaagatttcgtcgccctcgctcttctcgatgcggtccgcctcgccggtgagcaggctctcgtccatcgtgacggaaccagcgatgatctgagcgtcggcgggcacctgatccccgtgggagaggctcacaatatcgtcctgcacaagctcggagactggaacttcctgccgcttgtggtcacggatcacagccacgttctgtacggtcatgaccgagagcttgtccaccgtgagcttggcgcgcacctcctgcacgacgcccacgatcaggttggcgatcacgatgcccataaatagcaggttgcggtactcaccggtgaaaatgacaagcgccgccagcaccacatttacgccgttaaagagcgtaaaggtgtgctcggcgatgatctgaggaatcgttttggtctttacgtcagtgtcggagttgaccttaccggccttgacccgctgctcaacctctcgtgaagtaagcccgcaaacatcaggggtaatttccgcttttggcacacaatctcccacaacaagtactgtccgtcttctttattaaagaataagtatccccaattatcccaagttacgctgaagacggtttaaaaaatcatatgtgtctatgcaccagaaaataaaatggtgctctcggtggggttcgaacccacgacctttcgctccggaggcgaacgctctgatccactgcgctacgagagcaacaacacttaggcagtatacccctcctcatattaatttgagaagtcaaaataaagaactgagcggcgtcagcgcggaggtacccctacactctatatataagagtatcatccaacatggtttaattgagtgaactatatcgtatgtcataagagggtttcgctatgatagctgtcgtcaaatcgagcgccacgcccgagcagttggctcacttcgtcacgtggattgagcatcacggattcaaggccaacgtctc

SEQ ID NO: 396 - DNA, 66808 bp, Unknown
  Metagenome-assembled genome
atcgtattgtgagagacccagggttgtgtcctttaatccttgcggctgttgcactagcaatgaggattcacccataaactctctgccgaaactgtgaaagggtctatgtgctggtagaattggacattggattttcagctgtactgtgaaccttttcaggaggaattcatgggtttattcaataagggggcgctctataccccgaactataaggttactggagacgaaatcgccgtcttcaagaccaacaagggcaccgtcaaggtgaagcttgacgggaagggcgctgcgatccatgtggctaacttctgcgagctgacgaacaagggcttctacaatgggctcaagttccaccgctatgtctcgaacttcgtgattcagggtggagacccgaatacgcgtgacatgtccagtgaggatgtcgccgcgggcaagatgggcccgcacgggatgccgggcaccggcggtccgggctactcgatcaggcacgagtgggacgtgaatccccgcaatagccacgaggatggggcgctggcgatggcacggagtcagatgcccgactctgccggttcgcagttctatttctgcttgggaccacagcattttctcgatccgaactatacggtcttcggccagacgattgagggactcgacgtagtgaagagcctgcgcgcaggcgacacgatcgaatcggttacgattgagaacggtgaagacgcttaaaactgatacaacttctgtggcatgtggaggtgctgtaggtggataaacaggcgtatcaggctggcaaagcagcctatcagtcaggtgatttcaacggggctatcgaacagctcgtgaatgcggttgacggcgcaggcggaaacggtgctgctgagcacatgctcggcaacgcctacatgaggctgggccgctatggggatgcgattgacgcctataccaaggcgctctctgatacgagttacggaagggtcggcccgctgaactcaaaccgtgggcgtgcctaccttgctaaaaatgaccccgacagcgcgatcgacagccttcaggctgccgtggccgatgataactaccacaagaaatacaaggcatatctcgctttaggtcaggcctatgagctgaaggacgacccgaagaatgcgggcatcgcctaccgcagcgcggcaatcgatgagaataatccggatcctgccctggcactgcgtcggttaggccgcagcttcatcgagctgcaccgcccggttgatgcggttgaggcctaccgtaccgcgatcgacttcgccaccccgatggagaaccagaatacgatctacgcggagctcggtatggcctacgtggcggccaaccgcatgagcgaggctgtggatgcgtttgcgcatgcgacctccgacggcacctaccgtctgagcaccgatatgcagatcgcctatgacgccgcgaagcgctccgtggctgccaacagcgcaagcagcccttcggataccgatgcactgctgcagcgcgcaggctatgggaagaacgcagataacacttacgatccacttgacccgcttggcaagtccgggcagatgatgccgtcaccggatgagtccggtttcttctctgtctctgaggaggacctcgttaaggcagacaagaagaagcgtaaagagcagcgcaaagagaagcataccggacgcaaggtcgcgatcacgattgtgattattctggccatcgtcctcggtgtcggcggctatgcctactatcgtggatatggttatccgtcccagagcgatgtgatcgcttcgcttttctctgcgaagacctcgggccgcgatgaggatgcctacctgtccgacagtctaagcgatgcacagcgcacgcagattgaggcaattatcccttccggcgcttccgtcaccgtcgaggggctcgatcagtctgcccaggattccaccgcccgcatcaatgcccatctctcctccggtgaggatcagaagtatacggtctccttggtgcgcgacggcctcagctggaaggtctcagacatccagctgtcctacgattcgaacatcaatagttaaagggtcagtttcactgggtaagaatcagaacgatatatgaaagatagggaataatgtccttccttgattctatatttggcgagtatggtggagacttggcaatcgatctcggcaccgctaataccctcgtatctgtgcggggggaaggtatcgttctgaatgaaccttctgttgtcgcaatcgataaggaacagcagcgggtgcttgctgtcggtatggacgcaaagcgcatgatcgggcggacccctggctcgatcattgcggagcgccctctcaaagatggcgtgatcgctgactttgacgtgaccgaagtcatgctgcgctactttatcgacaaagcgcgtgagcgcaaatatccgtggtcgcccaggccccgcgtggtcgtgtgcgttccctctggggtcacctcggttgagaagcgtgcagtctttgaggcgacgattgcggcaggggcgcgtcaggcctatctgatcgaagagccgatggcggctgcgatcggagcggatctgccgatcgaggatccgaccggatccatgatcgtcgatatcggagggggaaccacggaggtcgccgtaatatcgatgggtggtatcgtggtctctcagtccatccgcgtcgctggggatgagttcgaccggaccatcctcgagcacgtccgtgacgtttacaacctctcgatcggtgagcgcaccgcagaggacatcaagatcaaagtcggctccgcggcacctttggcagaagagctggacgttgaagtcaacggccgcgacgttctgaccggtatgccgaagacggtacggatcgaatccgaagagatccgccgcgccttggataagcctctcgacgaggtgaccaaagcggtcaaggacacgctcgatgtgaccccgcctgatctggcttctgacctgatgtactacggtatccttctgaccggaggaggcgggcttctgcgtggtctcgatcagcgcctgcgcgatgagaccggcgtcccggtcaatgtttcgcccaccgcacttgaaaacgtcgtcaacggctgcgcgaaggtgctcgatgccaatgcgctttcaggcggctttgtgcaaagtgctgggttataggtatgccaggcatgaacacaggctttcaaagaaatgaccaaaggtcctcaggaggtcggctggccatcgttttggtggccatctcgatcatcctgttcaccgtgagtgcccgcgggggagacaccgggtttctgggtggcctgcgctcgttctaccagacgatcaccctgccgatcagctatatcggcaccgtcgtgtcgcggcctttccaggggatcgggaacgccgtgagcaacatgacagcggatgaggcaacccttcaggaccttgagagtgagaataaacagctgaaggctgagaatactcagctgaaggagtcgcaggagactgcgacccgcctgcaggccttactcgatctgcaagacagctacaacctccagtccaccgctgcccacattatcaatgcctcaagggattcctggtcggatactgtgacgatcgataagggaagcgcagatggcttggatgtaggcatggcggtcaccgactcctcaggtgtgatcggccagatctcgcaggtgagtgccgattctgcgacggttcgcctgatcgctgatgcgaactccggcgtcgctgcgatggtgcaggaaagccgggcgcaggggatgctcaacggctctgcggacgggacgctctcgctcaacatgatccgtaccgaccaggctgtcaacgtcggcgatgtggtggtcacgagcggtctgggcggcgtctatccgaagggattgccgctgggcactgtctcggcggtcgacaagctcgacggggcgctctactacacgatcagtgtaacgcctgctgccacgacggaaagctacgaagaggtattggtgattacctcactgacctcaggccagtccgccacctcagacgatattgcagaggcggacgcgcaggaaggcatgagcacgggcaagttcgatgaggatagctcccccgagggcggccgcaatgcttcgaataaccagtcagacaccaccacgaattcgaataccagctcatccaactgatgtgctctcaatacagacaactcgacgttagagatatttgctatgcagatcacgaatacgaacagaagtcggcgcgacatcctgatcttggggctgatctgccttgtgctgcagctcgctgtctcgcccctcatcggtatcgcctccggccatgccaattttgcctttatcttttccgcaattgtggccctgagcatcggtgggacgaccggggtcatctatggctttatcgccggcctgctcttcgatctgggagcgacgagcccgattgggttgatggcactgctgttgaccgtgagctcctattttctgggcaccgagtgccgcaaccgtatcagtgacgatccccgcaatgccttcgcctgctgtacgctggcagcctttgtggtctcgctgctctatagcctagcgatgcctttggtagggcaagcagatacctttgtcgacatctttgtgatgcgcgcgctgccttcctttgtcctcacctggctcttctcgattccgttctgcctctactacgcccgctctgaggggcaggggagatctccctcgggaggcctcaagctgggcattgactccgctccgctgagcaccaaagacctcaaccgtgcacgccactatgtctttcgcaagcgctaggtgaccgacgtgagtctggctcaaatcatcattctggtcattgccattgtcgccgccgtcgcggtcgtgatcctgctgctgtctcgcggtgaagcccgctttaccttcgatatcggcggcgccaccccgaaggcttccggcggggaggataactccggtggcacgaccctcagaaaccgcatcttaggcctcgggatcttctccgggggtatcatcggcgtgctgctcgcacgcctgtgggggatgcagcttatctcctcagatgaatatacgcagcaggcggagtcgaaccgcacacggacgatttcactcatggcgccccggggcaggattttggcccgtgacggtaccgagctcgtgaccaaccgtccttcgcttgcggtggtggcacaggctgatgtggcaaacgatgacctggaattgcaactgctgagcaacctcttggggatcccgaagatggcggtcaagcgcagaatcgaggacaccgccgaggggacccagtccaaccgcaccgtgatggtcgatgtctcccggcgcgtggtggcctaccttgaggagcaccccgatatcttcccgggtatcacggtcgagcagcgcacacagcgcagctatccgtttggatccatggcgggacaggtgctcggctacaccggcccggtcacgaccgatcagctcaaggcctcccaggaggatacgagcgaggacgcgatccagtaccactccggtgacaccgtggggcaggctggtgtcgagtcacagtatgagagggtgctgcagggtgtgcgtggcgagcagacggtctacgtcgatgcgaacggcaacgtcacctcttactccaccacggtcgacccacagagcggctccgatgtggtgctgaccctcgatcccaagatccaacaggcctgcgagagtggccttgcccgtgcgatcaaggcggcagtggacaccggctacagagactgcaagaccggcgcgatcgtgtgcatggactgtaccaacggggagattttggggatggcgtcagcgcccaccttctctccccccgtctttatcggcggcatctccaacgatgactggaatgagctcaactcagagcagagcgaatacccgttgctgaaccgggcgatccagggtcagtattgctccgcctccacgatcaagcccttcacggcctttgcggcgctctccaacgggatcgccaccccgaattcgacctatgtctgcaccggcaagtggaccggctttggggccgactatccgcagtactgctggaaccacaacgggcatgggacgatgaccatcgagtcaggtatcacctactcctgcgacgtcgtcttctacgagataggcaaagccttctattattccgacaatcccgaagcccagcaggaccacctgcgctactggggcttaggctcaccctacaatatcgatctgccctatgaggcgtcgggacgtgtgccggatgccgagtggaaaaaggaatactacaaggattacagtgaggatgagcagacctggcacggcggagatcagacgaacatctccatcggccaaggagacattctggtgaccccgctgcagatgtgctgcgcctatgcgggcatcgcgacggaaggtaccatctggcggccgcacatcctgaaatcggtgcaggcccccgggggagccggcacagttctggagtaccaagatgaggtagcccaccagatccttgagcagcctgactacttcgcgttggtcaagcggggactcagaggtgttatcaccaaggagagccgcaacatcattcagcactaccaatccctcgatgtcccggtcgccggcaaaaccggtacgggcgaggtcgcggggcaatctccggtcggttggtttgtcgcctacgcacccgccgatgatccgaagtacgtttgcgcctgcgtggtcgacaacggcggctacggtgagaataccgcaatgcgcggggtccgtgatgtcttcggcgccatttgggaccagcctgacaattcagatgctaccagtacaaccggcgctcgctaggaggtatgaggtgccctacagagtcacaactagaagaaataaggcaagcggctttgaccgcctgatggcgcgcctgagcgcgctcgatcggtcccgcagagcccaccgatcaacgcggagaggcaatgtgatctccaacaacttctatctgccgcagctgatcccggcgcttctgctcgttgccttcgggctcgtcgtccagtggtcggcgtccctctcaatctctgaagcgagcctgccccgtcaggtggtcggcgtgctgattggcctggcgcttgcagcgctcctgtggcactacgactaccgcgccttcgcggcgatgcgcactccgctcctcataattgatgcgatcctcctgctgctgccctcactgcccttcatcggcgtcagcgctaagggcatgaccggctgggtccagatcccgggtttgggtgtgcgcttccaaccttcagagctcgcgaagctcgtgacgatcctgatgctggcttctgcagcctctgactacaacggaaagatcaaatcctttgaggactatgcccggctttgcggcttgttgctcattcccctcatcttgatcatgacgcagccggacttgggcaccggcctcattatcctgatcaccggcgcctgcatcattatctgcggcggtgcggattccaagtgggtgttagcgacgatcgcgctcatcgttatagccacctggttcgtgatcttcagtttcatgaccgacgggatgccccatatcatgaaggaataccagctgaaccgcctgctcgtctttgttgacccctcggtggatccgaccggggacggctacaacttgcagcaggccaagatcgcggtcggctccggtgggctcttcggtcgcggcatcgcaaatgcgacccagactatctctggctttctgcctgaggcgcacaccgactttgtgttcgcgctgctctctgaggagttcggcttcatcggcgccctcaccctgcttctgctctttggctggatgattttggcgacggtctccctcgccttgaaagtggaaccgatctttgcaaagcttatcttggtcggtgtgattgccatgtggtctttccaggtgcttgaaaacgtgggaatgtgcattggtatcatgcctatcacaggcataccgctcccgtttatcagcttcggttcctcttcgatggtggcgcagctcatggcagtcggactcgtgcagtccatctaccactatcggacgaagcccgcataagggatctgcatacaaaggagtcaaacgcttatggcacgaacaaaacaaggcatcccctttaagagtatcgctgaaatctttcaggcagcccgcgcagccgatgcacgagcccaaggagagctcaaggtagagatcctgatgggcatcggctcaacgccggaccagatccgtgcggtgaaggaggctttcgtcccggagacctctcacgcctcagtgctggtgtgggacctcaattcccgtgctgagattgccccggacgctgactgcggcctcgtggtggtgctcgtgggggatcagacagacaaggcgaagcagattgtggcccgctgctcggtgcagggggtttcctgtgtgctgatctcctctacggcgcttgagttacctgccctcgatgaggcggaagagatcgcggcggataccgtggtggggaccgactacaacacggtgcaggagcagctggcacagtgtctcgcgctcaatatcaaccgtatcggcctggcggccaacttcccgttcatgcgtgaggaggtcgctcaggtcctcatgcaggagagcgcggcagccaatgccggcgtcggtgcccttgcgtttatcccgggctccgatttcccgctcatggttgtgcagcaggagaagctcgccctcgatctgatgggggcctacggcaagagcatgagtaccgagcgtctgatcgatatggtcggtgtcgtgggtatcggaaccttctggcgctacattgcccgctcggtggctggcttggtcccgggcttcggctggctcatcaaagccgcaatcgcctacagcggcacgctggcggacggcaaagcgatccaggcacatctgaccggcaacgttgatctcacctcacagctgggcaagctcaaggacctctttgtgacagtaaccggggagccgaatccggcagtctcagccaaaccagcggaaaagaaggatgagccggtgatcgttgcgctcgatcacacgctgcccgataccgaagaggtggaagacgatggagagggatacatcaccctggattaggctggtcgcctcaacctgcagcgggagtgctaccacatgcgtcaatcgttttgatcaaaagttggagaaaatgttatactaaaactccttgtgcaggtagttcctactttttaattgacggtcaaatacagcgcgagtagaatatatatctgttgcactcaatacagcaatgaagggttttaaacatgtacgcaatcgtatcgacgggcggaaagcaatacaaggttgccaacggtgataccatcgacgtcgagaaactcgacgcaaagccgggcgacacagtatcgctggatgtactgatgctcaacgatgacaaaaatatcgttgtcgacaaggacgccctctttggcaagaaggttagcgcaaaggtgctggagcagtttaagggtgagaagaaagtcgtcttcaagttcaagaagcgtaagcgctatcagcgcaagaacggtcatcgtcaacagttgaccaaactccagataacggagattccggcataagtactcgttttattgaaatagttaggtaggtttgacatggctcacaagaaaggtggcggctcctctcgtaatggccgcgattcaggtggtcagcgtctcggtaccaagcgttttggtggccagtatgtaaaggtcggcgaggttattgtccgtcagtgtggtacccacattgtcccgggcgagaatgtgggacgcggcaaggacgatacgctctttgcgctctctgacggcaaagttgagttcacgcagggtctcaagcacaaggtacatgtccgcacggcctagagcctgaggattcgtgtgtcttgattgctgaacaaagcatagttaagcgtatgggcggccatcatgaggtggtcgctttttctatgtatatgggctgatcctaagggttcttctcagagaacctttcagatcggtgcatgttcacctgtgtgattgcatgctttaggtgttattgggggaatggtaatgccagagtttaccgatatagcgcgcatcaatgtacagggcggcaacgggggagccggatgcatgtcattccgtcgcgaagcctatgtgccaaagggagggcctgacggcggtgacggcggctgcggcggggacgtggtcattcaggcggacccacagctctccacgctgatcgcgtaccgttacaagcaccacttcaaagcggagcgtggcacccatggccagggctcgaaaagacacggcaaagacggcaaggacctgatcctcaaggtaccgctagggacggttgtgaccgagctcgaccacgatacccagaagcccctctatcagatcgcggatctgacccatccgggagagtccgtagtcgtcgctccgggcggcatcggaggtcgtggcaacatccactttgtgacttcaatccgccgctctccagccttcgctgagaagggtgagccgagccgggatcactgggtccagcttgagatgaagcttctggcagatgccgcattggtcggtatgccgtcagtcggcaagagttcgctgatcgctcgcatgagcgcggcacgcccgaagatcgcagactatcccttcacgaccctagtgcctaacctcggcgtcgtgaggaccagaaacgatacctcgtatgtggttgcggatgtcccgggactgattgagggggcgagtaaaggtaaaggcctcggccatcagttcctgcgtcacattgagcgctcggcgctgatcctgcacgtggtcgatatgactggcggctatgagcagcgcgatccggtctccgattttcatatcatcaaccaggaattggcggactatacccaagacctggcaacccgtccccagatcgtggtggccaacaagtgcgatatgccgggtaccaaagacaacatcaaaaggctcaaggctgtggccgaagaagtgggctatcccttctttgcggtatccgccgtcactggtcaggggattcagcagctgatcgatgcgaccggtcaggaagtccacgagctcagggcaaagcaggctgagaaggctgcggctgagaagaaggaagagacgccccgacaggactgggagcgctctcgtatctgccgtgaccgtatcatcactgtcacaaagctcgagaagggcacctggaaggtctccggcggtgcagtggagcgtatggtcgtccagaccgattgggacaatgaggaggctgtgtcctacctcgagcaccgttttgagcgcatcggactctttgaacggttggagaaagtcggcgttcaggacggcgacgaggtaaggattctcgactacgccttcacttacacgagcccggagaccgacaaagatctgtatgcggagctccctgactcagacgattcggttgtcgaggagctcaaagagggagcggacgaccgtgaagagtaaaggtgcctttgtcgtaaagattggctcctccacgctcgtcgacagacacggagctccggatcgtccctttatcacagacctctgccagcagcttgtcgcacttaagcgtgatggctggcagccggtacttgtgagctcaggagcggcagcggccggggttgagcgtttggggcttcccaaacgcccgaccgacatcgaaaccctgcaggcgtgctgcgctgctggacaagcgtcacttatggagatctacgctgaggagctctcaaagctccacgtcgcctgtgggcagatcctgatcacccgcaaagatattgtggaccgtaaaagctacctcaatgtcagaaacacaatggagcgtctgctcgagctcggtgtcattccgattgtcaacgagaacgacacggtctcggtctctgagttcaccttcggcgacaacgatatgctcggtgcgatcgttgccacgattgtctacgccaagcgctacgtgatcctctctgacgttgtggggctctacgaccagaatcccgccacgcatcctgaggcgcacttgatcccgcaggtgtcccagatcacccccgagattgcggcgatggccgggggtgcaggctctgcggtcggcaccggaggaatgaaatcaaagctcaaggcggcacgtgtgatgcttgcctgtgggattgagatggtgatctgtgaaggtagacggccgcacgtgctcaccgagatcgcccagggcaaagcgatcggaacccggttcgccaaggatgagccggcaagcaaccatgaacggggcagaaagctctggatcgggttggccggtatcccgcatggcacattgatcgtcgacgcaggcgcgcagaaggcactcaccgaacagggatcctcactgttgccggtcggcgtggtgaagagcgaaggcacctatggaccgggggatatcgtggacatccagtccctggatgggaccctgttggctcgcgggcttgcccgctattcctccgcgcagatggagaagttccgcgctctgcatctcgatgttattgctcgcttcttagatgggcaggaacctgcaccggcggtacaccgcgacgagatgctggtcttctagtggttgcaatcaggactgtatacagacacaatgcagtaggatggagacacaccgagtacgtgagtcgtacacaggggagttgaaaagcagcggatggccgataagcgctacgatttaccgatattgggtacgaatccggaccgtacctaccgactgggcattatgggtgggacctttgacccgatccataatggacacctggttgcggcagagcaggcctatgctgatctggatctggatattgtggtgttcatgacagcagggagacccgcgttcaaacagcacaaaaaggtgacctcaggtgaggaccgctacgcgatgacccttctggcgacctcagacaatccgcacttctacccgagccgctttgagatcgaccgcgcgggcattacctacacttccgatacgctgagactcttgcgtgactactatcccgacaacgtggagatctactttatcaccggcgctgacgcaatcgcagatatcgtcacgtggaaccactccgaagacctggcgaagctcgcgacctttgtcggcgcgacgcggccaggctacaacctggaccgggcgagcagggcaatcgatgactccgggatcgatttcaatgtgatctaccttgaaatccccgcgttggcgatctcctcgagctatctcagatcacgggtggcgaaggggcagtccctccgttatcttacgccggactctgtgaccggctatatccacaaacatcaactgtacggggcgaaggcaggtaagtatgccgactaaaacatgggattttcctgaggtgtcggttgactataccgcatcacagcgcgcagagatagagaaactggagcgcgatatcaaggtccagctcagggcgaagccgcaccggctgcagcacagcctgtccgttgcaaaaactgctgaatacatggctaccctctacggggtggacccctatccggcccgggttgcgggaatcctccacgactgggacaaggccctgacaccgggtgagctgatcgagcgggcgaccgaacagaaggtcgatctaggggtaccccttaccaaggtagtgccgctgctccatgggattgtcgccgagaacgacctgcgggtacgttatcctgagctgacccaagcagagctgcaggcggtcgggcgccacacaatcggagcctccgacatgaccccacttgatatgattatcttcactgctgatggtattgagccctaccggactgcgcatccagatatccagcatattcgtgagatggtggggaaagtaacgcttccggacctctattggacttcctttaccggaggcatcgtctatgtggtgaggaccggccgctatctctacccgggtacagtcacgatttataatgagatgatggaacaaaggaatcaaccatgagtgttacctcaacagaacttgcgaaagtcgccgcgatggcggccgacaagaaaaaggccaccgacattgtgatgcttgaccttcggagcatctccgatgtctgcgactactttgtgatcgccaccgccgccaataggcgtatggcggattcgatcatcgatgagatcgaagagaaggtcagagtcaattgcgacgagaagccctactcgatcgagggccgagagagttcccattggattctgatggactacggctcggtcgtcgtgcacgtcttcgactacgagaccagaaagttttatcgcctcgagcacctctggggagacgcccaacgggtgccgctggacctcgaaggggccgcggatacgaaagcagagtaaaaagaactaatagcgatggtctgatggggaatcagtgtctgattgagaacccaaattgttaaggcggatgtcacgcccataggagagtgcctgtgagccaaagcggcgttggatatcatcggtagctttaaggagccggttgtcccgctcctgttccgctgaatcggctgtgtccagctgcttcccgtcgaggggaagctggagctgccgaggcttgggattgtcaaagcccgagatgccgataccgacaaggcggactggctgtggggagtgccagagctgctctaagagtttttgccctgccgcggcgatggtgtggctgtcgtcggtgggggccgtgagccccatctgagcggtatggatggaaaggtcggaatagcgcagtttgagcgtgaccgtcgtacccttcagattgtccgcgcgcaatcgtctgcccgtatgctctgagacggctttgactgccgagcggaggtcgggaaacgttatgaggtcgcgcggaaaggtgcgctctgaggagatcgatttggcctgccggcgctctgctgccggacggactgggctgtggtctttgccttgagcacggattttaagccgcggacccatcacgcctaataggcgggtcaattcttcggtatccgcctctgcgatatcgccgatggtgcgcatcccgtaggtcgtgagcttctttgcggtggcttttccgatcccgctcatcgcggagattggtaggggagccaaaaacacgcgttcttggccgggttctacagcgcaaaagccgtggggcttatatttttctgaagcgatcttagagatggtcttggtggtggaaaggccgattgagcagctgatgccaagcgcagctacctcatccatcaggcggtggcagatcgcgcggggatcctcattggaatagcggcccggcgtaacgtcgaaataggcctcatcgattgacatctgctccacgagcggcgtctcattcaggatgagtcgcatgacttggtgtgagagtgcgcggtagtggtcgaaatggggtttgacccaaatcgcctgtgggcacagtcgctcagcatatgaagagggcattgcggaatgcacgccgtacctgcgcgcctcataggaggcggtcgagacaaccccacgatctttggccctgccgccaacgatcagcggctttcccctccattcaggatggtccagtatttcgacggaggcgaagaaggcatcaaggtcgaggagtcctatggcgcgtccgtgccattccttattttgagtcatgggtttgggccttagggagacgtacggtgaaggtagtaccgtgatctgcatcactggtgacccctatcgtaccaccgtgtgtctcagcaatcgacttagcgattgtgagccctaactcaaagcctccggtctcctgggcgcgcgccttgtcagaacagtagaactgctcaaagagatggggcagatcctcaggcgggatcggcgtcccttggttgttgacggagcttgaattctcagagcaaaggcgagcttgccttgcgtgaagacacctcaggacatctactggtccttccagcaaagcgtggccacatccggcatcgaggaactcggcccacgctgtgacctgtgggagtgacacgaaacgcgatagttgtcgggggcccccgtcgtggggcaagatgccccttacccacgcgtacggcgttaaggccgcaaggcagcgtagcttgagtcagtttgttcggactaccagccactcccatcgacgacttggtgaggcgacaaataaggggtcagcttaaggcgcaggatgccgcttctacttgcatctgtccgcttctgatagcagacaagcttagatacctgcagatcgacaatggggttgctggccctcagcaatttcagatatgatctcgataagtgagctataatggaaatagggctccggcgcaatggaacaggtagaagcgtggtagatggcctgttgggagtgtgaaacgccaggaatcttcgctccgtatgtgcggcggcgttgaagcaacttagtctctataatgcgcaaataacaggctttctaacaggccggggaatggataaaagcaagaataggggcctgcgcgtaggccccatcctcattacagcgatcacgggaagagctaccgtatggtctcaaggtctcacatcaaggcctcctgcagctagcctctctcaaaggaggcgcaggcaccgattctggctgatcctaattgccccgctggtgccagaatatattgcccaaatcgttaagccctggggtgcctttaaacagcagtcgaagttcccccggttcacggcgcggtagtgtccacttctactcaccgcctcgctcggccgctccatgcgcagctgcccgccaccctctctgagaccagtgctgtctcaggtgggggaggcccccagggagctgcggcgtgggttcttctagcgccctgagcctcctgcaggcgaacctcctggactcgccctcgctgcgcgtcgaggccctgatatacgcgccgcgccccggcgcgccgtcccccagccgttcctgcaatctccctagaccgtgtgactaattccgcccgatctcgcggctatcggcttcacctcccttggccccctccagcaaaaccgtaatgtcctcccgctcggtgatgttaagatagctgtagcgcccatgccgacccctcctcgacgaacgcaaatctgcaagcgccactgtaggtctccatggaccgccgccttaccttttgtccgtttccctagccaatggaattcaaggcctatagtcacagatcgccttacgtccatggcatacataaagctatccggtctgtgacccagcgatagataggtgaaggcagatactggagcgagaggtaatttcatctgcttaggagaagcccgcagccgagctttcttgtatgtggggcactggtgcgctgccaaaatccctcgttgctcagatcgatgccgcagtcatctgccaaagcgtttgtgcgtatttcccacataggctacacaatatttggtagtggcaaacctctgcttgtgtacatctccatgcacccgcagcagcactgcggtgaactgtcatcaagcgtctctttgacagggcagattgtacaagctgatgccacatcccctttcgacctcgttggctgtccccttgtagcccctaatcccttccccttgccctgtccgccggtcagctcccgcatgtggacctcctcatccgtaccttgccgaagtctgccccttttgagaagaactcacagatgaggccgtcagtgttcttaaccggtcggcttctgccaaggtggtgcacctcgcagaaagtagaactgcacgccgtaaagggtctctgttgagcttagcccatgcctttgttcgaactgcttgccccactcggggggattgtcttaagggcggtccagaacaagcctcaacttttcaagacatcggcgctggcgtggtggcattttctcgcaacgagggagcctggacgctctgtggcaagcgcaagcaggcaatacaggccctactgctataagctgtgtcgtctgccagtccgccaaggtgcgagcctacactgcctgcttgggctatcctttaaggctgtgtgagatcctcgcccttgcccttgggtcttaggccctcttctgcgattccgcttcccttcctgctcatatggtggcacttcctgggccgctcgagagtggcggccctgacctgcctgcagaatagtcgagggccaacgacgcagctgacaaccatactcagcctgagattgtcgcctgtctgcttggggaaccacgctcgtcttacaattagcgagcgcaggtctgagcgccttccttttcagcctgtatctgccgtgagcgggcgctgccctccttggggtcgcacaggcgctaagcgtttttgtgcctgggcggtcctggcgatctttgtggcagtacgcgattcctgtccctgcagaatctttatgcgatttctccgatgagctttcccttcttgccaccagctccggctatacagttcctctcctgtgggcatacgagctttggtagtggcacattccttccagctttcgcttgattagacaaccaatgtcgtgcctcagaagtgcgtcacgtcttctgtggagggggctatccgttgcactcgaaatgctaatcacgcctctaagcccatgcctcaaatggagcttctttcgcaaggatcgatcatgtctatcgccttggtgcttttcgtactgtcagcataagggtctcaccgtgtctttacagctacagctttgaaggtaccttagttgacgcaagactcaagtgcaatatagtgcgatgagtcaggatagccgggctatggtggtgcacgggggacagaaatctacctagtaaatatttctggggaggaagcgtggtggaaccgagaattcacagaaagggcaccttgaagcgcgcaggcgaagtcataatatatagcagtgtgtgtaaataaagcggctcacacaactcacaacctatatccggagccgcgcgtctagaggagttttcattggcagttaagattcgccttgctcgtcacggagccaaaaaacatccatactatcgtgttgtcgttgtagacggtcgcgagaagcgcgacggtcgcccccttgaggaagtcggccgctataacccgctgaccaacccgaaaaccattgagctcgacctcgagaaggttgacgcttggatcgctcagggcgcacaaccttcgagtgcggttgcccacctgatcgacattgtccgtaccggtgcaccggcacctgagaagaagcagaggctttccaagagggctcaggctaaggctcagaaggctgcagaggatgcagctgccgccgcagataatgctgacaacgctgagtagctactatggcagaagaaaaaacagaaccgacagagcagaccgctaaggacgaagagcttccttccgacaaggtagccgatctggtcgaatacatcgtgtgcgggctggtcgatgaccaggatgccgtatcgcttgatgtcactgactcggatgagggcaccctgatcgaagtcagctgcgctgaagcggatgcgggccgagtcatcggtcggcggggccgcacgatcaaggctatccgtaccttgtcgcgtgcgctgggccagcgtgtcggaacagatgtcgaagttgaggtgttgggctgacacatgcccgattatcgtgtcatagcgtatatcgtcaaaacgcacggaagaagaggggaggtcgtggcggttcccgtcgacggccttccctcacttattcatacggggctctcgctctgtgtcgtaccgccgcgcctcaaagggccgcggtggcgtaaggttgtggcagttaaacccggggagcacggcgaccagatcaagctctccggtatcgatggcctcggtgattcagaacccctgcgcgggcgctacctgctggctgatgcgaaggacttgcccgaaggcttcgacctgcacgacgcccagcatctgttggggcgccgcgtcaccgatcccgatctgggggatctgggaaccatcaaagagatctacaccggtcctgccaacgatgtctgggtcgtggggactgaggagcatgagtacacgattccggtgattccctcggtggtggctacgatcccacccgaggatcccatcgtcgtgcatgtatcgggaggtacgatcgatacgggggagcaggaataatggaattcgactgcatctccgtaatccctgaagtctttgattcatacattcacgcctccatcctggggcgtgccttagaacgcgatatcttttcgttcaatgcctacaatctgcgcgattggacccatgaccgacaccgcacggtcgacgatgccccccttgggggcaagcagggcatgctgatgaagccggagcctatcttcgaagcggtccgttcagtctctgcgcagggcgaggtcccaccccacgtgatcttcttttcaccctgcggcaaacgttttgaccaagcggcggcggagaagctctcacatgagaggcgggtcctctttgtctgtggacgctacgaggggatggatgagcgctgctatgagctcgccgatgaggtgtactcgatcggtgactatattatgaccggtgctgagctcgcctcactcgtgatgatcgactcggtcgtgcgcctcctgcccggggcgctgggggattcccattccgcccgtgatgagtcctttgagaccgggcttctggagtatgagcaatacacccgcccggcgaacttcgagggccgggaagtgccagagattttgcgctccggaaaccatgaggcgatcgcggcatggcaacatagaaatgcgctcgaacgcactttgaagtggcgcccggatctgttggaaaatgtagaactttctcaggaggatcaagcctatcttgcggagttgaaggaggagcatggcaaagcacatggcgaacggcaataaggcagaggtctcaactgcgcgtgcagtgggcgaatggattgccgtgatcggtatcgccgtcgccgcggcgctcacaatccgggcctttgtagccgagatctatgaggtgccctccggctccatgctcgacacgatccagttaggcgaccgcctgatcggggaaaagctgagctaccacttcaggactccgcaggctggcgaggtcgtcacctttatcgatcccgatgattcctccacgacgctcatcaagcgcgtgatcgctactgccgggcagaccgtcgacctgcgcgatggcgtgctctacatcgatggggtcgcacaggatgagccctacaccgaaggcaaaccgagctaccccttaacacagcactcggcgcgcatcgcagagatccaatatccctatactgttcctgacggatgcatctgggtgatgggggacagccgcaccaattcacttgattcccgctactttggaccggtgagtgtgagttcagtcacctcacatggtctgttcatattctggcccgtacaagacgcgcataggctgtaggggcgtctgaagacaaaggagagatttcaatgagcacagagccgctcacgtttcaagatatgattttgaaacttgaacactattgggctaaccaaggttgcaccgtaatgcagccgtacgactccgaggtgggtgccggtaccttccatactgcaactttgctccgctcgttgggtcccaactcctggagaacctgctatccgcaaccttgccgccgcccgactgacggtcgctacggcgacaacccgaaccgcttacagcactactatcagttccaagtgcttctgaagccctgcccggttgactcacaggatctctacctcggctcacttgccgcgatcggtctggatccggcggaccacgatgtgcgctttgtcgaggatgactgggaatccccgacgcttggcgcttggggattaggctgggaagtctggatggacggtatggaggtcacccaatacacctacttccagcaggtcggtggcattgaggtcaacccggtcccgattgagatcacctacggcctcgagcgcatctgcatgtacgcccagaagaagaactccgtctacgatatcgtctggtcctatctgccggatgggacaccgatgacgtacggggacgtgttccacgagaacgaggtcgagttctcgacttacaactttgaggtcgccgacgtggacatgatgaagaacaagttcgacgactacgagcgcgagtgccactcctgcctcgaccacaagctgccgcttcccgcctacgactgcgtgatgaaatgcagccatgccttcaacctgctcgatgcgcgcggtgctatctcgcagactgggcgcgccaactacatcctcagggtgcgcaatctcacgaaggcgtgctgcgaatcctatctggcgcacgttgcatctgctgacaaacagagtgggaaggtcgcataagtactatggctgaaaccgaggattttctgttggagatcggcactgaagagatgccgagcgccccgttgatgaacgctcaaaaacaactcaagaccctagttgagaaggggctcaggcaggagggcctggcctacggtgaggtctcgaccttctcaaccccacgtcggcttacggtcatggtcaaggacatggcgactgcgaccgaggagatccacgaggtcagacgcggcccgaatgccgccatcgcctttgacaaggacgggaagccgaccaaggcggcccagggcttcgcgcgcaaattccacctgaagccgggggagctcacggtcaaagaggacactgacggcaagacctacgtcttcgcagagaacttcgttccggctcgcagggcgatcggcatcctctccacactttcccacgatacgatcggtgggctcacctggccgaactaccgctcacagcgctggggctccgagaccgagacctttgtgcgcccgatccgctggatctgcgcgttgctcggttctgaggtcgtacccgtcacctatgcgggtgtcacgagtggcaacaccactcagggtcaccgcgtgctagggccgggcgctcacacggtgaaggagccttctgagtacgttgaggtccttaagagagtcggcgtgatgggtgagagagagcgccgccaggtcatcctcgacggtatcaagaaggttgaggcagagcgcaacggcgcccatgtggataccccgaagaaggtcttcgacgaggtcgtcaacctctgcgagtggccgacggttctggtgggcaagttcgatgagaagttcctcaaagtcccccacgagatcatctgcgagtcgatgctcaccaaccagcgctatttcccgatctatgaccgtgacggcaatctgacccgcgagtttgtcgtggtctccaacgccgatccccacgtgaacgagaccgtgatcgaaggtaacgagcgcgtcgtgaccgcacgcctcgacgatgcccagttcttctacgaggaagacctcaagcatccgctcgagtactacgtcccgaagctcaagagcgtcgtcttccaggaaaagctcggcaccatctacgacaagacgaaccgcatggtgaagatcgcgggcgcctgcgctcgggaagacgagatgagcgacgacaagatggggatggcgaagcgtgccgcctatctggccaaggctgacctcgtcacccaggcggttgtcgagttcacgagccagcagggcgtcatgggcggctattatgccaaagctgccggtgagccggacgaggtctgcaccgcgatccgcgagcactaccgtccacggtttgccggcgacgagatcccgtcaagcgcggtcagctgctgtgctgcgatcgcagacaagctcgacacgatcctcggcatgttcgtgatcgatgaaccaccgaccggctcctctgacccgtttgcgattcgccgttccgcgatcggcgtcatccagatgctgcgccagatgcccaaggtgtccctcacaggcctcatcagcaccgggctcgatgcctacgctgagcaggggcttgagtttgacaaggcaaaggttacggagcaggtcaagaagttcttccagggccgcttaaagaccatcgcgaaggacgaggagatcgacccggatgtcatcgacgcggttgccgctgtcgatatcattgacccctcggagttcttggcccgcgccaaggcacttgagtctgcgcgcaacaatgagccagaggtcgtcgaggacgtcgcgaccgcctttaagcgtgcctcacatctggcggaccccaagctcggcgatcaggtggacgaaagcatgctcactgatccggagcgcgctttgcttgacgcctgcgagagcggcgaggcgaaggtcaagacctcgcttgacaaccacgactatgcgggagcgctgagcgtgcttgcggacttgagggaaccgatcgacaccttcttcgacaaggtgctcgtgatggacaaggatgagcaggtcaaggacaaccatctgcgccttctcaacagattctccaatatttttgtggatgtcgccgatatcagctgcctttcacgaacaaagtaagctaccttggccgatttgttttaggatttatagagagaggcaagtaagctctttcaacgtatgctgtacacaacgtaagggggatatgaagcatggatacacttcagctcgattacaaggcgccgaagcccaagatcctggtcatctctgactcactgggtaccaccgcctctgcggtcgttgacgccgccgcggctcagttcgacgatgacgcgattgacgtcgtgagactgacccacgtcaagaacatcgacgaggttgagaagttcctcaacgagcagaaagagggggaccggccgatcgcagtgttccacaccctcggtacggcagcgctgcgccgcgaagtcagagacgcgtgcaaccagcgcgacatcccttcgatcgatctgatggggccggcaatcaccgttatctcaggtctaacggatcaggagccctccgagcaaatcggcgcactgcgcaacaagcagtaaagagtttgaccatgtagacgctcattcaactatttgcaagtactctttggcgaacggttgaatgggtgttcttgtttaaacatttgaactacttgtatataattcataatggatgcggctaattcgaggtttgaactaggcatttcagataggtaaacaagcagagatgcaaaggagtgctatggctgaaaaacatatttaccgctttggcaatgacgccaacggtaacaatgttacggaaaccgccggcaagaccgtagatgaagctaagtggattacaggcggtaaaggtgcaaacctagcagagatggcaaacatcggccttccagtacctccgggattcacgatcagctgccagacctgcgtggcatattccagcgcgggaaatgtgtggcctgacggtgtcctcgacgagatcgacaaatatcgcaaggacctcgaggagcgcatgggcaagaagctcggcgacaagggtgatccgctgctggtctccgtccgttccggtgcaccgttctctatgccgggcatgatggatacggttctgaacctcggcctgaacgacgattctgtgcagggcctcatcaagcagaccaacaacccgcgtttcgcgtgggactcataccgtcgtttcatcacgatgttctctgatgtcgttatgggcgtcgacggccagctctttgaggatgccctcaacaagaagaaggcagagaaaggcgttaagctcgataccgagctcgatgcagacgacctcaagtcgctgatcccgatctacaagcagatcttctccgacaacgttgactccaagaagtatcctgaggttgttgttggtggcaagccagtcttcccgactgatccgtacctgcagcttcgccttgcagagcaggcagtcttcggatcctggaacaccccgcgtgcaatcctgtatcgtcagcagaacaagattccagacgacctgggcaccgcagtcaacgtccaggttatggtcttcggcaataagggtaacacctctgcaaccggcgtcgccttcacccggaacccggctgacggtaccaacgagcgctacggcgactttttggtcaacgcacagggcgaggacgtcgttgcaggcatccgtaacacccagccgatctctgagcttccaaagaccccgggcctcgaagaggcaggcaaagagctctatcacgtgtttgagatcctcgaggatcactacgcggatatgatggacctcgaattcactattgaacagggcaagctttggatgctccagacccgtgtcggcaagcgtaccgcactctccgcgctcaaagtcgctatcgatatgtacaacgagggccgcatctccaaggagactgcagttacccgtgtcgctcctgagcagctcgaccagcttctgcacccgcagtttgaccccaatgcgaaatacgatgtcttcgctaagggcctgaatgcatccccgggcgcagctaccggcggtgttgtcttctcctctgaggacgctgagaagttcaagaaggagggcaagccttccatcctggtccgttgggagaccacccctgatgacctcaagggcatggttgacgcagagggcatcctgacctctcacggcggcaagacctcacacgcagccgttatcgcccgtggtatgggcgctccgtgcgtctgcggcgttgaagcgctgaacatcgatgcgccgaacaggaccgttaccgtctccggcagcgacgtagtcctgcacgagggcgacgttatctccatcgacggctccaccggtgatgttatcctcggtgaggttcctctgatccgtccgcagctcggcggtgacctcaagaccatccttgactgggcagacgagatccgtctgaacccgaagcgcggccgcgtcatgggtgtgcgtgcgaatgctgataacccggcagacgcacagctctccgctgacaacggtgctgagggcatcggccttgaccgtactgagcacatgttcctgggcgaccgtaagcagcttatccagaacttcatcctggctgaggacgacgacgtgaagaaggagtccctgaagaagctgggcgaggctcagaagggtgatttcctgggtatgttcaaggcgatggatggcaagaccgttatcgtccgtctgcttgacccgcctctgcacgagttcctcgacaacccgcgtgacctcgaggttgagatcgccaaggaggaggctgcaggcaaagactgcaccaagaagcgcgagctcctgacgaagctcgactccttccaggaggcaaacccgatgctcggccttcgtggctgccgtctgggccttgtctatcctgagctcaatgatatgcaggtcagagcaatcgtttccgcaaccgctgagctgatccaacagggctatcaccccaagactgagatcatgatcccgctgatcgccttcgaagaggaaatcaagcagatccgcaagcagattgaggacgagatcaagaaggtctctgatgagtacggcgtcgagctcgacattcctatcggcaacatggttgagcttccgcgctgcgcgattatgtctgaggacatcgcgcaccactctgacttcttctccttcggtaccaacgacctgacccagacttgcctgggcttctcccgtgacgatgctgagggcacgttcatgccggtctacttcgatcgtaagatcgtcaagaccaacccgttcgctacgctcgacaagggtgtcgctcagctggttgacatgggcgtcaagggcggccacaagggcaacccgaacatcatctgcggtgtctgcggtgagaccggtggcgatcctgagtccatccaaatgtactacgatctgggcctcgactacgtctcctgctcaccgtaccgtgtgcctatcgcacgtctggcggcagcacaggcgaagatccactccaacggtggccctgtccctgttgagaagagataacggtagcttctaaacaaccgttccggaggcctgtcctaagcgatgggcctccctttttgtgccaaacgtggcttttgtatgaatggctgaacgtgttgcctgagctgctgcatccggttatactaaatacttgtgtgtcaacctatgtgtcgaacgcttgtgcggcggcacctctagagataaggaaatcacaatggattacattcgcgcaattgagcgtcagcagatccgtgaggacatcccacaggtccatgtcggtgacaacgttcaggttcactaccgcattaaggaaggcgaccgtgagcgtgagcaggtctttcagggtgatgttatccgcatgagcggctctggtgcgtgtgagactttcaccgtccgtaaggtcagcttcggcgtcggcgtcgagcgtaccttcccggtgaacagcccgaagatcgcgtcgctgaacatcgtccgtcacggcgatgtcaaccgtgcaaagctctactacctacgtgaccgtgtgggtaaggctgcacgtctgcgtgaacgtcgtcaatagagtttgctggtattgatggggtatagagggtcgcttacaggcggtcctcttttcttatggatcgaagaataggctcacatggtcgagaagagaaataccgcgcacgcgattgtagaacaactccacaaggcttcggtggaggggcttccgaagctgatccagatctatcgctctgataggagaaaacaggtgcaggctgcctgtaagtcggcagagcggcgcttagagcttgaaacgaaggagcgcaaccgcgtccaggagatgtatgacctgcaggtccaaatgggtggcaccggcgtcgtgatcggcgtcgacgaagtagggcgcggagctatagcgggacctctgtatgtcggggctgtagccctcccacaggggccgaaggtctggggtatcaacgattccaagcagctgtccccacaacggcgcgaagagctggcctcacagattgcgggtgtagcaacagcgatcggcttcggtatcgtctccgccgagaagatcgacgagctgggtatggctaaggcgctccgcttcgcaatggcccaagccattaagggctgcaggatagagccagactgtgtgctgatcgacggcaaccctgcacacgtccatcccaaagagaagtgcctcgtgaaaggtgatgcccgggtggcctgtatcgccgccgcttccatcgtggccaaagtgacgcgtgaccactatatggaacaagtctcccaagagtatcctgcctacggatgggatcgctgtaaggggtacggctctgcggaccatatcgcagctattaagcgctatggtctcaccccgtaccaccgggcgaccttctgcacgcattttgtccaagggacgcagtactgagcgcttcgatgtctcggcatacccctgcgtcagattcctgcgattttgggtgtccgatgcagtcagatccctttgatacgctctgttccacagtatccaaccgaaaggattgctatggcagggaaaacagtgcgtgcgaaaaaggccgtaaaggataagcaggcaacgcccaaggacaaaccagtacccaccacaccagaggaggattccgctcaggagcgaaatctcgcctccaaagaggggacggaggcggaagagcctgcaagtgaagaggccgaagagctcaagggtctgactgaggaggaactccgggaaaagggtctcaaagtcaccaaagagtttttgaagcgcagaggtttgcgcgtgatcgatcagaacgtcgagacccaccaaggcaccatcgatgtggtagcggacgataaggatgaacgggtactgatcctcgctcagacagagctggcactgggggatagcaaaacactgccggacctcgccgtgagcgatgaagaataccgacacctgcggcagctgctcttcgcctatctctctgagcactatgcggcaaagatccgtctcgatatgatcgccctgagcatcgtcgggcatcaccgtgcccgcctgcgccacttgatcggcgtgtaccggtggagggatgtggacaacgaaagcatcttctggaagcagcctgacgcagacgcctgcgtcgcagacaacatgcaatagctgtttgagggatctacgaccatggaattcgaacgctttgagctcaacgaaggggataccggctatcccatacagattgcggatggctatgagaagttgccggtgatctatggagtgggaaaccgggagatcctgcagcagccaatgcttgcgatcatcggtgctcgccgggcgacgccctatgggatcgatctggcttatcaggcggggcgtctggcagcgcaggtcggtatcactgtggtatccggtggcgcgatgggctgtgaccacgcagcgagcagaggggcgcttgaagccggtggcacctcggtgatcgtctcgggcatcggtgccgaccttgtctatcccaaaagctctgaggatatcttttcctgggtaccccgagctggaggagcggttatcgcgcttgaatcctggggtcaatacgtccgtcgctacgcttttcccaaacgcaaccggttgatcgcagccttggcgacttcgcttttggttactgaggcggggaagcattcggggacgatgacaacggcggacgcggcgatgcggatggggagaaatatctacgcctatccgggttcggtctattcagccacctcccggggaactaactacctgattgcaaatggggctgagctgatcctcgatgctgcggatcttgccagccgcctctcactggacttcggagtgcacttcaaccaaaacgaagtgaagcttcccaggcgtggggagatcctgtcagcccttgttgccaatccatactcagcccgtgaattagcgagtaagataacgagtacaccgttaacgatcattgatacgctaaccatgtacgaggaagaagggtatatcgtacggatgctggacggtagatacaccgtaaccgcccggggttttcatgcgataggcacaaaggagtagaaaagcatgcagcatgaggtatgtgtggtcggtgcaggtctcgccgggtcggaatgtgccctacagcttgcgaagcgtggtatacacgtaaagctgtatgaggcccggcccaaactgcagactgcggtccaccacacctccctatgtgcggagcttgtctgctccaactcgtttaaagcgacgcggcttgacagcgcctccggcctcctcaagcgtgagcttcagatgatggggtcagagctgatcagacgggcgcaggagcatgccgtgcaggcgggcggtgccctcgcggttgaccgagaaggttttgcccaatcggtgaccgatgaggtgaccacaaaccccaacatcgaattgatccgggaagaagtgaaagagattccggagggacccacggtgatcgcggcaggtccactctgctcagataccctctttgattcccttgcgaagcggctggggaccgaggcgcttgccttctatgatgccgcggcaccgatcgtcgatgctaccacgctcgactacgatgaggttttctcccagacccgctacgatagcacctcaaagggggattacctcaactgtccgatggacaaagaggagtatgaggccttctatacggagctgatcggagctaagcgtgtgatcgcccgggacttcgagcagaaggatctcttcagcgcctgccagccggtagaagaagtcgctcgaaccgggcatgactccctacgttttggggcactcaaaccggtcggcctgaccgatccaagaaccggccatcgtccctgggcggtggtgcagctgcgtgcggagaatgcgcagaagtctgcctacaacttggtgggattccagacgaatctcacctggcctgagcagaagcgtgtcttccgtctgatcccaggacttgagcatgctgacttcttccgatatggggtgatgcaccgcaactcctttgtggattccccgcatgtattggaccaaagtttcgggattccgggaaccgaggtgaggttagccggccaaatcaccgggacagagggctacgttgaagcgatcgcttcggggctctttgccgcactcaatacctatgccgcactcatcggtaccgatcaagtgtgcctgcccaagacgacggcgtttggatcgctggttgcctatgcgactgatcctgggacggtgcagtatcagccgatgcacgttaacttcggccttgtgacgcctcttgcggttcccaaacgcaataaacgtgagcgctatgccgcctactctgagcgcgcgcaagatgatcttgatgcctacatcgtgagtaggcctgacctctttgcagatgcctatgagtgagaacacgctagagactcgcaccgcgcagcaggaggtgttctccaaatatattgaggagtttcttgactacctgcatacggtgcgtaacctgtcgccgcagaccataaaggcttaccgaagtgacctcgaagcctacaagcgctgggttacgcgggaaggtatctgcccgcttgagatcacacatcgacaactccgccactatcttctggagctgacacaggcagggtataccgtcacaacaatcgatcggcacttgagtgcgctgcggaccctgtacagatggctctcgacgacggataaaatcacgaataatgtaaccgatgcgctggaggatccgaaggcacagcgcagactgccccgggttatgaaggacagcgacgtcgacaaactgatcgattcatgtgaggacacgcccgaagggctgcgggaccgtgccttcctcgagttgctctatgccaccggtgcccgtatttcggagacatccgggctcgatgtggaagacctcgatatgaaccaaatgcaggtcaagctgttcggcaaaggctccaaggaacggatcgtcccgttctaccggcaggcgcaggtcgcgctcgagaactatctggagcaggggaggccggcgctacttgtgaaaaagtccaacaataggacgcatgcgctgttcatatcaacacgaggaaaccggatgagtgcggcggcattgaggcggcggttcgaatggcagcttaaagttgccggcatcgatccctcatttacaccccatgctctgcgtcacacctttgccacggagttactttcaggtggtgcggacctcagaagtgtgcaggagctcttgggacatgagtcgcttgccacgacgcagatctatacgcacctttcagttcagcgcctcaaacaggcagtgcatcaggcgcatccgcgcggtgggacggattcatagaccggggcgagattccagtgtccggctcaacgggaactgcatcatggggagctgctgtacagatgaactacgtttgcctaaactagggtttagtgaggcatcatctcctccagctgagtgatgacctcgtaggggaggttgttcagagcccccctcttatgaccaaagcgcctgctctgtgatgggatacaacagcgctcagaagcggatgttccgcttacctgcgcatctctttttctgagatcgtattgcgtttactagaggtgtgaatataatgatgaagctaaaggcagcatgaaccgggatgccgctttaagaccgcagccgagactgtacgttcaagcgctgtaaggacacgcggtgtccgcactgagagcaatgaaggcggcggagcgtgtttccacacatgtttaaggaagctgtgcgggcattggatgccttgagaatctctagcaccgaggcgtttacaaaatctgaatagttgccctccaacagacgctgattcttaagtggatgacgtttatgcatttggaacgtgtcattcccggatacctttcttatattggaagaagatgaaatgaacgtcatttttattgttccggcgccagtctttaagcgcaacccgatctatcggctaggtggcaagctctacggccattccaatcccatcgtcggacccatgatcttgggcgcgatcgccaaacgtgccgggcaccatgtggagtgctaccaggagctgcacggtccggtcgactacagacggctgctcaaggttgcggatatcgtgtgcctctatacgatgactgcaaccgccaagcgcgcctatgagattggcgatatgttccacgagcagggccatgctcgggtgatgatcggcggcatccatgcctctgctatgcctgaggaagctatcaaacacgccgaccaggtgatcgtcggagagggtgagagcgtatttctcgactgtatcgaaggcaggatcagcgatccgatcgtgaaggctaagccggtctgcaatctcgatgagctgccgttcccggattattcgattctcaagaccccgtgcgaatgcgcaaacattgtgactacccgtgggtgcccctattgctgcgccttctgcaccacgagccgcatgttccacccctatcgtgagcgcagcgtcgacgacgttatgaatgaaatccgctacgttcacgatctgggcttcaagtacatgaacttcgaggatgacaacttcactgcgaacaaagagcgcgccaaggagatctgccgccggatgatcgacgagggcctgacctttaaggagaccttcttctttgggcgcaccgatatggcaaacgacgaggagctgctcgatctgctgtcccgcgcacacctgaaccgtgtcctgatcggtatcgagtccctcaaccaggaggcgcttgactccatcaacaagggcaacaaggtcgatgatatccgccgtgcgggagaagcctgtcgccgccacggtatccgcctcatcgcctcgattgtcctcggtatcgatgcggactcccatgcggacatccgccgctcctatgagttcgcccgcgatatcggggcctatcagattcagcccgcgatcctgacgccgctgccgggcaccccggtctacaagggcttggtcgatgaaggccgcatgatcaccgacaactgggatctctttgatatggtcaacgtgacctttcagcccaagaagatgagcccctgggagctgcaagagtgcatgttcgaggcgatcgagtgcgtctacaacctgcgtggcgcaatggatatctggcgtacgtttgggccggagtatggcctgaggcgtatctatctggcctttgtctcacacgcaggtccaatgctcgccgagtgggtggcggacaacgtaccggtctcggtctactacaagctgaagcatacgccctggatgtatgcgaaagaaaatggtgtagaggaaacggtgagtcagccgaaggaacccgagaagcataattgtggtctccttggcccgaatatggtgaagaaccttgcggttatcgtgggtagtgtcttggcggttgccgggttagcaaagctcgggagacgtgcgcctgcataggcaaactgatgtgatgttgcggttttgataaccgattgatcgtacagacactatcgtgtagatcagaaagcccagggcatcgcgccctgggctttctgcaggggggattggattttcaggagtgaactgtatgtgcctagtggccaaaatgctggacagatctatgatcgttttggaacaaatgttctagtatcaactcttatcttcgcatcagtggtggagaggaacctgatataggcgaatgcagcgagtggtcgaggatatgttcggggccgttaaggcttcgaaggttccagccgcgattcgactgcttgaggccggtggcgccggttgcaccaaacggaagaacgcagaagagatgtatctgaagctgaaggacgaagcggccaggtgcaaaacgaaggctgagtaggttgtcttaaatgcgtcgatcaagtggggtacctttacggaaaccgaggatagtgttattgcacataaatcatcctttgcacaatgtgcagatgcgtctgaaccgctagtccttcgagctgggctttatgccgaagaactccctgtctgacagcgtcttcgggacgcgcattgcgcggtccagcaccctggcggccttctccatcttgtcttcggagccattcatcatgacgtggaacagctcgagccagcctgggaggtcgtccctgtcgaatccggaatgcgagttgaggaaggtctccagcaggaagcacaggcggttcacctccctgagcgggttctccttgtcgggcatgcgcgagatctcccttgcgtcgtactcgacgctctcccaagacagcctctcgaccagcaccgaatgggacctctccttgtcgtgggagagtgtggagccttccgcgatgtggcttccgtatgcccctggccctgctcggccgtcggctttcccctgccgcacgggatgaagaccgacctgccctccgcgtcgcagccacgcagagcttgttcctcgagaggccgcgcttcctgctcccgtccgcattgagctgctcgtcggcgcgggctcgcggatagtacttctcgtcgatctcgacgtcgccggacaccacgacatcgtcctggatcccgtccaggacgcagaacagcttcgccatccagtagggcagtgtggtctttggcctgcactcctcccttatcaggccgttcatgctctcgaacgagaaggtctggaccagaaattcgcaccgctcggacacaggcagcctgtgtccctggaatatggtgccgtccatgggtgtgaacgtcctgccgcagccctggcagcgccatctacgggctccgttgccatccgtgtcgcatcctccgatgcgcgccgagccgcagaaggggcagctgtcccgcacgtagccattgaagaaggcgccctcctgcttggcagagagcggcgagtgccggtacctgtacatgctcctgtggctctgcatgacggccatctcggcaggcgtcataggagctgtccgccatgccgtcccagggcgtggcggaaggcgtggcatagcgccgcttctcttcgcttgtggtagcagtcctagctggccgggtgggaggcggcgcctaggactaccacatcgcaagagcgccgccacccgccccgccattctcgcgggtcgatatgtggttagtccgattatagggcgtggagcccagagcccctgtcaggctgcacattctgcaaaggatgatttttgcacatcttggaatttatcgctgtgtctgtccgatgtcgccgaatctcacaaagaacaccgaaactttgtgcgagtgcaccaacggctttgagaagactgtctctagcgatctggtgggaaggccggttgatgtgatgatggtggagagcctcaaccgcggcgacaaggaatgcacgatcaggatcacgctctgagacctggtacagtgagaatttacaataggggagtctgatcctgccctctcagaacctgagcgatgtaaggcgccctgatcagattcatggtgcattcgtgcaggataaaaccctataggcagaaaacaattcctagagtatactgtagtcttgctgtgcatctgcacagcgataactcacacacgtgactactcaaaggcctggtgcctgtgcctcgaagccaagacgcaggtggcgtttggggatgacctcacgtggacgtagaaccaatggaggttttagtatggctgcaaagattaacattcacacgctgctcgaggctggtgtccactacggtcaccagacacgtcgttggaacccgaagatgaaaccgtatatcttcggcgagcgcaatggtgtgtacattcttgacctgaagcagaccattttgggcgcagataaggcatataccttcctgaaggatactgctgccaagaatggcaccatcctgtttgtcggtaccaagaagcaggctcaagaagccatcaagactcaggctgagcgttgcggtatgccgtacatcgcagagcgttggctcggcggtatgctcaccaacttcaccacgatgcgctcccgcatcaaccgcatggagcagcttgaggcaatggttgaagacgggaccatggcaaccctgccgaagaaggagcaggctgtcaacggcaaggagctcgctaagctgcagcgcaacttgggcggtgtccgcaatatgaagagccttccgcaggccctctttgtcgtcgacactcagcgcgaggagctcgcggtgcgtgaggccaaccgtctgcatatccccatcgtcggcttactcgacaccaactgcgatcctgatgttatcgactacggcatccctgccaacgacgacgcgatccgctccatcaacctgatgaccgagatggttgctgacgcgatcctcgcaggctctgggaaagagcagatcaccgctgaggagatggagggtaaggcccccgaggctgatgaggctgaggatcaggctgcagcagcagacaagcctgctgagaaatgaggcttcctcaattccgtttttgtaagcgctatcaaggattgacgactgtgaattcctaaaggaggaatacatggcaacaaagattaccgctgcaatggttaagcagctccgtgagatgaccgattcgccgatgatggagtgcaagaaggcactcactgaggctgatggcgatatgaacagggctgtcgatatccttcgtaaaatgggtgtcgcaaaggctgtcaagcgtgcaggccgtgccaccaacgagggcaacgtcggcatctatatctccgacgacagcaagaccgcaggcatgctcgagctcgcctgtgagaccgactttgtcggtgacaaccccaagttcaccggcttctctgatgatctagccaagatcgttgcagagaacaagccggctgacctcgacgcattgaaggcgctgccgatgaacggccgcaccgtgggcgacgagctcactgagcgtatccacctctttggtgagaacatccagatcggccactttgtgggcaagaccacagataatggcgcatttgccagctatctgcacggcggcggcaagctcggcgtcctcgttgaattctccttcaagaacgcagacaccgcaagcaatgctgacttcaaggtatacgcacacgatgtcgccctgcacgtcgcggcgaccaacccggtaagcgctcgtcgtgaggatatccctgaggagaccctcaaccacgagaaggagatctacaaggcgcaggcaagagagtccggtaagcctgaggtgatccaggagcgtatcgctacgggtcgtctcgagaagttttacaaggagaacgtcctggctgagcaggagttcgtgaaggaccctgataagacagtcggtcagctgaccaaggagatttccaagaaggtcaatgatacggttggaatcgtagcattcgatcgtttcgaaatcggtgactaacatcacgtgttcgagccggtcttcggaccggctcttttttagacgtcggctgtgttgctcggcgaatgagcggcagagaaccggtggctctgatagaatgacaaccgggtacacaaactgtgatgagtggaggcaagcttgcctaagtacaagtacaagagagtgcttctgaagctttcaggcgaggcgctgatgggatcccatgatttcggtatcgaccctgaggtcaccaatcgtctggcagatgaggtaaaaccgctgtgggaagacggggaacagatcgcaatcgtcgtcggtggcggcaatatcttccgcggactcaccggagctgcaagcggcatggaccgtgctcaggcggacaacatgggtatgcttgcgacggtgatcaatgcactgtcactgcaggacacttttgagcaccacgggatggatgtgcgcgtgatgagcgcgttggagatccgtcaggtcgctgaagtctacatccgccgccgtgcaatccgccatctggagaaaggccgcatcgtaattttcgccgccggcactggcaacccctacttcacgaccgatactgccgcagcgctgcgtgcctgcgagatcaatgcggaggtcctgatgaaggccaccaaggtcgatggtatctacgataaggacccggttaagtatcctgatgcaaagaaatatgatcagatcacctatctcgatgtattgaccgagaacctgcaggttatggatgcgacagcgaccgcgttgtgtcacgataataagatgcccatcttggtcttcaacattgatcagaaagacaatattaagagtgccttactcggcaaacacgtaggaacgatcgtcgtggaagaggaaagctgacatgagtgagattactgacaaagcgaagagtcgcatggaaaagtgcctgacggcactgcagaagaacttctcacacgtccgcaccggccgtgcgaacgcccatgtgctcgatggtatcaaggtcgactactacggtcagccgacgccgatcacccagctggcaggcgtcaaagtgccggaggcttccatgctcgtgattgagccgtgggacaagtcatccctcaacgcgattcagcgtgcgatcgagtcctctgacttgggcatcaccccgtccaacgacggtgtcagcatccgtctaccgttcccgacgccgactgaggagcgccgtaaggagcttgtgaaggagtgtcagaagtataccgaggaagcccgtatcgctatccgcaacgtccgtcgcgacgccaacgagaaggcagagcacgacgacgagtattccgaggacgatgttaagcacgagaagaaggcaatccagaagctcaccgacagctatatcaagcgtgccgacgagatgctgaagacgaagtcatccgaaatcatggagatctaggtgcagatagatactgaaaagctcaaagccttctatgcggatgcccctgacgatatttcgctagacaatatcgcgctcgatcgaatgccgcgccatgtctccatcattatggacggcaacggcagatgggcaaaagcgcggggtcttgatagatctgaaggacataaggcgggtgtggcgtcacttagggaaaccgtgacggcctcagtccgtttaggtctcgatgtgctctcggtctacgcgttctccacggagaattggaggcggtcacagtacgaagtcaacatgctgatgcacctcttcgctacaacgcttgtgaaggagctaccgctctttcacgagcacaatgtgcagctcaagttcttgggcgatattgaaaaacttcctatcgagacctacaaggtcttcaagcgaggcttggatgagactgcggaccacaccggcatgatctttgcgttggcagtcaactacggcggcagggctgagattacccgtgcctgcagacgtatcgcgcaggaggtccactctgggaagcttaatcctgaggatatcgacgaggatacgatctccgctgagctctacaccggagggcttccagatcccgatcttctgatcaggacctccggcgagatgcgcctttcaaactatctgctgtggcagttagcctacagtgagttctatgtcaccgatacctattggcctgacttcaataagtgggattttctgcgtgcgatccgtgcttatcagacacggaaccggcgctttggaggcgtagagaatagatgagtgaggcccatgactcgaacagggctgaaaagcatgagagccaaggcattgataagagtatcgacaggctcgagcgtaaacgcgatgcgcgcgagccactgcgtgttgccggccgtctaagaagccagaaggtgcgtgggggagcggagaagttcctgacgcgctccacctcaggcgctatctatgcgatcatcgtcttcatctgcacctttttgggtattgaggcaacggcgatcatgattgcggcgatggcatggctgtgctgctccgaattcttcagaatgtgccgtatggctgggcgtatgccttctgaagtgctgggcttaggtgcggcgatcctctatccgatcggtgtgcttatcaatggttatcagtccctcgtcgtggtgactatcatcctctgtgtctgcgtggcggtctggtacgtgatcaccccacgcgcgagcatcggggatgttgcggtcaccatctttgggccgatctatacctcattcctcttctcttccattgtgttcatccggcgggcggatccgggtattgagggagcgcttctgacctttggcaccatgggctccatctggcttaacgacgccttcgcctatctggtcggatcccgcgtcggccaccacaagatggccccaaggatctctcccaacaaatcctgggaaggtatgtggggcggtatggttggctcgatggttgtctggatcctgatctccgtcctcaatatcatggatgtctcattgccgcttgcgatcatcacggcgctcctgtccggtgccaccggagtgatcggtgacctcttcgaatcccgcatcaagcgtggggtcggggtcaaagattccggtaacattatgcccgggcacggtggtctgcttgaccgttcggactctatgctcttcggagcgacggcggtctacattgttcttttcataggaggaatcgtttgagtaatcacaccacggcagcctccgatacggaccgtttgaacattgcggtattgggctgctccggctctatcgggacccagacgctcgacgttgcccgtcaccattcctctcaggtacagatccttgccctttccgttcatcacaatacgaaaagactggttgaagccgcgcgggagttttcctgctcctatgtggcggtgactgacccggctcactccgacgacagcgtgcttcaagagcttcctcaggaaaccaagctcttagtcggccctgaggccttggtcacgcttgcaaccctgcccgaggttgactgcgtcgtttcggcggtggtcggctttgccggtatcgagtcaaactacgctgcagcaaaagccggaaaacgcttggcttatgccaacaaggaatcgatcgtcgtcggcggcgatctgattatgccgctcttacatcccggtcagctgattccggtggactctgagcactccgcgatcttccagtgcctgcagggggagcagaaggcctccctgtatcgcatctggctcacctgctccggcggccccttcttcgggaaggtcaagcaggagctagagcacgtgacggtgcaggatgccctcgcgcatccgacgtggtccatgggatcaaagattacgatcgactccgcaactttaatgaataaggggcttgaggtgatcgaagcctgccatcttttcgatgtgccagaggataagatcaccgtcttgattcagcgacagagcaggatccattcgatggtggagtttcgcgacggctccatcaaggcacagctcggcgcctccgacatgcgcgcttgcatccgctatgccctaagctatccgaagcgttgggattctcctgaagccgagcgcattgactgggggagcgagccacccatcacttttaacgaacccgatatggagacttttggctgcctgaagttagcgagacaggcctcacgcaccggcaggacgatgccctgtgcgatgaatgcggcgaatgaggttgccaatgcggccttcagacggggagattgcggatttttggatatcgagcgcacctgcgctgcggttatggagcaccatacaatacgtccggttgaaagcgtccaccagcttgaggaggttgacgccgaatctcgggcccaggcccgggagtacctggcgggaaggctctagctatgggtgtgatatctgcaatcttttggggagtcacctccctttcttttcttgtgttcattcatgagggcggacactatctctctgcgcgcctcaccggtatgcgcgtcactgagttctatctgggtttgccctgcagtatcaagtggttccacaaatcgaagcgctacggcaccgagatcggcgttacaccgatcctgctgggcggctatacccgtatctgcgggatggaaggtactgacgaccctcggcttgcaccagtgctggcctatatacagcagcagggacgtgtatcgatcgaagaggtggaaaagcagttcaactgctccgaagatgatgcctgcacgatgcttgcgaccttggccgactgggcggccatcgaggaatactggaagcccgagcgcagcaacagatatcgccggaagtacatgcccgacggctaccagacggtcaagcgcgatgcacatctgctgaccgaattcgatcgggagagtgatttcacctcgagtgaaggtgtcaccgttgcgggagagccccgtgacctcgggatgtcacctgaggaattcctgcagcacgagaaaaagcatacctatgggggacacggcttttggagccgcatcattacgctctttatgggccccctgatcaatcttcttttcgccttcctgattgtcgtgctggctctgacgcttgcaggtgtcgacgttgcagccaataagaacgtaatcggtgcagtctctgaggactcccttgcgcaggcttctggactggaagccggcgatacggtggagtcgatcaacggggagaccgtgactgactggcagagcctgacccaggcgctgcagcccgcgcttcaagcgcaccaagatttcgaaatggtcattgagcgaggtgggcaggagcagacgatcgaagttcggcctgacccggacggttcccaaaccctgctcggaatcagtgctcccacggagcatctgaatatcgatatcggacatgcctgcttggtgtcgctctcctatgcacagcaggtggcgcaggctgcagtctcgctcatcatcccgacacacaccacggaggtgctcaatcagtcgacttcgatcatggggatctcggtcatggcatcagaggcggcctcgggaggagtatgggagttctccctctttgtggcggcaatttcgatgtcgctcggcttcatgaacctgctgccgattccccctctggacggagggaagatcttgattgagattatccaggcgatcatccgccggccgctctctcagaaagtacaggtgggtatctcctatatcggtcttgccttctttatctttatcttcatctttgtaacgagaaacgatatagcacgattcgtggtggggcagtagtggcagaacaacaggcagcgcgtgagcgcacgcatcaggtacatgtggggtcggtcgccgtgggagggggtgccccggtcagcgtacagtcaatgtgcacgactccgacgagcgatcctgcggcaacgctcaagcagatcaatgagcttaaggatgcgggctgtgagattattcgtgtggcaatccccaacaaggcggcgctggacggctttcaggccatctgcgagggctcaccgctcccggtgatcgcggacatccacttcgactatcagctcgcgcttgaagccgccaaacggggtgccgctgccttccgccttaacccgggcaatatcggttcatgggagaaggtcgatgcctgtatcgacgctgccggggaggccggaattccgatccgtatcggtgtcaacgccggctccttggataagcggtacgacgagcggcaggacattacccttacggacaaactggtcgcctcgtcgctctcctttgttgatcacttcagccagcgcggctttgacgatatcgtactctccgcaaaggtgcacgacgtgccggagaccttggagacctaccgtagactctcaaaggagctgccgcaagtgccgttgcacatcggcgtgactgaggcgggtacactgctgcagggtactgtgaaaaattccgtggctgtgggcatcctgctcgaggggggcatcggcgacacgatcagactctcgcttaccgctgacccggtcgaggaagtcaaggcagcctgggagctgctctcagcgctcagaatgcgccggctgcatccggagctggtgagctgtcctacctgtggacgctgccaggtgaacctgattgagattgctaacgaagtggagcggcgcctgcagagcatcaaggtgccaatcactgtagcagtgatgggctgcgtcgtgaacggccccggtgaagcgaaggatgctgacatcgggatcgcctccggcaagggcggagggattctttttgctcaagggaagccaatctgcaaggttgccgaatccgatatggtcgaggcactgtttgacgagatcaataaacggtttcctgaagctgaatagggactgatttcagctataacggaatatgtgtggcatgaacaagaattgagaggacatatattgtggcaagatacaagcgcatgagtaaactgtatgcgccgatgctcaaagaggatccggatgaggcagtgctcgcaagccataaactattgttgcgtgccggcatgatccgccgaggcgctgtcggcctctacagctatctcccactggcttggagatcgatcatgaagatcgagaatatcatccgggacgagatggcaaagatcgactgccaggagatgatgacaccgatcctgaccgatgcagagctctggaagaagagcggccgctggaatgcctacggtcctgagctgatgtgcctcaaagaccgctacggtcacgaatatgcgcttggcccaacccacgaggagacctacaccgatctggtcaccaacgagctcaagagctacaagcagctgcctgtgatgctctaccacattcaggataagttccgcgacgagcgcagaccccgcttcggtctgatgcgcagtcgtgagttcattatgaaggatgcctacagcttctctgccaatgaggagtcgatgcgtgagtgctatcagctgcagaaggatgcctacgcgagcttctgcaggcgagtcggtctcaaggcggtcacggttgttgcagactccggtcagattggcggtgacacctccgtggagttcatggcagtcgcagacgccggcgaggcagagatctgctactgcgacgcgtgcggctatgcggccgatactgaagccggtaccggcactatcagggtcatcagcgacggcgagggtgatctcgagaaggtcgagaccccggattgcggcacgatcgaaaagcttgcggagtttctgggcgtccccaccaatgcgacgatgaaggcgttggcgctcgtggcagaggacgggcagccctatgtcctgtttgtgccgggtgaccaccatctcaacgatgtaaaggcgagccacgtcttcggtaactattacatgatgagcgatgaggagatcaagcagtatggccttgtgaagggctttatcggaccggtcgatatctccgataaggttaaggtctatgcagacgagtcacttaagaaagcaaagtactggatctgcggcggcaatgaggctggctatcacttcagacatgccaaacaggggagagatttcacgatcgacaactgggcggatctggtctcggtcaacgagggtgacctctgcccgaagtgtggcaagcctttgaagatcaaccgcggcatcgaggtcggtcaggtcttccagcttggcaccaagtattctgagcccatgggtgcgacctttaccgacgaggatggtaaagagaagccgttccagatgggctgctacggcatcggcgtcggcagaaccctgcaggcgatcgtggagcagagccacgacgagcacggtatcatttggccggtcagtgtggcgccctacgaggtcgaagttatcccgctcgatgttaaacaaggccccgtgtgggatgctgcagagaagatcgccagtgagttggctgagagggatatcgacgtcctgttggacgatagaaaagaacgcccgggtgtcaagttcaatgaggctgacctcattggcttcccgtatcagattgtctgcggcaagcgcggcatcaagaatggtaccgtggagctcaagcatcgcgccaccggtgagcgcaaagatgtcacgctcgacgagatcgtggacacggttgttctgccgatcgaacagcaacgcacctagagccacttcgatcaaacagaacagaggctgcggttcgatatgaaccgcagcctctgttgatatctggacgaaaagtgatggactatttgaggtatgcctgatagaccttattggcaacgaccagggtgatgatgctcagtactgtgactaccgcgcctagcacacaggcaagcgtcgaaggttgcgcttccaggtgtgcaacagtggaaaggataatcgctaaaattcccaagatgagctcaacgataaagaaatggctggcagtgtttgccatcgacggagtattggcacccttggctcctctcagggaggaaataacggtaaagatacctaagatcagtacgctgaccccatagatggggtgagcgcttacaaagagcgggatggagataacaataagggcgaggccgaaaaagagcccgatcaggctcaatacctttaatgtcttctgtgtttgagacatgagtcatatcctttctgaaagccaggtggacattgttaatttgtaccctaaaacccgatcagcaaagattacctttgtccatatcatgtaacccgcttaaatatcatagacggaaacggtagggaagaacttttgtaacagcttcagaggtgctaaacggtgaagaatatgtcccttagtttcgcatgtactcgtacaattgaagatactttgcccgatgcattgggggtttcaccatatttctgacataggttgcgaaaatgcttgacgcaaattcttattctggtatatttaatcccgctccgcatggggaattagctcagttgggagagcgcatgactggcagtcatgaggtcaggggttcgaatcccctattctccaccatatggtttgaacgataggatctccgggattaacccagaggtcctgttttctgatatattttccctttgttcgttatcctagtctagttggacaacacggcaatatgaaatgtacactcctggggtgatacccttctaattgtcaagtcgttttgagcatgcggttctgggcaatgatgtcgtagtacagctcgcgcgctatgtatcgcttgacacatcgtatcgcctcgagcttggagtgccccttagacatcttgcgggcgatgtctgtgtggatcctctcgtctatcctcagccttcctggcgcaacgatgtgtatcgcgctgttcgctgccctgccagcgcccctgttgagcctgtggcgcgtcgtgagccccgacgacgcaggacgcgctgccaccccgcacagcaacgactcgctgcttgagcctccccggattgtcccctactctgatcatcagctggacagcgccctgcgagctgacacacttctcctcgagcaggagtggcgccacctcctcgaggatggccccgatggccacgtcgaggtcctggtagcgaccggcgagtgacttgagcgcgatgtgagtggctgttaaagtcaaccccaggcttaccgatttgggcaatatatctgcaccagccggggcaatggaatcagccagaatcggtgcctgcgccctcctttgagagaggctggctgcaggcaggtccttgatcctgtaggagcttcccgtgatgcgtatgagatggcagcggtagtatagcctgtcggctatagctaaggctataggcgcattgccgaagacgtcggcccacatgctatccccacgctcaccgacgcaccgtcgagcccctcttatagcttatcgagacaatctggaagatgaggccagcgcccccattgtcgatctgcaggtatctaagctcgtctgctatcagaagcgacaggtgtaagtagaagcgcatcctgcacttaagctgaccccttatctgtcgcccccacaaggtcttcgatggagatgctggtagccgacagggacaaagatgtcagggagctgctcgcaggtatatttgatgcgaatagaagaccctacggcaggctctacatacgcgataagatagcagccgatcttaaagatcaacatggtagtcggcaagcacaggatatctcacatccttaaaagaggagggcaaggtggccttaagcttaaggaagaacaagtcttgcaacttctgtgcaggcaagatatcagacaaccctgacagttttgtgaagcaagacttcagagcaggcctgcccaacttccttgtggctcactagcatcttgcagtttgagatacccgccgacaagccctactttaagctttatccttaaactgtcgtaacgcctgccaaccgcagatggcaaacttagtgctatgtgctgctatcaccgcgataagcaaaggtaagcgaaaagtatctcgcaacccagcagcgacgaagggcgccactgctgctggccagagtggatatagatcttttccgaggcgggtatcaccacatcgatgccacctaagggctgcccttgccacaaccagaagggttaaggccttcttcgaagtgttcaagacaaagatgttttgcaagtgcaagtgggacggcaccgcttagacgagtttgaaaggagcgcatcgatcactgtatcgtcaggtacaacacgacaaggcgcaagcgctcgcttaaagttgtgagcccaatggagttcaggaaggctttgggcttggccctggcagcttagggaaacgatgattaatgccccatgccggccgcgaaaggccgtgtggccggtcttcactggtacatcattgggcattaatcatcgttttcttaggattatcgatggaaatggcactgaaaaccgacactacactcaaatgtgtcagtaactcagagcatcacttgtggatgtaggtagcatccctttcattgtccttgactgtgacatagcgcttaacctgcatgtggaggtcgtacttatctctcagctctgcgatcttctccatcattggtgaattatggtgctcatcgagagccttctgatccttccactggtcgatcagaagtacagtgtcagggttacgcatggagaggaagtagttgtagctctcgttgccccgctcattgcggatgtcgttggcgatgccggactgctccatctcctttgcgaaggcgcgggcactgccgttgctaccggtgtagtaaatgttgatcgtgagactcattgtttcccctttttgcagcctcaagaaagaacttctacggttgatgttgttgtaccgcatttatcggggcttatttatcagctatgaacttctctatgctttcatcagagcgttgtaacacaacagtaataaccgaattattgataattttggttcaatcctaaaagctatgggcagatgcctgcggtatagcatctgtacagacagggaagcggccatcctctagaatcttgcatcgcaacatgtagactccgaaggaggatggaccgcgatgacaagtgtagcatccacggcagcccagctgtccgtcatttcccatgctagcaggattgccgcccccggcttcctttcgatcccctcgcatctcgaaggatttgtgcagacgggaaagcctaaggagagcgcacgcacggaggagttcggcacatcgggcaggagatgcaggaaggcggtgcagatcctcactgtcccgggcagactggcagcgaaggatgcaccttcatgcccctgctacggaaggatgatggagaaaaacgggaaggcccccattgcgcttcggcacctcctgttcgagatgggaagggcaaggatagaggtcttgcggccaagatgggcatgcagggagtgcgggggcaccctcacggaagaggtgcccctcagggctcccggccagcgcatcacactgccgccgctcgccttcgcgcaggacctccttgccctggggcagaccctcaaggcggtatcgctcacggcagggctccacaagaatgtggtcaaggccatcgaccgggcaaggctttctggactctacacggagggggaaggcagcgaaaggacgctccggaagccggagcggcaggcccgctatctgggcgcagatacgttcaagctgcacaatggccgccggtgcgccaccgtgatcatcgaccttaagacgggccatgtgctgtggcttatgcattccaagaggaagcaggtcgtatacgacttctgcgacttcgtgctcgctgagtggatgtttgcatgtggaggccatagcctgcgacatgaacgcagactttgggcgcgcattccttaagaggttcccgcacctggacatcgtctacgagtacttccacctgatcaagaacttcaacgagaaggtgatctgtaaggtcaggaaggataagcaggcaagacttaaggaggagggagacagcgaggctgccagggccctcaagcactccacatacatccttatgtcctgtgcggacaccagggagaggaaggagcgcgatgcacgtgccggcaaggtcgtctccaggggaagcgccctttgcggcaagcaggaggttgtgcagaggggaggcgccaggaagcgctataaggacctcatatcccaaaacgagctgcttgctacctgcgacatcgcagatgagatgctcgccagggcatatggctacaggcaggagaagcacatgcgcgctgccatggagaggatcgtggacacctgccgcggcacgaaagacaggcacttcgcctgggttgcctgcctcgtcgaaggacacatggaagggattgccgcccatgcgtgtcaccacatcagcagcggcagggtggaaggtaccaaccagatgatcaagacgctcaggagggcaggctagggataccccgacgacgaatacttcttcctcaagatattcgattaccagcaggcgctactcgaaggcttccagggctggtgcgtgatggggctgcacacaggttttaggtctgagccaacattgttatgttcaatacaccttcacggggtagcgctatcgacgcaggcaaaaggaaatggcgtcgtagtagttcaagggagtggatcccggagccggtagggaacagttcgctgatttttagtgagtaccgcttggttcactattggttcaaaattcaaattatatagactgaataccatttatggatcggtgaacggtatctgatacctcgctgaggtcacacggaatgctctgtatcaatctttcacgattagcccagctaccttggaaaacagtgaaaaattaagcagtattcatatagctctgcgccctatggcgaggccgttcactttttgacattcaatacttacaagcatagagtagataacacagataatgaggtagctaataattagtaagctatccaatagtatgccgaaaggagcacccaatgaaacagacgtttacagcgaccgcgaagaaaaccaataccggcttacaggttgagtcaggcactcggggattcaagatcctgatggatgagcccaaggaacttggtgggaccaataccggtatgaatccggttgaggcgctcctgtgcgcgttaggctcttgccagtccattgtcgcattctcctttgcccaggcgaatggcattaacttgcaaggcttctccgtgaagctggaaggcgatatggactcagatgtccgcaatggatacaccgagatccgctattcgatgcactttaagtcgaatgcgagtcaggagaagctggaagatttcgctcactttatcgaatcgagatgcccggtgggagattgcctgaaggatggtgtccctctgaagctcaccaagattgttgccgagtaacaggcgattttgaatggagctgttcttgagagcagctccatttttgagaggataaccctgacatggttgaaatcaaaaccccgatgcttcccagcaataaacccctcattgtcggcaaaattgacgtacgcgtcggtgatcatgtggaacaaggccaggttatctgccaaatagagacggcaaagggtaaccatcaaataaaggcgaccgaggctggcactatcgcagagatcctggtcgaagagggtcgagaagtggtggcaaatgacgtgctgatggtgatcgacgaacagggtaagatccaaccagaacagcagagtgaaagcaacaaagagattcttactacagttcccactgacacagtacagcatcaccttgagaaagatcttctcgttatcggcgccggtcctggcggctatgtcgcggcaatctatgcaagcaagcggggcatggatgtggcaatcgccgaacgaaaaaagctcggcggcacctgtctgaacattggctgcatccccacgaaatcgatggttcaatctgcccacctctttgaattgctgaatgagatggatctctttgggatcgaaggggacttccacgcctccatcaatatggaaaaggtcctgcagcgtaaagatgaggttgtcgataccctagtttccggcatcgagtacctgctcaacaagaacaaggtaacagtgctccagggtacagcccacttcctcagcgatacggaagtgcaggttggctcaaccatcatcaaggcgaagaatatcattatcgccaccggctctgtggccgcctcgttgcgggtagagggctgcgatctgccgggtgtgatcgattcaacggccgccttggacctgcatgaggtgccagattccctcgttgttatcggcggtggagtcatcggcttagagttcgcctttatctacaacacctttggctcgaaggtacatgtcgtcgagttccagaagagcctgcttccgatgctcgacgcggatgctggaaaattcattgagggtatctgcaaagagaagcacattcagacgagtacatcgagcaaggttatcagcatcaagcagacggttgagggcgagtacattgtcacctacgaaaaggacggcacaacctcctataccatcgcagataaggtgttgatgtcaacgggcagaagggcgaacaccaacggactcgggcttgagcatacctctatcaagaccaataagcggaccggcgagattctcgtcgatgagtacgagcagaccaacgtacctcacatctatgcgatcggcgatgtctcctccaaggtcaagcttgcccatctcgcttcacagcaggggtgcgtggcggtcgatcatatgctggtggagaagcatcctattagtgatactaatgtaccgtctgtcgtatataccaaccctgagatcgcgacggtcggatataccgaacaagcgctcaaggagcagggtataccatacaaagtctcgagatttgatttcagcgcaaatggtagggcgctcacaatgaatcagaccgagggattcgtgaagctgctggcttctgaggacgggacacttctgggggcggttatctgcggccccgatgcttcaagcttgattgccggtgtgactgtggcgatgacaaacggtgtgacggtcgagcagctcacgcagactatctttgcgcatcccacgacctctgaggcaattcgcgaggcggcgttggcgctgatcggcagagggatacaccagtaatggatgccaaaatcattgatcttgcttccactgatccctatgctaatatcgcccgtgaatacagctactacgagaattttaatccggatgagatggtcttcctgctctggcagaatgaaccctgtgcggtgatggggagaaaccaaaatatttaccgcgagcttaatctgaagtatatgtacgaacacaacatcctaccagtgaggagatttaccgggggaggttgtgtgtaccacgacctgggcaacctcaacttcacctttattgcgagccaaaagaataagcgcttggatacttgggtggacatcatcctatctgctttgaggcgtgagggcatcgaagcagaggtacagggccgcaacgatatactcgtccacggcaaaaaggtttcgggtatggcctggcttgaggatgaggagcgctttctcattcacgggacactgatggtggatctggatctcttgcagttttcaaagtgcctgactcctgatatcagcaagtttgtggggaaaggcattaagtcggtgaggagccgcgtcacgaatcttaacgaggtgaatccttcgatcacgattgcaggcttaaaacggagtcttattgactcatttcaagaatcctatcctgaggcaaagatgacggagcatgtggaatatccagacgaagtggatattgagcggatgatcagaagcagcgcatggattgtgggaaaaagggaaaaggcacaggtacagcgttcaataacccttgaagggaaaccgttgcagcttgctatctctattgatgccgatactatttcagacattacaatttacactgatagtctggatctcaagcgtgtcgaaactctaagggcaaatctgatcggtaagaactataccgatttgctcaagaggaacctcctataactgctacgactcgagagaaggggaacctcctataactgctacgactcgagagaaggaaaagctgtcgactgtactatcaacttgaacacctaaggggaaaagtccagctgaacctgtctgatagcatgcgagtcaccacacgacaacaatctatctaaggtagcagatagactgcccacattctaccattgaggcgcagcagaagctctacatttgaaaagcgggtcacactacagagctgcctggaaggatggctttgctgagaagtatctgcctgagagctcagttagcctgtatgctccatcagctacgtggcagggtcgagctctgccacggctaaggcagtgcgccacagagccaaacaagggcagggcatctgtaaggaaagacgcaagagctgttgtcacagaacagaatcttctgaagagctcttagctcacacactgtgtagagggctacctcttcgaaggtggcttgtcacctgaggcgtgctgcaaccgctcaggagctgcagggggagtttgtgtagaaggacactttatacctacactgaccaaagcttgctgggtatccacaactatagcctgcctgaaaagcttaaaagcgcaggtcacctgtccaccagaacaaagaagagctcgccacaagcttgaaaagcgcccctaaagacacaatgtgcacgcctgaggttaggcacaaggggtacgatttggtcttgaggcacaagaccaaaggcgataaggcacacctaaccttgtctgagtgtttgagccgtgagtgtctcatccatccctgtcctggatacaacagctgccaagcaccatgcaggctttcagaaagctacagggccactgcagcaagcatagcgacactatctttcaaaaccatcacagctgacaggggctcctgagtctgtagactcttacagctgaaggacatctcaatctaaccatcaagtatatgagggctgatgcaagcctgccagatagcccaggtgatacaactttccataccaaagggagctgtgccctggagcctactgggctctgtgtttggtgacaacctcttaggctagccttcaaagagaagtggaaccgtcaggatccatggtatgggaaagtcccttctacaccctcagtgccaaaggctgaagatgccaagatctgccggcctaagaaggccacagctgagtgttgctgctgtaagcacataggctttgctaccttcgctaagctaagtgccaagatgggagtgccttgactgcaggcacaggtacagctcgcttacagggacagtctttaagcacaccaggcacacaccctgccgaagtgggtatcacccatcaggctcatgcgctacagtgtgccccttaactgcataggcgaagcgctcagatattgcatggcgaatccacacttcgagtacaacatggaaatacgagctaaccatccaggcacgacctatgatgatgcttgcgaagacatataccattggaggcaccatggacgactacagctatcttagcattacaaagcgcaaggacatcatggtttgctagaagggccatgaggggccagccagatagtagggaagctcggccacaacaagtcgaccatatcccacaagatcaggcaataacggctgggaaggccctgcaaggcgtcgctgctgtgcatcgatgaaggatgcactgcaggcaccccaggatcacaaacgatctagaaaggcactttctggtcgtggggcacatgctggcgagcactggttgctggaggagatagcgggccgcatcggcatcgcgatgcagtgcccggaccttgccgtaagcgacaccaccatctagtacgccgtggagtcaaggctgctggactgcgagctttcagggcgcagaaaggccgcaaggctgcttgggcaccacggcaagcgcaggcacagcaaaggcagccaaaagcgcaggagcaaggtacacatcacccacgacatctcgaagcgcccgaaggaagcctccctaaggagccggattggagagtgggaaggcgacagtgtggctggcaggcgggcgtatgccttatcactcaggtggagcgcctgcctaagcggataccttgttggtggcaaggccttagagagcgaagccacgcaaaagtcgctctttggtaagagtgtacatatggtcacattcgacaggggcaaggagttctcggatgcagaaggcctccaggaggcactaggggcgaccgtgtacttctgccgtccttaccatccctgggagagagaccaatgagaacaccaacaggcttctcaggaactgatttccgaagggcaaaagtctcgacgatgtcgccgatagaaaggtgcagaaggtatacgatttactcaactgaagaccctgcaagcgcctgggttggaagtgtctctgggaggtctaccatcgccagtcgttgcacttgctttgaggatgcacccacacaaaaaagacttcactgaccgaatgaccacagattaaaaatacgggtagttaatgacgcggtattctgctagaataactaacgcactgagggcgattggctcaggggtagagcacttccttcacacggaaggggtcgctggttcgaatccaacatcgcccaccattgcaaatttaaagaccagtgcttttgtaagtgctggccttttgcttatgttaagggcccatggcgcaatggttagcgcaggggactcataatccctgggttgggggttcgaatccctctgggcccaccatttattttggctcttcggtaatctcgctgttagaccataattgacctgacgcccctgtccttccaatagctccagaagggctgctctatgtctatgagcgcacgcctgctatggaacatacctgcctcctgcaagcttgcctgagagtatatccttcttctcccgctcagaatgccttacctgctctatccacaaaaagcaggcaagacaagtgccccagccacttcgtagaagaccccatgggaaaaagcaggaactcgcgcagccttcgctgcatcgcattgacgaggctaagctcgccgtgcacggccttcttcgccacgctcgctgtgtgcttgaagaccccaagcgaggagagccacgcgcgcatatcctgcatggtcgtcggtagcgacccaggggctgtcgacgatacctgaaagggcatctgtcagcttcccgtccgtgggcctgtccctgccacagaggacgacatattcgtcgcctaggtcatttgcgcagcactccacgcagaccttcttgttcgatatgccacagcaatgcactacatggccgtgcgtgtgcgcctttctcagcatctggatgttgggccttgccctgttgcctgtaagcgactcgtcgagatagatcccgatcttttggcaggagacggtgggtccatacctgaaggtgccaagcgctgcctgcatcagctcgaagagcctcattctcatgaaccacggtgtccttaaggctcacatggcagctgtcggcaagctcccttaagggacatgcctgcaagcgtgccctttgcatatgcggcccatgtggcggcagtgagctttaacatcgcgagcacggatctggtcctggcggagaaggtcttgcctcacgagcaacacttccatctcttaaggccacacgcgtcgtggcccttgcaatagaagctgagcgatttgcacctcgggcacctcttgggtgttcccgcaagggcagagcctgccatcttcttggctatgagcgccttcagtctctctaagagctcacgcttctcggcgatccccatcttttcgatctgctgcagtatcattgaatccatccgggccctttgatcctcgatgtttttgtttgatgatatgcattgtaggcaaaggcctggacacttttgggcccttctcaggtcaattatggtctaacagcgagatttccaaagccaaatgcatgttccggccaattctgtctctaacaccatcagagataggcatctgcgatactctgagcattcgaacgaaatagcgcctctgtctcatccgtctccacatacatatccgtgttcatcgcatcggcataggcctgttcctcaagcttcgatgcagtcttcgcatatgccttctcatatgcttcatccctggcagactggctctgcgaattaaatggtgcagcttccgatgtctcataaggcgattcggggaagccagcgtttacgatattgagatcaaggctcaggctgccatccgtatcttgaagtggtagcacgctataggccgtaggtgcaaacataaacctgcacccagaaagatcgcttgcgccgtccgatggcaggcagcaaaggaacacgaggtactgacgtccagcactggtaggcgtgagatagcccgtataggggcttcgtgtcgagctcgcgccaatctgaagtccgcttccgccatcgctctgtccatccttgctgacagcaaattcctgatagacggcaatcttatcccctgggttgagctgcacctcaggaagcgcaaaggtagtgccatcagcaagaaggcgagactccttcccaagaccgatgattacgcggtctatcctatagctgctcacaaaagcccggtatccataatgcgactcatccgtcgccgtcacaatcaggattgcatcggcatactcacctggattagccagctgtagtccgagggccacagacttctgcgcaggagtgagagctgcatctccatcagactcataacgttctctccatgcttgctcaacctcgtccgcatctgacagagccgcgtatctttttggcagatagtgtgtctcataggcagctgacggaagcctgtctgcatcctttccatcgatatcggtaaggctcatcctgaacagaaccgttatgacagcaatgaatgccgcagcggcagcgattgcgacaggagccagatacctatgctcatgtctgcgatgcatcttcattgctgctccttcccgacaatccttccgtcttgcagatggacatgaaggtcaaacaggccttcaagctgtggctggttgtggcaggaaacgagcagcgtcacgcctgacgcatgcatcttccggacaatgtcgctcaccagctttatcccatccgtatcaagcgcattggtaggctcatccatgatcaggagctctggctcttccatgatggcttgcgcgagattgagcctctgcttcatgccgaggctgtattcagataccggacgctcatcatcggcgtccagtccgactagctcgagagtccttgcaatctcctcagggcctatcagcttcctgatactggcaagaatctcgagattgtctttccccgaacggtattcccagaaccctgtgccatcagccatgtagccaagacgcacagggtaggctttcatgcggtccagcagcttgccaccgacaagtatctgtccttcattgatgcggacaagtccggcaacagctcggaacagcatcgatttgcccgatccgttgacgccggtgaagccagcgactgagccatcgggaatctcgaggtctatatcgtccagcacagcccgtctatgtatcttcttcgtgacatgttcaatctttacatcagccatggcactccaatcagacctctacgcgttgacggaacagcaggaacacggcggtagcagcgagaaaccagatgctcagggccaggagggccaaaagcaatgcggcggggttcatctctaagcctgcaataagggccgtcgcgctgaagctccagcccgcaggaatcaatctgcagaggagcgaatcgcttggcagcgacgcgacagccatgcaggatacgatatagaggatgacggcaaagccggaagcggaacggctctggttatcccttgcaaggagcgagcctatcatgctgtatacagctgcggacatgcatgacagcaatgccgagaaagcgatgaaggctatgaatgagccgtcatcaaggcgccatcccagcaggaatcctgccaagagctctgacaggctgctgaggccagcaatgagcatttcagcaataagaagactcgcagtaccctgcaccagcatgccgcggggattcttcatgcggaatctgatgagagggccatggcgaaaagaaggatctgtcgccacatctgacagcaagaagatgttgagagcagctggtgctatgctgccgaactgccagagaattgcattgccttgctctcttgcctcgataacgcttgctccggccaaaatctcagtcatcaggtattccgatgaacttgcgagaggagcgagcgcacacaggagtgctacgccggcacagatcatgcagcgtattgtctggctcttttcaaggatgggatagcctatcatctgtatccgccccctgatggcacgtcgcacaatcccgccatcaatctgatagatgcgaagattgcaatgcagatgaacatctggcgcaggagcacagccagggcatctccgatgccattctgcatgtcctggactatcatccatccaaagtgcagcatatcgattgatcgcagcggcgatgcgccgagaaaatagccgaagaagccataacctagaacagcgagcaccgcagctctctcgccagctgcaatgcacaccgtgacaagcagcaacgcgcagctgacaaaatatgagcagaccgccaatatccagagaagccagaacaggccatatgccgcaccaatgcacccaagcaaagtcgcatccagagccaatcccaccgagacagtaaatcctgccgcaagcgccagaagaagacagtcctgcagcgtgcgcctcagtgcatcggcgaagccgttgcacctcactatcagcatagaagatgtgataccggtaagcgatggcacaagcaggacaatgcaggctggtgtatagaagagagcgttcagaagctcgtgggaatatgtcccatagagcttcataaaggactcgggcgaaagtgcctgctgagaggggcttccatacatgataagcataacgaagatggatgctatatagagagcaatgcttgctagccatcgcttgatatctggcttcatggccgactggtgccttttcattgcaggtcacccttgagcagaaattcggatacaacagccagcattattcctgctgcaagtgccagtaatggtacagagaacatcccagcaagagagaggtcttctgcccgagagattgacagggtcagattgacgagaggattccattcagcaggagcaagctgcgtcgcgacaatcacgaatgccatcggaaacgcaagcaccagaagcggctgcttcggtaaaaacagcgaaagggctgcagcaaacacgaccagtgccgagatgtagaatgcgtcgtatgccagataagccagatttagcaggtaaggacttatggatgccagcgcaccaaaaggaagctgtgccgcgtagtcagtgtatttcagcatcgaagccgcattgctgccgaatcccgtctgaaatgcatctatgctcgaattcaggggaaatacgaccagctccacgatctgtgaaaccgcaatcatgccagctacatagacgaagcatccaatgaacgctgcaaaaagaaaggaagcaagataggttcgcctgcccatccttgttgccagcgttgcatatctcccggaacgaagatcgcggcagaaggaatctcctgcagccatgcagccaagcgttgggattacgaaaccaagcatatagacccagagatacgaatatatgctttcgtaattgcccatccacccgattgcggccgaaggcagggatccgacatcgcttccccagaatctgagaagcccttctgcaaaaaccactgcaatgcctagagctgcaagtgtgacggcagcaagaaactgaggtgattcgacgatgttcctgagctggaaacgtatagccgtaagcatcctcatgaaggcatccctcccctgcagcatgcaaaaccaatagaggggacatttcacaaagccccctccagcagcgaaaatgctagccgttcagattttgccagccttttacgttgtctacaattggtccatagccaagctctcgtccgtatagagttgcatagccgctgtagcttctgccgctatcttggtaggctccccaagcatgttctccgcgattaagatcgattgcggttccaatataagtgccgtcagcattatcaacccagaaatggccaccggctgatgaatcacttgccacctcaacgtaatatgactgagatgaactgtacttggttccggatgcaatccaagttcttccttgccacgctgctaggttcgcttcaaaatatgcgcctgcagcaggagcagcaactgccagtaccatagatgcggcgactatgccgccagtcagaaattcctttactttctgattcatgatacgtcttctcctcgctcttaatctttacagtgcatgtcgaagacgtttgatctgtccaaataataaatatcgtttcagcagatgagctttttgatgaattgaaattcttattgtttgggtgttgcaactggatcgtgttctcatcactgacacttccaaatattcgatatctattattataatttcagcttatcttatgctttctagcagtcaagtaaatgagggctgagctgggccaagcggatggctaggacccagatggtacgattctcatatgtcccaaacccctgtcaagtggcaatgcggtcgcgaaacaggcgcccacaaggcttcctgaaccgcaaggatgaaggatattcagcaaatgccgctgcggacgcgtcctgcaacatgagagacatgcggacatccctgcccattctcatatccttagatagcgtgcatatgcacggtcccaacatcgatgttccaacatggcggctaagggacagtctaaggaaacgatgattaattcgcctcgatgaggtcgctgggactgcacgctgtatgacatcggctcaaaatgtctcgaaccacgcagtgcccatacccacatagatgcctatctgcctgcggatatgttataattacagcaacgtattccagcatatccaaaaggcagatatgggcagatagatgagcttttaggaccttaaatcctaaggtctaaggagaaagacccggcaagaggcattcctggagcggatggatgcaatcgttgtgtgggatagctggattgcactggtagataccagctaccactgacaggctcttgtcaggcatgtgcgcactgcaaagacgaagctttaggatgtagcctgctttaggtcatgtttgctctcttaagacgagggaacttaaagatgctatcctggattgtcggtcctatcagcgcttctgtgcacgtagacctcatgcaagcgcaggtgccagatgtaacgacacttgcgaaattccgccatagccttaaagcgagagggactcggtaaagcttgtgcttcacgacctgaacttagagcttgaaaaggcagggatcgcggcgcggggtggctccattgtggatgcgaccttcacctgggctcttaagctccacgaagaacaaagaccttgcacgcgacccttaaggcgcaccagtccaagaaagggagagcctggcgtatctgatacaaggcgcatatcggcgtggatgccgcaggtggccttgtgcatggtgtggagacgattgcctagaatgtatctgacatatcctgtggcacatgcactcgtaagggaagatgataggttctgctgcgcagactttaggctatagaggtatagcgaagcgcccttaaggacacataaagacccacacctctcatctatgcgctaaagcgttgctaaggaagccttcgaccataaagggccttgcctgtgcactcttgtccgagaagggcatcgagtccaggaaggcttccggctgctcaaaggcagaagcaccctttcttatcgtgaagcggcgcttttgccccttaaggaagcgctacaggaggatagagaagatacctgcacactcaagtctctctcgcccttgcaaaccttgccatgtgcatcttttgccggcaggctgcacctcccggctcccagcgtcgcttgatccgtcttggagccttattgcggtgcatggggcaggacagatgtaaggatagcggctcctgcacgtgctggatgagcaaccttttctgcctttcccgcattccggctgcgaaaaatcgtgtggtcggtcccctttaacacgttatggggcattaatcatcgtttccctagaatcaggggagtctggcctgctggcagcacccatgctcctataaggtcatggcgggccttcgggatgcccgcggcagggcgcggcaagtcatttcaaggtcagtccttgcgacgacggttggtgtatgggccagcgccctgttgcaagctactacgatgggagcatacgctcctacggtcgactttgcgcgagtgtcggcgcagttgcaaccgcgatatcattatcagtgtgacgctcctatgctgatatagatgaaccaacgattgggatacaatcgggcatacgtcaatcaagaactcttaggctctttgttccagatgcttttcccag

SEQ ID NO: 397 - DNA, 36501 bp, Unknown
  Metagenome-assembled genome
cgccgccagcgttcatcctgagccaggatcgaactctccgttcaaaccatttgcaatcaagcaaatagaagatgaaatgaaagagtgtgtgtcctgtatcgaatgatcacgctcgccaaataaaaagcggattcatcatgtagttctcttttttaagaaagaattgacggaagtacatggtgtttaactaccaaatacaaccgttagtacacaaatcactgtcttttagtgtttgtcacacagtatccggttttcaaggttcagcgcgctttgaagaccagtgccccgaagcgcgagcattaaccctacacgcccaccgaccccaaacatgtgggatttgtcatgttcacagaatggacacaactcaactgggattttgctgaaacaaatagatttctgtctctgtataatattataccctagctattcagactcattgcagtaaagcccattttgtatgggcagattgtcaagctgagtgcaacatctccctaaagacctcgttggctgtcctgtatttcaggaccttcctcgctctgtcacagatcagctccaccgcatgctgcacctcctcgtttgtgaccttgctgaagccgctgcccttaggggaagaactttcgcaggagcccgttggtgttcttaactgttagcttctgccatagatggtgggggtcacagaagtagaactgcacgcctcccaaggcctttgtgaaccctgcatgccctgcgaactgcttgcccctatccggagtgagcgtcttaaggggacatccctgcaaaagcccgaaggcggccttagagacgcttccgctgtcgtggtggcatctctttgcgagaagcagcctcactgccctgtcggcaagtacgagcaggcacacgggtcccgctgccacgagcgtgtcgtctgccaagtcttcgaggcgagacctcgcatcggcctgctttggcctctcctttacggtgtgtaagatctcgatcttgcctttggtcttaagccccttcctgcgcaggtggtgctgcatctggccttgcgggccggatcccggcagctcgagcgtggcggcctggacctgccggtagaatagtcgagaggctcacaacgcacctgccgccaccctcgagcctgagatatagtctatctcctccagggaccagtgtctgtccatgatgagcaagcgcaccttctgcgtaagcgcagggtctgaaagccgccttttcaccctgcatctcctgcggcgttcatccgccctccttttgggcagcacatgccctaaagcgtccgtgccgtgcgttcctcttgagcttgtggcagacgctggagctgtccctgccgatcttgtgtgcgatatagccgatggagcttcccttgtgccacacagctcggctatgcagtccctctcctgtaggcttgagatgcttgtagtggcacattccttttagctttcgacgttgattgagacaaccaacatcgtagccttccggagtgtgccacgcttgcattcagcgggccatcctgttgcactcagaatgctaatccgccgaattaatcatcgtttccctagctcaggtgctctctgagcccccttaccctattattgtcacgtcaaacacagacacagagagagcgtgagctgcctttgcatgtatctttggagttaatggtaagagatcaatagacaatttgttcattgttctgcagggaaagtttcatagagtaaagttttaagcgtctaggacaaggagtgtatacatgtttgataaattacctgttccgggtcgcaacgacccctgctggtgcggaagcggcaagaaatacaagaaatgccatgcagcagccgatgagaaaatggaggagttcgtgctgaagggggaagaagtgctgccacgctcacttctgaagacgaagaaggatattgagggcatcaaagcctctgccgccatcaacataggtgtgctcgactatgtggggaaccacattagggccggcgtctccacgatgaacatcaacgagtgggtcgaatcctacttaagtgaccacggtgccgtatccgcagacttgaactttgagggctatccctacagcgtctgcacttcgatcaacgatgtggtctgccacgggttccccaacaagaaggacgtcctgaaggacggtgacattatcaatgtcgatatgtccaccatcaaagacggctatttctctgactcctcccgcatgttctgtatcggaaacgtgagcgacgaacggaaacggctcgttgaggtcacgcacgacgcagtccaagccggactcaccgccgtaaagccctggggacacctgggcgatgtgggcgacgcggtccatcaggttgccctcgatgctgggtttactgtggtgcgtgactatggcggtcatggtatcggcaaagagttccacgaggatccgttcgtgagctttgtcgcaaagccacacactggtccgatcctggttccaggtatgtgcttcacgatcgaaccgatggtcaacgctggcaaaccggacatcaagattgagcgttctaacggctggatcgtccgcaccaaagacggctccgattccgctcagtgggaagtgcagctggtcgttaccaaggatggctacgagctgctctcctggtagcgtcttagctatatccgtactctttcaggtcaggtcttacagcagaggcctggctttctttttggctcttcgacgtttccctaggatcttggctgtagattttctgtcggggcagccatagacgtcgcacatcgcctctgccatctgacaggcatgcgcctccctgagatgtgagctgtaatctttggtggacagctggacgccagcaactggtggcaagtatcctttgcccagatacccacctaacaccacctgtagacttaagccatgagatgtcagtgagtgcaagtaaggcagaagaaggcaaagtacaagtcgaagcttcccagacagtatatagatgagtagcaccttaaggctaccagtactgcggcaaggcccggcagacctaaagagaagcatcagggcgtacaccaaagagcttgaccctgttagaccattgtagatatagggaagcgaaaagatgtcacggggtcaccctacaatcgggttcgactaagaaaccgacctgaagaagaccccgcatgctcgatatgatatgacaactagcaaagtagctgacctgcgaggagaaggttgcacttaccgccggcctcaagcagatgatagccgagaagctaacattgcaggccgacaagtccgccacatgcctgcagctcaccaggcacgggtgctcgctcacagcagggacaggcaagctgctcgtgcagtcgaagccagcagcatcccagtggatggagcttacccagtgcctagctggcaggctcacgctgtacaggcgtgagaagagatgcggcgtgtgagtgtacagcgtctagttcatgtgccagcacgcatgtgaggcgatagcgttaaggcttaagttgttgtgcgccgtcggcaaacacttcgcaaagagcctggccgaccatctcccaagatgtcgccaaacaaagtagaagatagcctttcaggcggctttgtttggcaggggcaatcatatcatggatacatctgcggatggtcttcgaccatcactcaactcgtagaccctcgtatcgcgggtattttgatgattatctagtgcgaaaccggctttgtcggctacacgatgggctccactatccccgatacggaggacgacgccttcgttatctctgccgccgcccactacgacatcgcaggcacggtgcttgtcgcagcgatctttctgttggcctgctccaacgtttgcgccggcctgatcttttcgatcgactcctacttagagcgcagctggccgaagatcccctacgatgtgtgggcaattctgatcacaatcgtctcctgcatcatcgccaacgttggcctcaccgcaatccttacctactcgatcccgatcctgatggcgctctgtccgctcgggattcgcggcatggtaatgggccttgtccctagcgacgacacacaccaccgtgtggagaataatcttcgtctccgtaggcatcgtctcagtcacggtcgcactgcgcgacggcttttccccgatgtgttcctaccctttgatctgcttccactcgcaccttaaggcatgggctgggtggtacctgcactcgtcgcgataccgatcggcttcattatcgagcacacacaggaccgctcaagcacactaagcgcttcttcactggcccacagggcaacatagcgcctttaggagctgtacctgctgaccgttctcccacgatagcgcctgcatgattcagccaaagggctatcaaaaatttgtatcgttcaatagagcagtaggggccatatcctcgtgatacggcccctacatttatgcctctcgtatgtcctgaaatgctactgcttctttaagcaaagctgcggcccgtcggcgtagtccacagggtgagatcacttgcagggttcggagcagtcgtcaccgtataggtgaacgtcgtagtgttggagggtaaggtattgacgtagccagcgtacacatcgtggtcgtagagcgtcgcctctccctggttcatgacctcgtccgcatcgatctggaaattgctgatcgagccgccggcgggagccattgcgaggaaggaggtgatcattccatagccgtgtgactccggaacaatgcccgtgatgtactcagtcagctcatgctgcatctgatcgagcgtcgtcgtattgtgcagagtcacggtcaccggataggatacgctgccgtcgtcgttggttgtgggctcacccacgctactgcgcatatcgaggtaccaatcgagcttggagccggttttatcgtagatgtagaacccagccttcgggtttgccgcgtcctggttgatctccccgtcggcaccgagggcagtgaccgcctgctcttcgtctgcgttattcatgtaggccaacagacgtccctgtgtgatgccgtcccggatagtggtaaacgcatcgactagattgatagagctcattgagcttttgagtttctccatcgttccgctcgcgacctcagagaagaaggggtcctgtttcgcagggtcgaggaaatacacctgattcagcaggacctgagcagcattgtccccgtcgacaaccgtaccgtccgaagtcgtgatcccaccggtcagcttgagcatgctctgcaggaagaccgggtcaagggcgatcacaccgtcgacgtctccatggtcctctgcgttccagcaccactccatcagctgggccgcacgcgggaagctcgggacgacatttacgtcagctggggcaaacgaggcaccggactgcatgagcgtaccgacgacggagaactcctcgtcagtcagggggatcgtgccctgcgggaaatgaccgctggcaggctcatagtcccccagagtgatcgttccgttatcgacgatcatcgggatcctagatccggggaagccgccggtggagcggatctcagagttattctgcgcgacgatcagataggtgcgcggcccattggcaccgagcagtgacggcagatagggctgaactttcgcaagctctgtcgtggcggcatccagaccatccagcgttgttttgaccttctgcaacggagtgttgatctgatccatcgaagtaggaccgatcgcatcgatctgctgcgaggcattctcaatcgccggctgtacctggatcaactcggcggtgagcgccgtaaaagccgggacattgatagcaccgtctgagaagatcgcgccggaggcatcctggctcatgcgctcggcaatcggggttaccacctgggtggacaagtcattggctacgcccgtcaacgcacgtaccttcgggatatccgccccggggccggggaagacgctcgcgatgttccaccaagggctagagacttcgttgttcatctcagaggtaaggtctgtgatcctcgtggcactcgtattcatcgccgacgtatcgcctgaagcgaggttctttgagaagttgttcgcttcctgcgtcaattcgcttgcatcgtcagccaccgtctgcgcactgtggtagacgccgaaggccgcgatgccgagcacgacgacgattgcgacgatcacgcgcacgataatcgtggtgcggtgttccttagcgtgatgatagcgatgcttgctgttctgctccgactcctgcatgaatgaggggtcagtaaagggatcccagttacctgaggcgtcaggggtggcatggcgtacgggttgtacgttctcttctggttcctgctctgaatccgacggttcatccaacgaggcggatttggtatagatcggtgagaccgaacggacagcttttgcgtgtacgtggtggcttgctttgccgtttctctccacgttctgaccaacgtctttattgtccgtgccgtcagacgagtttttctccgccatgaaagcaatcccttctcagtgaaaacaaacaacggctatgttacaggatagcgttcccccgcctcggattggccaatctatccccgtagcggtcaaccgcgcgttcaaacagcgcgtagtgtttcacccgatgtgcgtcacttgcaatataggtgtaaagcccccgctcaaacaatttctttgcgatccgttttgcgtggcccaaacgtcccccgtgaataaagtcaccggaagcctgcagctcacagcccagatccaccagacgttgggcgagctcaatgtttttgcggatcgcggcatagcgctcggggtgggcgatcaccacacggtagcccagtccctgcacgatatagatcgtgcgctcataggccgcaaaggaatcctcagtgcagttggtatcaagctcaagcaaaaactgcccggtctcgggggtcagcagatagggcgcccacttcctcacgcctagctgcatcagcttggtgtggttcacctcaaagcccatgtatatcgggaatcctgaggctgcagctttgaattgctgaaaagcgtgctgcatccgctcatagtcaaaataggggtccctgcaatggggcgtacagataatgctggtgatgccagagtgctgtgcggcctcaagcatcttaaggctgtagtcaaggttcggggatccgtcatcgacgcccggcagtatgtggcaatgtatatcctgcatgataccttagtggttgacagttgaggcatcgtccgtgtagtaaccggcattcttcagaagctcagtagtctcatcgagcgcaaccttcacgggcttctcagaagctaaatgcgttgccggacgacgatatgccacagcggttacatcctgtgagttgtcgctgtcatcaggcgtcgcctgcgcgttatcaggggtggccactggagccttcgaggtatgcggcgtatcctccttcagtatctcgtaggacttgttgttgtccttgttggaagatccttcctcgtagtagtcatagtacttgttcgaggtatccgcatcggtgaagttgagtattgtgccaatcacatgggcacctgcctgcttgagctgggtgtaggaggcacgcacgtcctcacggcgcgtgaagttctggcgtacgacgagcacggtcgcatcggtaagcgaagccacaacggccgcgtcgacgaaggtattgaccggcggggtatcgacgatcacatagtcatacatcttggtgagcgtacccatcagattgtggaagcgccgcgactgcaagaggtctgccggattggggatactcggctccgcatccagaaagtagaggttgggcataccagcattgatagcagcttcctcaaccgtgtggcgtccggagacaaccgaatagaggccgtgtctgccgtgtgcgccgagggcacttgccaaagagcggcggcgcaggtcgcattcgaccataatgactgtggagccaccggcggcaaaggccttgcctaagcccacggcaatcgttgtcttgccctctgaagggatagaggacaccaccgcgatgctgtgcgccagatgatcaacggaagagaatctgatgtttgcggccaaggtcttgagggagttctgcagaataaccttgtctgctttgtcactttttctcggcataattacttcccccgatcgatttcaggaatgcggccgataatcggtgtatcgatcagctctttaagatcctcagagccacgtacacgggtgttgagcatatcggagataacgacgattacgattgcgacaaaaagacctgcgataaaggctattgccacatagagaacacggttggggccagagggtgactgcggcacctccacctcgctgatcgggttgatggactcgacgttcatcacattgtgtgcgacgttggagacatccttaatcatcgtgttcacaatgtctgcggctttctgcgggtcggggcccgtaacggaaagcgtgatgacacgggaagtcgtctcattggtaacgtcgacattgtagcctttaagctctgcaactccgacctctgaggccacctcattggtgatacggtcgctcttcaggagtttcgctacatcgttcgtcagcatctgcgaagcattcagatctgagtaaaggttgttgctgtttgagctactagcttcattctgtgcaaggacatacatgcttgtcgttgctgcataactgttccggacaaaggcaaacgaatagaccccgacgacaagcgcgcagatgatcggtaccagtatcacgaaccgagcatgcttcttcagaagtctaaaaagttcaattagcgtcatacggttggctctctcaccatgtttttgcgatatagactgcatttattctgacaaattctcattactagtgcaataacgaggataaaaaagaacagcgacccggggtctctcgcaatgcgatggtatccgcgaaaaacaatcaaaggcgatcaccctgggctgctactatcatcttagcttagaagagcgagaagatgccctgctttcccacactgagggcaaaaacatatccaagattgtcagaaagctacattgcgacaagtcgaccatagcttgtgagcttgcagcgaactcatgcaaccaggaagtatccgatatgtgatacagaggcactgcaacagacgcaggcagtagagtctcaaagagtttttgtgcctgtgtgcagggcaagactatcaactaccagtgctcaccgcaacagatcacaggaagactcacactagggaaatgatgattaatgcctatgccagccgcgaaaggccacgtggctagtcctttctggcacatcattgggaattaatcatcgtttccttagagcggtccacacaggttgttaacaagcagacgcagcaacatgagaagaaaccccatactgctgcattacatttgttctatggccttctatcttacttagcgcaacacttgttgaaagcttcgatcaccttatcgcccatctcatgggttcccagtacctttgagacaggagtcgcagaatctgccagatcagcggttctccatcccgcgtcgaggacatcttccactgccgcatcaagcgtagctgccgcctcatccatcttgaagctgtagcgcagcatcagcgacacagacagaatctgtgccagggggtttgcaatacccttccctgcgatatcaggcgccgaaccgtggctcggctcatagagagcggtgccatctcctaaagaagcggaggcgagcataccgagggaaccggtgagcatcgaggcctcatccgacaggatgtcaccgaaggtattctccgtcaccaatacgtcaaactgggcgggatttgcaaccaactgcatcgcggagttgtcgaccagcatatcggaggattcgacatccagatagtccttagcgatgcggtggttgacttcgcgccacaagcgcgaggtggcgagtacgttggccttatcgacggaagttaccttgccacgtctgccctgtgccgcctcataggcccagcgtacgacacgttcgatctcatactccgagtactgcatcacgtcactggcgaaggaaccggcacggccattcacgcccgcaccctcaacatgatcctcacgcttgtgctcaccgaaatagaggccgccggtgagctcacgcacgatcagcagatcgacgcccttgagccgctcaggacgtaaaggagaggcatcccgcagcgcacgatagatgtgaaccggacgcaggttgaggaagaggtgcagattcttgcggatcgccagcagtccctgctccggacgtaccgaagcgctcggatcatcccacttcggtcctccgaccgccgctagaaggaccgcatctgcggcctgggcagcctgcagagtttcagcgggcagggctgtgacattttccccgttgtcacgcgtcatgtcgatagcgctgccgccgatcaggtggtcctcacagacaaagccgacgtcgtaggcagcccccactgcagacaggacgcgtttgccctctgccatgatctcagggccgataccatccccgggaagcgtgcaaatgttgtaggtcgttgataccatggctccttaagcctccttcgcctgggtagcgttaccttctttcgctatccttttcttcgcgtagttcacaagcccgccgtcgttgatgatctcctggatgaaaggtgggaagggctgtgcggagaaggtcttgccggtcgtctcatcctcaatcgtgccggtatcagcatccacccggatccgatccccttcgttgatggcatcgacggcctcggggcactccaggatcgggaggccgatattgatcgcattgcggtagaagatgcgggcgaagctctttgcgatgacgcagctcacacctgcagctttgatggccaccggagcatgttcacgggaggagccacagccgaagttctcttgggctacgatcatatcaccgggctgaactcgcttcacaaaggtcttgtccagatccttgaggcagtgcttggcgagctccttcggatcgcttgtattcagatagcgcgcaggaatgattacgtcggtatccacatcgcgcccatagcaaaaggcatttccttcaaatttcatagtgtatccccctccttaatccagatctgacggcagtgcgatgtgtcctgcaaccgcagaggctgcggctaccgcaggagaggccagatagacctcggaggtgggatcccccatgcggccgacaaagttgcggttggtggagctcacgcagcgctcccctgccgccaggatgcccatgtagccgccgaggcagggcccacaggtcggggtggagaccacgcagtgggcgttgataaagatatccatcaggccctcatgtatgcactcaagccacaccgcctgggtggcggggataatgatgcagcgcacatttggtgagacggtgcggcccttcagaaccttcgcggcagcccgcatatcctcgatacgcccgtttgtgcaggagccgatcaccgcctgatcgatcgtgatatctctgctctcagagaccggatgggtgttgctcggcagatgcggccacgccacctgcggcacgatatccactgcatcgaggtggatcacttgcttgtagtgagcatccggatcggagtggtactcgtgggcgggatgctctgcgcgtcccttgatgaactcacggcacttgtcatccacctcgaagaggccagctttgccgcccgcttcgatcgccatgttcgccatcgtcagtcgaccctcaaccgagaggtccccaatcgtggagcctgcgaactccatcgcgcagtacagggcaccgtcgacgccgattttgccgataatgtagaggatgatgtccttagcggtagcgccctcgggcagctcaccctcaacctcaaagcggatcgtctccggcaccttgaaccaggcacggccagtggccatgccgacacccgcatcggtggagccgacgccggtggagaaggcaccgatgccgccgtaggtacaggtgtgggagtcagccccgatcacgaggtcacccgggacgacgatacctttctccgggagcagcgcatgctcgatgcccatgcaaccctgctcaaagtaatgcgtaatgcccatcttatgggcaaaatcgcgcgtgatcttcgtctgctctgcactcttgatatctttgttcggggaatagtggtcaggaaccaagaaaatcttgttcttgtcccatacgcccgccccgatctcacgcacggttttgatcgcgataggggcggtgatatcgttcgcgaggacgccatccacatcacactggatgagctggccgggggtcacctcgtccaagccggcgtgtgctgccaatatcttttctgccatagtctgagctcgcgccatgagatcctcctccttctgtctatgtcgtcaggtgcttatattcgttcatactctcttcgtatgcttcgcctccgtgctctgcagaggctaagccgtccacaagctgccgggccccacgtgcggagcgtccgcccttgcgcagcgcaaagcgctccgcggcctggtcgagttctttttgatccatccggatgccggcgactttcgccagcttgtgtacgatatctagatagacttccttgctcggtttcgagaacgtcaagtggatcccgaagcggtccgagagcgagacgatctcctgcatcgtgtcgttgaggtgaacgtcatcctcctgctcacgctctgagaaggtctccttcacgaggtgacgccgattgctcgtagcgtagatcaccacattggaggacttggcggagaccgagccttccaggatcgccttcagcgccgcaaagttgtcgtcgtcacgggcaaaggagaggtcatcgataaagataatgaagcagagcggattcttcgtcagctcgtcgagcagcgccgggatcatcgtgagctgctctttgtgcacctcaaggatccgaagaccctgatccgcaagttcatttgcaactgccttgaccgtagagctcttgccagtgcccgcatcgccggtcagcaggatgttagctgccggtttgccgtgcagcagcgcccgggtgttatcgaggatgatcttcttttcccggtcatagtccacaagctcatccagattgatcggatcggggtggcgcaccgccacaatgtgccctgaatcatccatgcggaacacgtggtaacgcgcatacatcccatagccgaactggtggatatgggagagccgctcccggtaggttgcgacgagctcgaggtgctgagcgtcgaagattgcaagccctgcacggactgactcaggaagcgttgcggtcaggtcttcaggtgtgagacaggcaagcttctctaaggtctcaagctctgaggcggtcgcctcacctaagagcgctgataccttctctttggcgccgacgcgcctcagaaagacattctcgtcgtcgagcacgacttctcgcacgtagggggcaagcccggagaacccgcgcgcgaacagacctgagacaaaccgcgcgtaggactccgccaggtcaagctgggtgccttccacacactgagaggcaaaacccaaggttgtaaccagatccgcaaccaccggattgtcaagcaaggagcggaagaccacgagggtcttcatgcggatgtagaggtcttcaagttcgcgttgttccatagaggttcacctgacacttacgcgttgtcagtgtcgttcaagattgcgccgcgggcacccgaggagaccagtgccgcatagcgggccagatagccggagagcggctttctcttcgggacaaagttcttcatgcgacgctcgtactcttcgtcgctgatctcaagtgtgagcgtgcagttcggaatatcgatcgagatcaggtcgccttcctggacgatgccgatcgggcctccggaggctgcctcgggggacacatggccgacacaagcgcctcgggttgcgccggaaaagcgcccgtcggtgatgagggcgacgctgtcccctaagcccatgcccatgatcgcagaggtggggttcagcatctcgcgcatgcccggaccgcccttcgggccttcgtagcggataatgacaacgtcgcccggcttgatcttgccggcattgattgccacctgtgcatcctcttcgctctcaaacacgcgggcaggtccctcatgtttgagcatcttcgggctcacggcagagcgtttgacgacggagccgtccggggccagattgcccttgaggactgcgatgccaccggtcggtgagtaggggttctgtgcggtgcggatgacctcagggttgcggttctgtgcctcgtcgatctcctccccaatcgtcttgcccaagacggtcaggcagtcacggttgatcagtcctaccttatcgagctccttcatcacagcgcccacgccgccggcctcattcaggtcctcgacgtaggtggggccagccggagccaggtgacacaggttcggagtcctctcgctcatcccgttggcggcttccaggctgatctcgatgccgcactcatgcgcgatggccggtaagtgcaacatcgtgttggtggagcagcccagagccatatccaccgttaaggcattgtggaaggcctcacgggtcataatgtcacgggcggtaatgccccgctcacacaggttcatgaccgccatgcccgcatgcttggcaagctgcagacgctttgagtagaccgcggggatcgtgccgttgcccggaagacccataccgatggcctcggtgaggcagttcatggagttagcggtatacataccggagcaggagccgcaagtcgggcaagcgtcgcactcaaactcgtggagcttctccgcatcgatcttgcccgcagaataggcacccatcgcctcaaacatggaggagaggctcgtcttgtggccgtcgatgtgacccgcgagcatcgggccgccggagacaaaggttgtgggcaagttcagccgtgctgccgccatgagcaaccccggtacgttcttgtcgcagttcgggatcataaccagcgcatcgaagtcgtgcgccttgaccatacactcggtggagtctgcgatcaggtcgcgggtgacaagcgagtacttcatgccttcgtggcccattgcgataccgtcacagaccgcgatcgcggggaagacgaccggcatgccacccgcctcagcaaccccgagcttgacggcctcagtgatcttgtcgatgttcatgtggcccgggacgatctcattgaatgagctgacgataccgacgaggggctttttgacttcctcttcagtccagcccagtgcgttgaacagtgagcggtgcgctgccgcttcgggacctaccttgattttgtcgcttctcatggatcttccctttctaatcaacgagctcaaagccttcggaggtcagcttctgtttaattgagtctatctgtgcgcggtccttggtttccataccgatccgcagcgtacagctcgagatcggtaaatcaggatcggagagatcgtagtcaacggacaccacgttggcccccatggaggcgatgataccgctcacctcttcgagctggcccggcttgtccatcagtttgatggacagggtcgtcttgcggccgctcatagcgaggccacggttgatcacgcgggagagaatgttgacgtcgatgttgccgccgctgatcacgcagaccacgcgcttgccctgaagcgggagcttgtggaacatgcaggccgccactgaggcagcaccggccccttctgagacgagcttttgcttctccatcagcgccaggatggccgcagcgatctcatcgtctgagacagtgaccatatcgtcgacgtagttctggaccatcttgaaggtctccttgcccggaaccttgacttggatgccatcggcgaaggtgttcgcgtctccagaggactgccactcccccgcgtggaaggcatcgaccatcgcgctcgccccctgggcttgcacaccgtacaccttgcacttggggttcaggctcttgaccgcgcaggcgacaccggcaatcagaccaccgccgccgaccgggacggtcaccgcgtcgacaccttccaactgatccatgatctcgagaccgatcgtaccctgtccggccattacgtcctcatcgtcgtaggggtggatgaaggtggcgccggtctccttctgtagcctcacggcttcgtcgtgcgcgtcatcgtagatgcccggaactaatcggacttccgcacccaacctgcgggtgttttcaaccttgacgatcggggccccatccggcatacagacgatcgcgtgggcgtgcagtctgctcgccgccaaggctacgccctgggcgtggttaccggcgctgcaggctatgacgcccttggagagggcctccttggggagctgactgatcttgaagtaggcaccgcgaagcttaaaggatccggtgaactggaggttttcggtcttgaggtagagctcaggcatatcagacacaatgtttgacgcccgaatgaggtcagttttgcgcgctatacctttcagtacgtaggcggcctgatagatcctgtcgagcgtcaacatacgccgttctcctcatccttttctagattgccaagaaattggtgatgtgctgtcctgccgggaccatcgggcgcaccatctcatccggggcgatggctgcatcgatcacgtagccatgaccgcaagccaatgcctctttcagcgtgtcctcgaagtcctccatcgagctcacgcgtttaccagcaagcccataagcgcgggccagagcgacccactcaggcggacggtcaagcgttgtttgggaatagcgcttgttgtagatgagcgtctgccactggtgcaccatgcccagcacggagttgtcgtagatgatcgtgatgatcggcagatggtagtgctggaccgtagcgagctcaatgcagttcatgcggaaggagccgtcgcccgtgacatggatcacgcacttatccgggttacccacttgtgcgccgatcgcggcacccaagccaaagcccatcgcgccgaaaccaccggaggtcagaagctgccccggatagtcatagtggaagtgctggaccgcccacatctggtgctgtcccacgtcggtcgcgacgatcgtatcctcagggcagatcttcgcaattgcggtgtcgatctgcttcgggttaaggtggtctccgtcctcttcgtacttggtttccgtcggataggagaagacatgctctttccactcgtcgtggtgcagctgatggagccgctcgttaagcattgagaggacctgctttgcgtcgcctaagaccgcatagtcgcagcggacattcttgccgatctcggcgcggtcgatatcaatctggacgatcttcgcatgctccgcgaaggtggagggctgcagcgccacacgatcggagaaccggcagcccacagcgatcagaagatcgcactcatcaactgccatattggaagcctgggagccgtgcatgccgatcagaccggtcgcaagcgggtctctgccgcgaaagccaccggcacccattgcggtgattgcgaccggggcatcgatgcggttgacgaactcgttgaactcttcatcggagcgggaacgcaccacgccgccaccgcagataacgagcggacgcttagaggcattgaccatgtcgaccagcttgtcgacttcatatggtttgggatccggggtattgaggctgcccatcagccgcttggagagtcggttgggaagctcaaagatctggtgcttctccactggcaccacctcatagtcgcacttggcagttgcgatatccttggtgatatcaagcagagtcgggccggggcgtccgctgcgtgcgagcaggaaggcttgccgcaccgccggcgccagatcgtgcacgtcgtccacgacgcggttccacttggtgatcgacttggtgatctcggtgatattgacctcctggaaggagtccttgccgagaagcttgctcgagacattgcaggtgatagcgacaatcggggaagagtccatataagcagtcgcgatgccggtcaccaggttcgtacagcccgggcctgaggtagacatgcacacacccaccttgccggtcgagcgggcatagccgtcggcagcgtgcgccgcgccctgctcgtggctcgtcaggtagtgatggatctctggcgtctggtataggacgtcgtatacgtccagaatcgttcctccaggatatccaaaaatgctatcaacgccctgttcctttagacactcgatgagtatctgtgcgccagtaagctccatgtgatgctcccctcctttaatgcaaacgatggctcattccgtccgattgtggacggcgccttgaacctgcaaaaccaatactgtctcgttttgtacgcacaaagcgccgaaggcgccggagcacgcaccacaagccgtgtcttgttgtgccccggcgccacaacatacgccgattagttgttgaggagcttgtcctcgtcgttccaagaatacagagcgcggatctttttgccggtctgctccatcagggactcagcctccatacggcgcatcgccttgaagtggacctggtgggtctcatcggacatatcgagcaggaagtcttttgcgaaggagccgtcctggatagccttcaggttctttctcatgccctccttggcggcttcggtgataacgttcgggccgcaggtgtagtcgccgtactcagcggtgttggagatggaggacctcatgccggagaagccgctctcgtagatcaggtcgacgatcagcttcatctcgtggatgcactcaaagtaggcgttacggggatcgtagccagcctcgaccagggtgttgaagcctgcctccatcaggtcggtgacgccgccacacagaacgttctgctcgccgaacaggtcggtctcagtctcggtcttaaagtcggtctcaagcagtgctgcacgcgctccgccgatggcagcgccgtaggcaagcgcgatatcgaacgcgtcgcccgtagcatcttggtgtgcacagaccagcatcgggacgcccttgccctccaggtaggtggaacggacggtgtggcccggagccttcggggcgaccatgatgacgttacagtccggacgcacctcgatgcagccatagtggatgttgaagccatgtgcgaaggcgatggtcttgcccggagccagattcggctcgatatcttccttgtacatcttggcctgatactcatcgttgatgaggatcatgatgatgtctgcccacttggtagcctccgcattagagacaacctcaagtccctgcttctcagcctttgcgcgggacttggagtttggcaataagccgaccttaacgtcaacaccagagtccttcaggttcagggcgtgtgcgtgcccctgggagccgtagccaatgacagcaaccttcttgccgtcgagcttggacatgtccacgtccttctcgtgatacatcttgaatgccatagcagtgcttcctttcttttcgtgccttgtctatgcattttgcttgctatcgctacgccgctcaagtaaacgacggagttgccactacttacttctttgctgaccgtgaggccaggatcatgcggttgatcgcatcgatataggccttggccgcggagacgataatgtcgttgtcggcgccgtgcccggtaaagaccttgccgtccttcgactgcgtcctcaccgtcacctcaccaatcgcatcgatgccgcgggtgatcgccttaacggagaactcttccagttcgacgtttgcaccgatgacttggttgattgccttgtaggcggcgtcgatcgggccggagccggtggagcagaccacgtgcgtgtcgccctgctcatccttgaccgttgcggtcgcggttggaaccagcggatctccgcaggatacctgcagtgcgtcgaggctgtagaccgcggtgctattgcgctgacgctcctggacgatggactccaggtcctcgtcgtatacctctttcttctggtctgcaatctcaaggaaccgcttgtagatatcatcaaactcatcatccgggaaggtatagccgagctctgcgagccgatgcttcagagccgcatggccggaacgggcggaaaggataatctcagagcctgccgcaccgacatcctcgggggcgatgatctcataggtgtcacgggccttcaggacgccgtcttggtgaataccggaggagtgcgcgaaggcgttggcaccgacaatggccttgttggcctgtacctgcataccggtaattcggcttactaagtgggaggcccgcgtcagctcctgcgtcacaatatcggtatgcccatcgagctcatctccgtgcatcttgagggccataacaacctcttcaagcgcggtgttgcccgcacgctcacctagaccgttgatcgtgcactcgacctgtgtggcgccgtttttgacgccagccagcgccaacgcggttgccatgcccagatcgttgtgggtgtgtacggagatagtaacagtctcaatgtcccgtacatgctcggtcaggcctttgatgcgcgctccgaaatcatcgggcagctggtagccggtagtatcagggatgttgatgaccgtggcgcctgcatcgacggcagcctgtacaacccgctccaggaactgctgatccgcacgccctgcatcctctgcgtagaactcaacgtcgtcgacgtatttcttcgcgtatttgacgcagtgggtggccgcctcaacaacctggtcttcggtcatgtgcagcttctcgtggatgtgctgcggggagacgcctaatccggtgtggatacggggacgtttggcagtcttcagtgcctcagcggcgcagtcaatgtctttatcgacggcgcgagtcaacccgacgactactgcgtcatcccctgccagacgcccgatttcctgtacagacttgaagtctccagggcttgaaatcgggaagccagcttcgatcacatcgacgttcatgcgaagcaattcgtgggcgatcgtcagcttttcttcggtattcatggaagcaccgggcgattgttcaccgtcgcgcaaggtagtatcaaaaatatcgatctttctggtcataaaaaactcctcgaagtcaaagggttataggtacctcaagacaacgattcacccggtttgcataaccagaaagcggtattcagccccaaaaaggatggttctaccccataaagcagataaatgctcccacccaagccttaaccaagcttggtaacctgccacagacacactcatgtcttcacaaaaagcatttctgtctcagttatacaaaaaggaatacataaaaaaccgttgtccgcaacacttgcaaacaacacggcgtacatgacgggattctgacagattcaaacccttaggtcagcacgcctagactaggaggaggcccaaaacgggcttaataatctctaccgctacaggagcaataattactagggactctacgaagctagtggtactaacagtattcagctcacccttgctttcaaatgtcccaaagctcattgcttatctccctgtaagaaaaacgctctatttgtggcggctctttgtcgcctcgcgtttgttgagacaaagtatgccagaaagccggaacagtcagcgcagaaaattacaaagtgaaattatcttgtaacacttgacgcaaaagtccaggtagactgctttcagctacattgcaagcacgtaacagagcccaatctagccgtcaagcacatgagggctgatgcaggccggccagctagcccaggtgatacaactttccatgccaaagggagctgtgccctggagcctactgggctctgtgtttggtgacaacctcttcggctagccttcaaggagaaagtggaaccgtcaggatccatggtacgcaaaagtcccttccacacccgcagtgccaaggccgaagataccaagatctgccggcctaagaaggccacagtcgagtgctgctgctgtaagcacataggctttgctaccttcgctaagctaagtgccaagatgggagtgtcctgactgcaggcgcacgtacagctcgcttacagggacagtctttaagcacaccaggcacacaccctgccgaagtgggtatcacccatcaggctcatgcgctacagtgtgccccttaactgcaagagacaaagcgctcagatatcgcatcaaaagcgcttggggatggtggcattgggtctttcgtcctcaaggaagtgcctctggatcgacaaggcctacatcgctgatgcgcacctctcctgcgccttcgggcaggcgagcaagtgtgccctgtcagcgggttggcacagacgtccacacgagcccctataccgtggtctgtggccacaaagagccgtccatgaaaaggatcaggggactttgtggccactgagctgaaggcacaaccatcgtgcatgagcgcctgtgcacccacagggaccgctcgaagagggcacgcctgctcaggcaggcgcgcttcccagcgccgaagtcggtcgagggcttcgactggaccaatgtcgccttccccaacgggtggaggcgcgacgagatgtgctcgctggcgttcgtgcgcgacgtgaagggcctggtcttctacagccagaccggccgcggcaagacccacatggcgatagcccttagcatcgccgcgacctcggcgctctacgcggcgaggttcttccagaccgcgcagcttatgctccatctcggcaaggcgaagcgcgaaggcacgctcgacaggctactcgccgatatagccaaggcgaggctcctcatcctggacgagttcggctacgtgcccttcgacgtgaacggcgcgaggctgctctaccaggtgatatcggaaagctacaagaggaggagcgtgatcttcaccaccaacgtcgaattcagccgctgggggacgctcttcgccgacgacaagctcgcagcggcaatcgtggagcgcgtcgtgcaccacggcaggctcgtcgagttctgcggtcccagccacaggcttaagcagagcctcatgctgggcaaatcgggaaggtaggacgtcggcgcgctcatgtgtaaagccgaaaaagtttggctcaatcctaaaacctgtgtgcagacccatcatgccgcagcaccggaacccttcgagtagcgcctgctggcatcgaaggtcttgaggaagaagtagtcgtctgggtatctctagcctgccctcctgagcgtcttgatcatgcagttggtgacttcgaccctgccgctgctgatatggtggcgcgcatgcgcgacgatcccttccctgtgcccctccacgaggcgggcaaccctggcgaagtgcctgtctttcgtgccgcggcagacctccacgatcctctctatggcagcgcgtatctcatccgcatcggtgtacgaataggcctgcgcgagcatctcatctacgatgtcgcaggcaaagggcagctcgttttgggatatgaggtcctcgtagcgcttcctggctcctcccttctgcagggccccctgcttgccgaagagggcgcttccccttgagacgagcctgccggcgcgtgcatcgcaatccttcctcttcctggtgtcggcacaggacttaaggatgtatgtggagcgcttgagggaccttgctccttaagtcttgcctgcttatccttcctgaccttacagatcaccttctcgttgaagttcttcacgatatggaagtactcgtagacgatgtccaggtgcgggaacctctcgaggaatgcgcactcgaagtctgcgttcatgtcgcaggcgatggcctccacattggatatccactcagcgagcacaaagtcacagaattcatgcacgacctgcttcttcttggaatgagcgagctacagcacatggcccatcttaaggtctatgactacggtggcatatctgtgcccgccgtaaagcttgaacgtatctgcgcccagataccttgcctgccgctccggcttccggagtctggtcccgccgtcctcgcccttctccgtatagagcccagagagtctcgccctgtcgatctccttcacgacattcctgtggagacccgtcatgaggctccctgccttgagtgtctggcccatggcaagcaggtcacacacgaatgcgaggagcggcagcgtgatgcggtatccgggggtcctgaagggcacctcttccgtgagggtgctcccgcactccctgcatgcccatcttggccgcaagacctctatccttgccctctccatcttgcttcgcgccttcctcgtgctcgactctggtgtcgaagaactacatctcgtctatctatacgtcccgaaaggaccacccggttcttacagccgctgacggtgcaaaagatcttgtgggggataaggacctgagctaattcacctgcacacatgccagaataacggatgcattgctctttacatttctgcgataccccagcaaactggtgtgtcagaatacgacaataccccgcatgtttaccgttggcctcacggagcccgtcgtgcagtttatgggatagttgcacgcatttggcagcctgagggccgccgggttcggtccgtccgaagaacatgctgagcatcatcacgctgcccgttagggcgccacacatacagccggggccttgcaataccaccggatatcccggtcgccatcttgcttgataacctcatccggtaaatcgagaccaaagttatcacagattgaccgcaccaccgactcagcgcaaagaaagccgctgcggcaagcttcttccgcatcctcaatcaccttgtggacacccacttcgttgttgacccgcacagtttcccctccccaagacatggtgcaagggcatgattaaaaccgtgcccgtatggttactcaaccccataggtatacggggttatatccgcatcttcttatcgaacctcacgattgagccagtagtaatacctatccaatatggctatagaactcatcgacttctgcacgagtcggaatcgagcgttgggctccgactttggttgtggtaagagcagctgcacagctcgcccatcgaagcgtaaactccctgtccttatgctccgcgaccatcactgccaaggctcctatgaaggtatcgccggcaccggtagtgtcttctaccttcacctcgagggcaggttgataaagatagatctctccctgcatcaatgcagcacctttatctcccaatgtaatgatcgccgtaggaaccccctgcttgataaaccaggacaagccctgttttacggtcgctttgtcggtcggtaggataccggtgattgtctgacactcagtctcattgacgcagaccatatcaactgaatcccagatactatccggcagcgacaccgcaggcgcagggttgaagagcgtaacaagtccctgatcatgggcctttctcagcgctgccaaggtcgccctgtaaccacactcgagctgtgtgacaaagatatcggcagggtgcgctacccgagagaggctctcacttacctcatcaagccccaacgcatggtttgccccggcattcaggatgatccggttatcagaatcggttctggtaatcatcgccaaaccgcttgaaatgtcgtcgagaatccgcacttcgcttttatcaacacccgcagctggtagcatctccacaagctgttttccaaacacatcgtttccgacagcgccgatcaagaagacctgagcaccgagccgggaagccgctaccgcttggttagctcccttgccaccaggattgatcaggaagtcatggcccgggaccgtctctcctgcctgggggatacgctcacaggcaattgagagatccatgttcagactaccgaaatcgataacgcagggcatagtgagtcctccttttgatcagtagttgacattcccataaactacagtttacgggatttcggcgtgacccatgcctcaatcgacgtgaatttgctgaggtgttgccacaacacctctacacagttgccgctctgccggcttttgcttgtgtgcaatgtttgcggcagcgttgatgtctgcactcaccaagatgctatctttgggttcgctataggtcgcctcagatgcgcttgtctaagaaaaggtgtgcttacttgtcagtgggcttgtattcgatccccacccatacaggatgctttggacgtgtaggtctctttctgctgcatgtatcggtatgtaagctagcgttcgagtagcctatagagaatctgtatgaacacttgatcattctttctgccgtgattgctccctgcttgcatcccatgttggacccaacaatcagggtgtctgtgtccttctctatgcacaagttggtgatggtgcgtgtcgctttgagcatgcagtctcgcacacgccgactccctttgtcggctacctgtcagatttgcctgtgtctagtcggcttttcagatacgccaggtgtgtgttgcaatagtggttggctgacttgagctatcgcctgccaaccaagcgcccatgggcggaggtgacatgtacggcgagattgtcagcttctatatccactcccctaacacagcactcattcaagctaaggggttgtcgggctttaagcacatattggattttgaaagcagctgctggctgtttaggaaggatacccttgatacactgccccatccaaacatccgagatggcccggataggtctgtgtgagctgcctgtgagcgggcagtctctacaacccgttcgtgggaagtatcaacaagaacacactaccttttgtcctgtagtgtgagatcaacacttgagagtagctgtagtcgccactcttgcatcttctcaatactgcaaggggatgctttcaagctataggcgacaacctttatcgtgtgcgtggccccttaggcttgcaacatcttgtaggtatcgttggttttgcacagatgatagttggtctttcagctgaaaagcccgcctgcaatgaagagatgctgccttgtttgatacaaagccttgctgtagaggttgttcgcatataggcaaaggcatttcaacttgcgatagtggttggcgctaagatggcagctgtagttggtttgcactccatactgcattcttgtcttacctgcctaaatatcgatagcttgctgtatgcaatatattcactgacacctaagaacaagaagcgccaccttgaacgatcactgtgagccagaaaacccttcgagatacctgctttgctgccacctcatcctttccaccaactatcgaaggaaaacacttatcgcttaggtgatgatcacaaacatcacttagctctcaactaaaaaatcgctctgaagcacaccatctaaatacttcacatgcaaaccgacaaagaccatatccactacgtgatccacccagcgcccactcaagcgagttcgtgcgtactttgaaagtactcaccgccttccacatatgggaggcccacacatcatagttgtgccatgtctgctggcataaacatacgttctgatcaagtggatacttcattgccatcacaggtgaagtcagcgctaaaaccctcaaacatttgagagctaaggcagacatgattggacggcgtttcatcctgcaaactgaagttccacaggtcttcacgccacaaatcttctataaatgtggggacacttcatattatcttatgtagtatgcacattattggcaaagagagaggggaacgcaccccccctctctcatactggtaaaccttatgcaaagatgtctccggaaacgccgccgtttgccatcttgcccttaacaatgtcgagcttcggataggtacgtttcagatcagaaacagcagcactgatgccggtaccgccggaagtcgcaaagacgtagacctgcttgccagagaagtcattggcatccaggaacgttttcacgacgttaggcgctacgccccaccaaatcgggaaaccgatgtagagcttgtcatattttgtgatatccaccggagccgtggtgatctcaggacggatgcttggatcattcttttccttggtgcttctggagttaggatctttccagttcatatcagccgcggtatagggcttcttcggatcgatcgatacgaggtccgcgcctgctgccttagctaaggaagctgctgcacgtgcggtgtttccgttcttggttgaagaaaaatatgcgactaacgttgccatactcaatcactcctttgatggtttcttgcttcaggttcctgccaaactcacgggcttgtttgacatacctggacctttttgtcatccccggcgccccacagccataccctaaggtctcacctttatcttggaagttcaggtagcgcaccagggtcttgtagtgggcgtttgacgcatcgaaggtccaatccgaagaattccaggcatccacgatcagcgcagaggccatatgctttgcatggagactcgagctgaaggcgcagaagcggcctacagccatcttgaactgcacagttatcccgtggtagtggagcggcgttgcaaagatgagcatatccgcatcgaggattctcttacgcagcgtctccataccgcccttctgtacgcaggggccctcgtagctacaggtgacacatccggtacagggacagacattggcatacgtgacatcgatgatctccacactgtgtctcaccgactaagtaccttcagcgaaggtatgggacagcagtgcggttgaaccgtctctgttcgaactcccttggagaacaagggtcttcatcgtcgcgctccccccttgcagctttcagaccacaatgcttggattctttcggaacttctgacgctgtgtcaatttactttttatagtacttttcttgacaacatgtctataaatttccaaagagaatcagattgcttatttacggctgcaataactttgcaaacagtgaatacaccagctggtagaccgctacctcaggatgtggtgtccccactatatccatagccttcacctgtttgtcggtgtgatgcgcataggagtaaaccccattgagatacgggaaaaactggaaccgaatctcttggcacttctcgtctgtcatcccaggcagaaactttttgaggcaggcatcgaaggtatcgaactcacatttcatcgccgtcttgaactccaccaaacactcgagccggctctgctcctcaatctcgttgagattgtttgactggatcctaagcatcgtctgatgattatcaaacacgtgtgccaacgccaatgccaacccatcggcgtccaactgatcgtggtcatcgatgatggcctgaagatcgtcgacgcagcgattgcattctcgggtcaggagccctaagaagatctcttgaatggtgcagaagtaattgtagatggaaggccgggaaaagctggtataggctgcaatgtctttgactgtaacgttgcagtactggcttttcttgtagagcgcatccagtgcatcgaggatctcatctctgcgcgcttcggtcttctcttttttcacgctaactgacgcctcgccttcatttttaaacatacccatctattgacacaatgtcaatattttccctctccttaatatcgtgcctcaagctgcaaagttatagaccgcgtactccgtttatacctggtcctcccagaagctcactgcgtggtccaaccagccttccgcaacggttccgatcccgaggccaaggctatggtaaaggccatagaacacttcaatctacgccgggatgccccgcgcattgagctcattgcaccgatcggacatgacgcgccagttggtgatcccatccgctgtgcctatattggaataggttggcagcttttcgctggtcacctctgagagacctgtgtactgcatcacgattgcgacaagtctggggcagttctcattaatagaggcagaggttccctcggatccgacccaatcggccatcctggcgccggcagagccatcacagatggagtagccatccattgaaactccaggctcatcggcgtgatcctgcacgtaagcgatcgcccacgaaaggtcttcgcaggcggtctgtacgcccgggcgatagacggtcacaaaagcgttgtagcccttgtgcgaaaactccaaagcatgggacatggaatcgtggattgcagccacataggtaaaaccaccgcctgcgcagcagaaggcagtcctggcatcctgctaccccggagaaaagaggcccgtatttgccaggtccggactatcgtcgatctcatcctgtgagtagaattgtaactgtcttattggaatcggccgcgctgtaccacgccaggtttatggtgcctaaggtatctccggacatgtatccctcatcgaccgggaagatcattctcccccagtcgtcgaaggcaccgtcacctctcacctggtcgatcgggttatcacggttgtaccagactgtctgttgggtagtgccgccgttgctgtagtggggaccattgaagaagagtctcatatcgttatgggtgtactcaccggcggcctgtacgttgtgctcaaacccttcctactcgcgaaaggcgatgcttcccccatcctgggaatcggccgcgataaacctgctggaggagtcgttcttcatattctggatctgtgtcttgatccccgaataggcgaagccatccgtgccggacatcgagtagatgaaaaaatcgctcgaggtgaagccctggtcagctatttgccaggcaatcacactgccgtctgaaggcaccgatccgcttatcggtatgaaccatccaaaatagtctaaacaatactggaaggtgtgccaggcgttcaccgaacccatcgagaaccccgcaaacccacggtgattccgggaagcccgaaaagcctccagagtcgtgctagtagcataggtatgccaccgggatttcactgccggcatcagatcattgcgcagctcattgtggtagttattcgtaagctgcagcgccagctcatagtcagagctgtccgacccaatcgtattgttgtagctcagtaccacgagcagcgacggctcaatccgtccattctggatcgtatggtcgatattgttcttaaagctggtctcgttgccgagtaccccgagcagcgttgtctcattgctccatcccccgcagctgatgtagaggatgccatagggctgattggcgttatatccatagggctcataggtctggtggtccaattcccgcagcattccctattgatcggcaggttggtcatacctatccggaatcgactcaggaatatcgggaatctgtcccgcatcgtagccgatagcatttgatgcatccggtgttgtattctgtccctacccagaatcagaggaatccttattctgattgttatgattattgctacagccagtcagaccaaggcccaccatgatacctgcaactgaaagtctggaaaaatttctgcgtctcattggtgcctttctcatagtggatcgctctgatcggttgcctatctcctacccattagcttggagttttccgacacgctgtataatgcgcatatacgttatccagtattcgttccatgtatagcagcaggtatatagcctagtaatggcaaaggactcctcccgttcacacaggagaagcccctctgcctcacagagctctatgcagacttaaaagattatttcgcaaatcccccctgcggtttcggagcatcccgtgccgtcagatactgctcaaactgcgaggccacttgattgaagtcgttgggaagtaccaccgtggaggcgccctttgcggcgtactggttcatcatatcgatccactgggtgaactcgaagagctgattcgcctcatcttcgctgagctcagcacctttaattgtgtcgatcgactctttgatgccccgcgcgattgccacacgctgatccgcgatacctttgccttctgctgccattgcctccgcacgtgcctgtgcggtgatcacggtctttgccttattagcgtttgcgtcgttcgtcgcagactcaaggttgtttttggaggcgatgatgtggttcattgactcctgcacctctttcggcagcttgatgcttgtgatgagcgtcgtcaccaacacgtagccatacccgcgcatcttctctgctacgacccggtcgatcgactgggcaatagaatccttctccgagaacacctcatcgagcgcacgtgccggaatttgcgaacgcagcgcatctgccaagtagtcctgcatctgccccaccgggtcctgcagggtgtagaagctccggtagacaccggagccttcccctttctccatatccgaatagtcgatgtggtactggatggagacatccagctcaattgtcacattgtcggaggtcttcgcgtcaaaggtcatgtgcttatcttccgtcatgagactcagatcgtacatcgtatcgatgatggggatctttacgtgaaagcccggcccagcaaagcggtgaaacttgccccagcgttcgatcaccgctacatgctgctgccgcacgacgaacgcgccaaggataatgaggatgacaacgataatgagaagaacgatcataacaaaaacactcctttagttaattgagataaaacaccattagtctggctgttcacactgtagcaaacagcctttacagcaatatcgtccaaaacaaaataaacgctgagagggccaatacttccgccgtgcgcgatgctctacactgccctcatccagctttcaacaaactcaatggcacctgtaggcaaccagcgccgagcgggtacactgaacaggttcactacatcacttgaagagtctttcatggcgcagggggcaatcagcgcccttagacaagatggtgtcatgtcgcaccctcagcgttttcgtgacgtcaccaaacagatcccggcatcacaaccttgtccgtgatcagctcggtgggctacgtcgttctgctcacctatgtaagggggcctcattatcgaccgcttccaagccgatccggccccacctgatcaggtcttttcggtcttcggaggctacatcttagcccttttgatcgtctacgccgtcagccaggcgctctcaaagctgcaggactacagcgtctaccgcctcgaaatcaatggcaactacaagctcacacgcctatgcttcgatacactgtcaaatcggtcaatgaagttccatacgagtcggttcggaagatcgctcatgagcgagtgcacccagttggtggatgtcgtggtgtattccctcatccccatcgttgcgagcgtcgtcgccacctttgtcatcttgggacctgcagtttcgatctatgcagtcctgcttgcaatcatgctcgtgatctatttgatcgtcactacaaagatgtaccgacgtatcttgccgctctccaccgcctcaagggcacagaatacattgagcggtgtcctgagtggctcagtcacgaacatcctggccgtcaagacctatggacgtgaggacttcgaacgcgaactcttcaacaaagcagacgtccgagcgaagaacgcagagacccgcaacatgcgcgctccgatacagcatggctttgccatctctgtcataattacgatagcaagcccaatctgcatagctgtgctgacctcataccctgctagctggtcttctttgcaaagaagtcggccaagtccgaattcgtgtgtaaattcgcgaacgccccacatctcctatttcgccttcatgagcccgcactgatcgcgcgcgatggcggcgagcacgggcgcccgcttctcgagctcctcgaccgccgggcggtagcaggccttcctccccggcccctgccagcgctctgagccctgtcaatataatggacagaggaatctcagattttttatgcggtctgcatcgcctttggatcgtatgcaaggcctctctcgaagcgctcgaagaactcctgcatcacctctgcgggcacgcgatctcctatggacttatgcgggcggaagcggttgtagtacgactcgattaaactcgtgtgccttgtgcttggtcgtggatgcgtccgagaggcgcttatggtagtaccactcgttcttgagcgtggcgaaaagcgattcggcgagcgcattgtcgtggcagcttccggttctccccacggagagcctcacgtcgggtacggctgagcaggcggccagctttgagcttatgtactggctgcctgggctgcttagaatatggcccctttggccacgtatccgcgcgaatatgccatcttcagggcaaagacgacaagccctgccctcatgttgtcctgtatgcttcagcccaccaccatgtgtgtgcacagatcgtgtgcgacggcgagatatataaagcctgccgtggtcctgcgataggttgtatcgcccacgagcttggctgtcggcacaagacacgaaaagccgcgccgggtgagggcggggcgctcgggggtatcaggtgcgggcagcgtcgttctcttggaggcattggatcagatgccgcctatcccagttcagccatgcacctgcgcacgcggtagcgggtcgtgcctgtaaattttgcgtaactttggatctcctgtgagcttggatcagacctagcaaaagctaaagcgcctgtcgctttcctcccatatcgcgcagatggcttccttgaggggaccccataggtcctcaccgcctttggccttgagccatctgtagaagtgagccctgctcacctccagtacgcgctccatcatcgagacgctgtaggttgccctcttctccagcatgagctaaaacctgtcctttgtcagaggcttccggcgaagaaggctgccactttttaggaactcgttctcgctttcgagctcgtgcatacgcctgttggccctgtcgagctgcttgtgctcgtctatcctttcctgggtgacccttttggtctttgagtgcttgatgatccagtcgtttaaggtcttgtcgttgaccttaagcttcgcggcgcatcctctgatactcttcttcgggttggccttacgtgccttcctgtagtactcgatggcctcaaggcaatacttcttcagtgtagtgcctgggtgtttccggcttcgtgcgggactttgccttctctatctcgcttgcgcttaccgacatctcatctcttcaatctgctggtgttggtaggtgggtatctggacagagcatatctgttgttagtccctgaatcccactgtccaccaaaagattacagctcacgcgcctcccgcatgagcaccgccgtcgcgagcctgagcgcagactccgggctcgggaagaccccgaccgcccgcgagcggcgcttgatctcgcggttgaggcgctcgaggtagttcgacgtgcgggtgcagcggcgcatgtcgccggcgggcagcgccatcacagtcatcgcgtcgtcgaagccttcgagcagccgctcgactgccctcggggccctctcgcagtagtcggcggcgatctcgtcgcgcctgcgctcggacgacgccctgtcagggcagttgaacatctcagcgagcttactgcgcagcccggccctgagcccctttggggcggccttggccacgttgcgcgagaagtggccccgggcagcgccgagtggacgggccccaccagccccctcgcaggcgtcggaggtgaccacgcgcatgcccgccaggccgcgcgcgacgagcgaggacaggaagctcgaccaggccccttaagtctcgccgtcggcgagctcgacgccgagcacctccttgccgcccgtcggcgtcagcccggcgtccacgagcagcgccttcggcctgacgcggccgcccttgcgcgccttgaggtaggtcgcgtcgaccataacgaaggggtgggcgccctctatggggcggttgcgaaacctctcgagcacctcgtcgagctcggagcaggcctgcaagacggcctgcttggagaagcccctgccgcagatctcctccatcacgcggccgaccttggctatcgagcgccgccgacgaccatctcggccatcgtgaggaccacggcggcctcggtgcgcctgtagttgtcgaacacgagcgtcttaaacgagatgttgcggtggcgcgagacggcgagctcgaccgtgccgaccctggtgacgagggacctcttgcgggtgccgttgtggaagtcggtccgctcctgcgtttgctcgtagggctcggcgcgcagctgctcggcggagtttgccgacaggatcgcgttgagaaactgctgcaagaggagccgaaacgcgtcccctctggaatccgcgaggacctgcgctatcttgtcgctttcgagggtaatattgattcgagccatgctaagcctccgattctctgtgccttttggtgattgcaagtttacttggaagacgggcctctggctcgctcccgtttttacaccactttacggacgtaaccatc

SEQ ID NO: 398 - DNA, 10976 bp, Unknown
  Metagenome-assembled genome
gcctgccccttgtcttgcatctttttgccatcgcggtgccgtttggtacgggagagcgcacccttgcatgcctcggtgatgtttacgccttcgcgcaaagggcgcaagcatcgcggggcggcaggccacggtaacccccgtttttttagaaaatgactgaggacctccagcataccgcaggagtttcctgtcgcctccaaaccatacaaatgaggattcaaggttgatgcatccgagagggcaaagaaagagatggtaaaggggcatgcatgtgctctgaacaggcgcgaatgcgagagcaaagagacaattgaagtgggcctttttgacagatggttctcaaacgggagtcgtgcgaggggaggctgctcgatgagaagttctccgcgctttgtctgcccggtgtgcgccaatacgtcctgctcgaaggtctgaggccgcgcgcacgggcagtgcacgaattctcgctcaggtgagcgtgagccgcatggactttgatggagggcacgctcgagctcaggaagtggttcgtgcgatatggctcatttcgcgcccagaaaggaaggtcacgcctgcgccctgcaaaggcaataggctgcagcttaaagaacggcagtgcggtccttgcagggataatactcgcctgggtcagatcgcagtggttcagcgtccttgcagctgacacacacgagtggactacttctatatcggcgccaagcggcaggcaaaagtgggcgcgccacaaagcacagccagatgcttacatcgcggccatgatggcgcctgcccccttcgctgcgcaagggggtaccctaaagattgctggcacaccaggtgagcatgaccagctctgccatacatcgaagataaggcggatggctggagcggcaaagcttgccggctctcttcgttttgcgggccgtctaataagaaagtacgacagagcgggacggggaagatcccttcccatggtccacagggtgatatccaacttcaggcctacgttgagggtgcctccctggccttcccaaggcccacatgcactccttgcggactcactcagctaaagatatagccacaagggatgtgaagggatggctgcatggatccccacaggatttgccgcctcatccatgtcttgctcttcggcatcgcatccagcgcgaacggtccagccgaagatgccttcgatcttgccaagccgcttacatgttcagggagcctaactatgctggaggtaactcgtcattttgatagatttgagagtatacggcgcttgttttctggaacttctgtgtgtatgtatacagagcttctgcgccgaaaagaagaagtgaggatgagtatgacgcttgaacagaaagactaattctgcgccgctggaagagagcgatgcggaggatttatacaatacgccatcaatcccgatgtgggaccgattgctggatgggctgttcattcgagtgtaaaaaacagcagagagatcataaaaggtgtgctgtttcttgccgaaccagagacacgcagcggttttgaaaggaacaggacaccctgttggcagtaaaggattgtatgattggcaagcagtatatcggtattcctgatacggagggtgaaatcggatactggatttggcgttccatattggggacaaggactcatcccggaggcgttcgtgagataatgcgatatggctttgaagaactgaagctctgaaaaattatggtgtgggtacttgacggaaacgagaaatcaaagcgtgtgcaagaaaatgtggatttttcattatcatcacacttcggtgaatgtttccttgcgcttggagggcattctgcgaacagaacatgtaacctgtttgcgaaagagacttgtttggagaagaataactttcagttccacgatgagacagaatgttacgccagcaaagcgttaaaaccgaatcccttactccgtaacggtgcaacggacatatttgcaggggtgtgcacaaatgcacctgtgtgggtgcaatcgttaaggagtagaaattccgctccgtttagttgcatcaaattagacacggcaacagattgtgttgctgaactcatgaagatgttcagaatcagcagatcagattgacaaaaccaactacgacaccattataatgaaaccggagacataatgtccatatgggataagttactgaacaggatcctttcctgtcaaaggatatgcgatttggatgacttgaagaggttcttgaaagctacggctatgagatgaatgcgccaagagtggaagtaatcttatacgtttccgtacagcctgggaagaaatccgattacaattccaaagcatgaaccgatcaagaagatatacgtcgagatggtgcgagaagtggtggaggaatcagcacataaaacgattgaatattataatgaccttcccttatcggctggaaatccgtcctgcctggatcgaaaggtggctatgtggcacttatccggatctcccacgctgtattacgtaggagattccgtgaagagtgtgctgaaaaatgcagaagatgcaaaagagaatggattgctgcggctgtagaggatggtgttactatcgcggaaccggtgaatatggggggtattcaggacagttcaaactccttgattccaaagaatcttcacaggaagctggccgagcattccaaaaagaaggagtcagcatgaaccagtattgtgtttatctactctccaagaatgatgcgtttggagaaggtatatcctggcttgatacattccgtgataacaatttgataagcagttcgtataccctgtagaaataggataactgaatcaatctaatcaatcatcaagatgacaaaactcaaatgggttgtagaatctatattcatttttcgatgggaataaggttttgtcccttttccgtcctagacaccaacttccgggtttctaggtagcacactcagccttgtgaccgggtactgcctccatggcaaccccgagctcttgagtgctcggcgcgcttctcgagcagttgtttgatggcccagcccgcccttatacctgtcagccttcgcggcacgggcctccatgaggacatcgctgaccgacatgccaccctgatgcctgatgctggtcttaaccctcgcactctataagccctgccaccacatccacgaagtgcgatgccctctggcggtagtagtcttgctggcatagcgcgtggccgtcttggccgttcttgaagtagtcgagtaggtcttcgcgaccagcgcctcttgtacaggcgaacaccgactcggcgtcgcaatcctcttggggcaacgaggtctcgatgacatagacgcccatagcgcggagagctcttcgagcttggcggattgtagccctgttccccgcgctgccatatggcgccgatagttggtctggtctcggctgctcgagcaggtcccgctagactatgacgcgcctgccggcgagcctctctcggaaacctgcaccagcgtcggcttggtgccgcgctgtccaaaggaacgtaatctggcagctccaggtcggcactgcttcccgcctgcacctggccggcgtgctggcgagggggaatatgtgtggtttgtcgccctcgcacagcagcctggcgttgtcgtctgcgttgaagccgcgtcctacgacgaatatcacgcacgccgagaagggcacctgtcacagcaggtcgcgcaccgccagcctgtcggtggctcgcccctcgtagaagcgcgagcttacaggtcaacctgctcatggtagtggacgccaagacgggcgcgcccatatgcctcgcgcttctacgaggggcgagccaccgacatcttggcggtgcgcgacctgctggtgtccaggtgccccttctcgggcgtgatattcgtcgtagaccgcggcttacaacgcagacgacacgccagctgctgtgcgaggcgacaaccactacatcattcccccctcgccagcaccactccaggtgcatgcgggcagtgtgccgacctggaagctgccagatactttcctttggcagcgcggcaccaagccgacactggtgcagtttgtccggaagacggcctcgccgtcggacgcgtcatagtctagcgggcctgctcgatcagctcgagacccaaccaactatcggcgccatatgcagccggggacaaggctacacatccgccaagctcgaagagctcccgcgctcatgggcgtccatgtccctcgagacctcgttgccccacagaggattgcgacgccgattcggttttcgccctgtacaagaggcgcttgtcgatcgagacctacttcgactacttcaagaacggccaagacggccacgcgctatgccagcaagactactaccgcagcagggcctcgccttcgtgatgctggtggcagggctttatagagtcgaggttaagaccagcatccaggcatcagggcttggcatgtcggtcagcgatgtcctcatggaggcccgtgccgcgaggctgacaggtaaagggcggctgggccatcaacaactgcctctgaagcgcgccgagcctttcaagaagccgtgggttgccatggaggcagtacccgtcacaagggctgatggtgctcctagaaaccccggaagttgtggtctagacggaaagggacaaaaccttttccccactcgaaaatgaaatatagattctaacccatttgagtttttgtctcttatatggatctgattcagattgatttcagttatcctatttctacaggtatacgaactgctcttatcaaattgttatcacggaatgtatcaagccaggatcataccttctccaacgcatcattcttggagagtagagaaacacaatactggttcatgctgagctccttcttctttggaatgctcggccagcttcctgtgaaatctttggaatacggagtttgaactgtcctgaatcccctcatattcaccggttccgcgatagtaacaccatcctctacagccgcagcaatccattctctttttgcatcttctgcattttcagcaacactcttcacggaatctcctactgtaatacagccttgggagatccggataacgtgccacatagccaccttcatccagatccggaaggatttccaccgataaggaaggctcatataatattcaatcgttttcatgtgctgagtcctccaccacttctcgaacctctcgacgtatatcttctgtcggttcatgctttggaattgtaatcggattcttcctaagaggcttacggaacgtataatgactacttccactctttggcgcattcatctcatagccttagctttcaagaaccttcttcattcatcaatcgcatatcctttgacagagaaaggatcctgttcagtaacttatcccatctggacatttatgtctccttttttcgttataattggtgtcgtatttggtgtcaattctgatctgctgatttctgatacatcttcatgagttcagcaacacaatctgttgccgtgtctaatttgatgcaaaaacggagcggaattttctactccttaacgatgcacccaccacggtgctttgtgcacacccctgcaaatatgtccgatgcaccgttacggagtaagggatcggtttaacgctgcctgtgcgtacatcttcgttctcctcgtggaactgaaaattatctcttctccaaccatttctctttcgtcaaacagtttacatgttctgttcgcagaatgccctccaatgcgcaaggaacattctccgaagtgtgatgataatgaaatccacatttttcttgcacacgctttgatttctcgtttccgtcaaagtacccacaccataatttttcgagcttcagttcttcaaagccatatcgcattatctcacgaactgcctccggatgagtccttgtccccaatatggaacccaatccagtatccgttcaccctccgtatcagataccgatattaccttgccttgccatcatcaatcctatactgccaacaggtgtctttttccttcaaaaccgctgcgtattctctggttcggaaagcacaccttttagtctctctgctgtttttctacactcgaatgaacagcccatccagcaatcggtccccatcggattgctggcgtatttgtataaatcctccgcatcgctctcttcccagcgcgcagaattagtctttctggttcaagcgtcatacttcatcctcctctttctttttcggagcaggaactctgtatacatacatccagaagttccagaacaagcgccgtatcttcaaatctatcaaaatgactgagtacctccagcatagttaggcttccctgaactgtaagcggcttaggcaagatcgaaggcatcttcgctgaccgtcgcgctggctgcgatgcccgagagcaagacatggatgaggcacatctcgtggtgtcagctccatgcagccatcctacatccctgtgctatatcttagctgagtgagtccgcaagggtgcattgggccttgggaaggccagggaaggcaccctcaacgtaggccttaatttggatatcaccctgtggaccatgggaagggatgcatccccgtccgctctgtcgtactttcttttaacgagcccgcaaaacgaagagaggccggcaagctttgccggctccagccatccgcccttatcttcgatgtatggcagagctggtcatgctccacctggttgcatcaatctttcgagtacccctctgcgagcgcagggggcaggcgcccggcctgccgctgttaagcatcggctgctgctttgtggcgcgcccactttttgcctgccgccttggcgccgatatagaagtcgtccacctcgttttgttcagctgcaaggacgctgaacgcactgcgatctgacccaggcgagtatatccctgcaggacccccctgccgtctttaagctgcagcctatctgccttctgcagggcgcaggcgctgatccttgccttctgggcggaccatgagccatatcgcccacgaaccacttcctgagcttcgagcgtgccctccatcaatagtccctgcgctcacgctcacctatgcgagcacttcgtgcactgccacttgtgctcgcggctcagaccttcgacaggacgtattggcgcaacccgggcagacaaagccgccggagaacttctcatcgagcagctcccctcgcacgactcccctcgtttgagacctcttcaaaggccatcaatgtctctttgctctcgcattcgcgcctgttcaggcacctgcatgcccctttaccatctctttctttgccctctcggatgtcatcaaccttgcatcctcattgtacggtttggaggcgacaggaactcctgcggttatgctggaggtactcagttattttctacaaaatgtggcttaccgtggcctgccgccccgcatcgctttgcgccactccccgagcagacataaacatcacataggcatgcaagggatgccgctctcccgcaccaaacggcacgcgatggcaacagatgccagacaaggggcaggcgatgagagacgacatcttccagatgaggcgcgatgcgtccctcgtcggggttatcggcgataatgcagccgagggccgcggggatgctggggctagcaaccgggaactgccttgccactcacgctcgctagccagcgacggacttcacccactctacaagctgctcgtaggagacggacccatcggcgatcccgagcatggtgcggaggaactcgtcatggggaggctcgaacgtatggcccgtgagccgcaggcaggtgccgagcagggccgcgcccgtgcgcttgtttccatccgcgaacgggtggtcggctacaacgccgaagcaaaggcggcacgccttcgcgatgtcgccctcgtagaggtcggaacccccgaaagtctgatagggctgggcgagggcagagtcgagcatgccctcgtcgcgcacgcccgcaatgccgccgaacctatcgatggcggcatcgtgtatgacaatcgcctgttctttggtgatgacggcggagcttctcacttggccagctcggtaaaaacgtcggcgtactcatccatgaaatcaatcgcgacgtcgacggcgtcgtccttggcagccgcgctcgccggttggatgacgacccagggcttgttgtttttcagcaccgtgaccgggcgtccggtgcggttcacctccgcagtaaccttcgagaagttgttcttcgcctccgcgaggcccatcgtgatggcagccatggccgctcccttcgaactcgtaatagtatagccataattatagacatacaactggctgatatctatggtttacgggttgcgttggagtgagagaaatctagattcgcaagacctcctatacaactcaaaaggcccttcccgccatttgcgggaagggccctggtggcgttaatggggttgtgcacgcgaaaatgctattcgaactcgcaaatgaaatatagattttaagagccttcggtagtttatgtggcccggagctcggctaggcagccttcgccttgcctgccttctccttcctcctcttcctgtcgcgttcccggtccttccgcttctcctccttccggtcctcccagggcagcgcaggctgctcgtcggagcagcgcagcatgatcagcgctatgaggttgtcggcgttgcgaaatccgtatccgctggctatggtgaccttgatcttgtggttgatgctctcgacgcgcccgttgccggttccgagattcacggcggctatcacgtcggcatgcctgtgcctcactttcttctcgactgcggcgacgggcgcgatcctgcagtatgcggtggccttcagccaggcatcgagcagcccttgtgcctcatgcgcatcctttgcgcggaagatggccctctgcgcgcttcagctctaagagccgctccctctgccgcacggtcaggtcctcaggggttcttcgcgagcgcatagctgctccccttgatgcgaaaggcctccgccgagaggctgcgcgccctgggcctttgcggccctcgcctgcctgtctgcctggtgcgcggcctgccattcgtcgcgcctcacctggtcgagcgcatcgtttatccattcgaccacatggaaggggtccatgacccatcttgcattggggcagcgcttcctgaccagctcttctatccacttcgctgcgtctgccgtgacgacctcgatcgagcttttctgctcgcgtgtgagcccgtccaggaaaagcgacagcacctccttgccgtatccctcgtgtgcccagacgaggcatcccagatcatggtcgacaacggccgtgaggtatctgtggcccttcttgtagctcgtctcgtcttatgcctttgcgcctcaggccgtcgatgtggccctgtccgcgtgcagcctcgatctcctcctacacccgcctgcagatgccgcccacgctcttccactcgatcctggccagccttgcagtccatgagagcgggctgtgaacagcaaggcacgccacccagtccttaaagtcgcgggtgaacctcgatgccgcccttgccccacggcacgcgctcgacgagcactgcgtgctcggggcagctcacgcgtgcggggcgctacttaaggtagcacctcgaggaggcgagctccatcgcccttcaccgcctcgccggcacgtggtcgtggcagctgcagcaacgcccgcacaccgggcacctcagctgctcgcgcctgtgcggcctcacccgcacgactatcgagtcccccttatcgcggctcccaccacgacagtcttcacaagcgacaggacgtagtgcagaatcgttcccatacgcctgtctccctttgcatcggatgcatttgacgaagtgaaatcctttgggaaaacggcgcggggcggccccttacggggccgttcgtcttgagactgcgtgttttctgcatgcgagctgcgcaaagctatggcgggctacccacacaaactaccgaagactcagattttttctcccacttcctgtagcttgctcccggtctgcttgagggtggcgaagatagaggagtcgggttctttgcctcttttcccaggtttttcagttcctgctccgtctcaatgatctccctccgccaggcatcgtattgctgctgggtgaccgagccgttttttaagcccgcgtccatctggtcctgcacggacttcagttgggtgagcttgttctttgtctcacctaccgcggactttaaaagttcctgtttctgggcaagaagcgtggtgttcgtcggatcgagctttaagagcttgttcacatcttttagctgggactacgtatttcggatttccttgttgacgccggagagcgctttcgagaggccggtcgtatcgccgccgatctcaacggttattcctcgaaaatggctgagtacctccagcataaccgcaggagttcctgtcgcctccaaaccgtacaatgaggatgcaaggttgatacatccgagagggcaaagaaagagatggcgaaggggcatgcaggcgctctgagcaggcgcgaatgcgagagcaaagagacattgatgggccttctggagaggttctcagacgaggagtcgtgcgaggggaggctgctcgatgagaaggtctccggcggctttgtctgcccggtgtgcgccaatacgtcctgctcgaaggtctgaggccgcgcgcacaagtggcagtgcacgaagtgctcgcaccaggtgagcgtgagcgcagggactattgatggagggcacgcatctcgagctcaggaagtggttcgtgggcgatatggctcatgtccgcccagaaggcaaggatcagcgcctgcgccctgcagaaggcagataggctgcagcttaaagacggcagggcgggtccttttaaggatatactcgcctgggtcagatcgcagtgcgttcagtgtccttgcagctgacacgc

SEQ ID NO: 399 - DNA, 26150 bp, Unknown
  Metagenome-assembled genome
agggccggactcaagaactgcaggtcgagagatggggcatcgctaatgagatgggggtggcaggatcgcgctttgcaggtgagcccaagagatgcttaagtgcacattctgcagaccctcttctgtaaggggcacatctgcacaaggccatcatggaagtgtttgcttcatgttgcaggacccgttctcagcgacgaagcggtcggccacagcgatatcgaacttttcatgccaccgcaggacataagtatgtgcaaagacacgctttgtgggcatgttacttaaactagcttatcgaagaactgccatgtcgagccttagaggacatcgtgtgggtgtccaatgcaccttaggctctttgagactgtagtggttctgctcctggaaagccctccaagaacgcccatatcgtcgcgccaggcagaaggggcctctcatgcatcgaatgcgaagggctaccggcgggcggcgctgcggtgagggcaatgttccgattgtgcataacccacatctgggtaggttgtggatgggcgtgggggggggattgtgtgtagagtgcggtgggtatacgtcgtaggggttggttggggctgttggggatatggggaaggggggttggttgggtgaggtttgctcggctgcctcttaccgtagttgcttgcgggcagcagggcaagtcggaaaaaaaattgcaatcgtcgatagcacacacggccacggttatgcctgcactcaagcggctccgtttctcgatgtctttgtttggtgacatgcattgtaggcaaaggcccggacaacactggacccttctcaggtcaatcgtggtctaacagagagaaagatttaaactgaaaaggaaagaagacagggtaaacaacgtttaagttttgatgtgaggcggcaatggatatttcgcgagagacagattatgctctccgtatggtagcagcgcttataaaccatcccggtgacaatccatcagtgagaagcgttgccgaagagtttgggatcccgtattcgttcgcgcggtccatacaacattctctgactgaggctggcgttatcgtcagtacccgtggtgcccacggcggcatgtatttagcgattgatcccgatcaagtcacgctgctcgattttgttcagatgctgcagggccccgttctgctatccgcatgtgaaacctgcggtgaaaatggtgaggattgcccaggtaagccgtactgtacgtacgacccaatttggatgtttgcacaggataatctacgtaaatacctctcctcattcacgctgagggaagccgcgaatggtattggccctgccaggttgagagaactctcaaacaaagaattggaagtactcgacttcaagaaggaagatacgcctgaggatgactcggacgacgaagtggctggctgcattcagatactatgaggagcacccctacatcgagggagctcgctgcctttcacaaggaagtcctgcaggagggcagaaagctctaccgtgatcttccttggaggcacacacaggatccctatgagatctggatctccgaagtgatgctccagcagacccaggtgtcccgcgtcgagaagcgttggcctgcctggctcgccgaattccccacgcttgagacactggcgacagctacacgcgcccaggtgttgaatgtgtggcaggggatgggctataaccggcgtgcgctcgcgttgctgcgcgctgcacgccaattggttgatgcgggcgcttccatcccctcagaggagaatgcactcgtggcccttccgggcattggggctacaactgcagcggggatccgcgcctttgcgttcgatcttcccagcgtgtatctggatacgaatgtgcgctctgtcttcctgtattatttttttcgtggagaaagtaaaatctctgatgcaatattgcggccgattgtatgcgccacctgtcccaagaacgataccgatccaactgatgatccgagaacttggtactatgccctgctcgatgttggggcttatttaaaaagaatgattcctaatccctcaagacaaagcgcttcgtattcgaggcaatcaaagttcgatggatcgcaccggcagaagcgtgcagaaattttgaaaataattttgggggaacctgaggggataacgacagagggtattgcggaccaggtaaatgaggttgaggagtgcgcaggtaggccgccagtgagcacgcacgaagtccaaatgattctaaacgagctacaaaaagaagatttttgtaggtttaatgataatgatgtatggttaacctagcggatataggatgtagagctgcggtggaaagggaacttaccgcaaacagagatagatacaccgtgtaacccaaaaaaggagcgttgacatggctgtaaactttgatgagtcacagactaagaagaaccttgaagcggcattcgccggcgagtctcaggcgagtgtgaaatattcctattttgcaaaccaggcaaagaaggacggctacaaccagtacggcgacatctttactgagacttccaacaacgagagagcccacgcgaagatgtggttcaactacctgcacggtggcaagacccccgacaccctctccaatctgaaagaggctgcaggtggcgagcactatgagtggaccgagatgtatccgggcttcgctgagaccgcacagaaggagggcttcactgagatcgctgccaagttccgtatggttggcgacatcgagaagggccacgacgagcgctacaacaagctgatcgagcatgttgagaagggcgacgtctttacgcgtccgggcgtcaaggtctggaaatgcatgaactgcggtcacctgcatgtcggcccgacggctccgaaagtctgcccggtctgcggacatccacagtccttctttgaggagcagtgcgtcaactattaatggtcgtaagcagtgaattttgctgattgccagcgtgtctggagtatctctccggacacgttttttgttatattctgcctgattgatagggctatcaatttcatagataactgacggcaggatctgagaatagcgatgtggagctcaaaactctaggcatgcgctagtatttcggtcatggaaacgttgattcagacatacacgagcaggcgaatgattgagcccgggttcttctagaagccgcacgggcggcacaggaccgcgggcaggagacatccccttgaacacgtttggaatacacgcctcaaacagaaagcgagcagcacatgcctttcgaactcaaccctgattttgtcaaagaccctgagaaacattttgagactctgcaagttcacgccgggtggtctcccgatccggtcaccggttcctcagccctcccgatctacgcctctgcagccttccagttcgacgatgctgctgacggcgccgcaaagttcgcactgaccaagccgggcaacgtctatggccgtctgaccaataccaccaccgacgcgcttgccgcgcgtattgcagcgctcgaaggcggcaccggtgcagtcgcggttgcctccggacacgcggcagagatcctggccctcaccaacatcgtcgacgcgggtgatgaaatcgtcgcgtcgagctcgctgtacggtggcacctggaatatcttcctgcacacgctgcacgatcttggcgtcaacacgacaatcgtcgacaataacgatatcgacgcattcgttaaggcgacggatgagaagacgaagctctggtacgtcgagacgatcggcaacccgttggtcgacgtcgcggatgtcccggcgctcgttgaggctgcgaactcgctgccgtccaaggtgccggtattcgtcgacaacacctttgcgacaccgtacctgtatcgcccggcagaggacggggcggcggttgtgatcgaatctttgaccaagtggatcggcggacacggtgcagccctcggcggcgcagtcatcgacgcaggcacctacgattggaaggctcaggcggacaagtatccgacgatcgccggaccggacccgtcctaccacgatatggtctttgccgatgcggccccgaagaacccgttctcgacgcgtgtgcttgccaacaagctgcgtgacttcggcccgacgctctccccgtatgcggcgcaggtcatcgcgctcggtgcagagaccctctcgctgcgcgttcagcgccaaagtgaaaacgcgctcgcagtggcaaagtatctgaaggacagtccgaaggtcagctgggtccgctaccccggcctggaagacgatcctacccacgatattgcaaagcggctcctgcatcatgggtacggcggtgttgtcgtcttcggcgtcaggggcggccgtcaggcaggcctcaatgtggtgaacaacgtgaaactcttcacacacctggctaacgtcggtgacgcaaagtccctgatcatccatccggcttccaccacgcactcccagctgacccctgagcagctgaaagaggcgcacctctccgaggatctgatccgcctttccatcggaatcgaggacatcgacgacattatcgccgacctcgaccaggcgctggcaaaggcgtaaccgatcaggcgatacaacctagtgctggtttgcggcattccgcttgcgcgagcgagatgccgttttctttgaggtgtgcttgccgtgcttgcggaaccggtcgggattgccaaacgaggggcacagatccgccaggggacacccgtcacagtgcgggtgctgcgagctgcaggtttcacgcccgaagtggatccactgctcattgacggggctccagagctcctgagggatgagcttcaacagatcctgctctgccgccagcggcgtcgaggctttggtgaaccctaagcgcgttgcgatacggaagacgtgggtgtcgaccgcaataccctcggtaatgtggaaggctctgttcaagacgatgttggcggtttttctgccgacgcccggaagtgacgtgagttcctccatcgtgtgggggacctgctcgttgtagtcggaaaccaggatctgggccgtctcgacgcagtgctcagcttttgtgcgccagaatccgatagagcggatgaccgtccccacctcagcgggatcggctggcgctaaggaggcgggatcgggccaacgcctaaagaattcgggggtcactttgttgacggaggcgtcagtcgactgcgcggaaagcatgacacagatcaacagcgtgtagggatccgtgtactggagtgcactcccgacatccccgtagagagcctgcatgcgatggcaaacttcgatcgctctcgcacgcttaacggcgaatgactccttaggcataatttactccttctgataaacgggagtatggtagtttatcttctaaataagatacggtgacacaggctcactatacccgtttagaagtctcgttaccctccgctcgggcaacatctgcgcggcgagggcgccaaagagacgtaagataaatcgaggctctcgaaaatgaggagggtttatggctcttgagacaaaggatccgacatatgtgatcagctcggatgacttgtatctgatggctcagggaaactggtatcgcagctatgacaagttgggggcgcaccccgctactcaagatgggcaggatggctacaattttgcggtatggtgccccgatgttgtttccgtctccgtcgtcggagaattcaacaattgggatcctaacgctgaccatctctatgagacgaagactggtggagtttggaccggctttatcccgggagtacatcaggatcagtgctataaatacgcgatcgagccgcagcaaggggcagagctcatccataaagcggacccgtatgccttccatgcgcagtgcccacctaacaccgcctcggtgacgaccgatatcaacacctatacctggaaagacaacacctggatgaagcgacgccacaagcgcgtcatgctcaaagagccgctcaacatctttgaagtccatttgggctcctggaagcgccacgatgatggacttgagggtaaccatacgcagccgcctgagggcgagaccgctggcggctcatatctgacctacgacgagctttcggtcgagctcgtagactacgtcaaaaagatgggctacacccacattgagctgctcccggtgatggagcacccgttcgatggctcctggggctaccaggtcaccggatactatgccccgacttcacgctatggctcgccgacggagttcatgcactttgtcgacgcctgccaccatgcgggcatcggcgtgatcctcgactgggttcctggcggcttctgcaaggacgcccacggcttgggacgcttcaacggccagaagctgtacgaggagaaggagcaccccaactggggtacctacaagttcaatctgggccgcggcgaagtcaggaccttcctgatctccaacgcgctctattggatcgctgaataccatgcggacggcctgcgcatggacggcgtgagctccatgctctacatgaacttcggtatcgatgacccggcgcagaagcgctacaactcaaagggcaccgaggaggacctgcaggcttctgacttcatccgtaagaccaactccgcggtgggacgctactatcctgacgttatgatgatcgccgaggagtccacggcctggccgctcgtcacctatccgcctgaggtcggaggcttgggcttcaacttcaagtgggatatgggctggatgaacgacaccctgcactactgccagaccgacttcccgtaccgtccaaagaaccaccggatgctgacgttctcgatcatgtacaccttcaacgagaacttcattttgccgctctcgcacgacgaggtcgtgcatggtaagtgttcactgatcggcaggatgccgggagactactggcgccagttcgccggtatgcgtgccctggcgctctaccagatgacccatccgggcggcaagctcaacttcatgggtaacgagatcgcccagtggatcgagtggcgtgagtatgagggcatccagtacttcctgactgagcagcacgaggcgcacagaaagcagcaggtcttcatcgcggcactcaaccatctgttcacgagcgagcctgcgctgtatcagcgcaactatgactccgcaggctttgagtggatcgacgcggacgacgacaaacagtcgctcatctccttcatccgcagaggtgacgacccgaaggatgacctcgttatcgttatcaacttcgacgtcgcagcgcatgaggacttccgcatcggcgtcccgcgctccggcatctacaaggagatctttacgagcgatgcggagaagtatggcggctccggcatccacaacaccggcaagctcaaatctgaggatgagccctggaacgggcaggacaactcaatggtcctgcgtgttccggcgctcggcggcatcgtgctgaagcgcaccggtgacctcccgaagcccaaaaaaactgcgaaaacagcgaccaaaaaggccggaaccgcagcgagagctgcaagaaagcagaagaccgtagcgacaaaaactacctcaacgaaaaagcaaactaaatcttcgacgcgctctggtgtatcctcaacaaggaagacaagaagtgcagcgggcacggctggcacaaaaaagtcttccaagacgaagtcacccaagaccacacgccccagcaaaggcagtaaggcttaagctgcgctggtatagaagaaaggtagttatggcaaatctcttcaaaagcaacaaagctcctaaagagcctgtaaacacgctgtttaagagcaagcaggatttcattgatcagctgcgggatatgtgccagaccgagcggtcgcgcacgtttgaggagtgcaccgatcgcgagcgcttcctgtgcttagctcgtctcatcgcgcagaaggcgcgccacattgagggcagctgctgcgagagggccacgaagcaggtgtactatttctccctcgagtttttgcttggcccactcctggacaactatctgatcaatttcggaatccgcggctttgttgaggatgccctgaaagatatggggacagaccttgagacgctgtgctcaaaggaagctgacccgggtcttggcaacggcggcttaggacgtctggcagcgtgcctgcttgactccatggctgccctggggatctatggcaacggcaacggtatgcgctaccactatggtctcttccgtcaggagatcgtcggcggccgacaggttgaggagactgacaactggctgcagtacggcttcccctgggaggtcaggaagctggagagcaagatcgttgtgcgcttcggcggtgaggttatccgccaccaggagggtggccactactggtacacctgggaaggcggacagaaggtcgacgcggtgccgtacgatgtgccgatcgtgggctacggcggaaagaccgtcaacaagctccgtatctggggtgcaaagccgcacacgcctgacttcgatctggacgccttcaacgccggtgactatgccaaggccttcaagtcccgctcggatgtcgaggctatctcgacgatcctgtatccgaacgatgcgggagagcacggacgcctgctgcgcttaaagcaggagtacctgttcgtctccgcaggcattcagtcgatcctcagatactatgagaagcaatatggggatgcctggaaggacctgcccgaccacgtacgcatccacacgaacgatacacaccctgcactgtgcgggcctgagctcatgcgtatcctcgtcgacgaaaagggactcgactgggacagcgcgtgggatattgtgacccacaccgtgtcctataccaaccacacgatcatgcctgaggcgctcgagaagtggccgatcagcatgctgcgcgcccaggttccgcgtacctacatgttcatcgaggagatcgaccaccgctaccgtgagagtttcccgcacgacgcgccgaactggaaagaccagctccagcgcacctcgatcctgtgggatggccagtgccggatggcgaacctgtccgtcatctgctcgtattcagtcaacggtgtctccgcgctccacaccgagatcctggagacctcgacgctgaaggacttctatgatctgaacccggagaagttcaacaacaagaccaatggcgtatcacaccgccggttcctgggtgaggccaacccggcctactcaaagctaatcaccgatgcgatcggcgacacgtggatggctgatgccaacgagctcgagaagctgatcccctatgagcaggatgaggacttcctgaagcaggtccatgaagcaaagcaagcgatgaaggtgcgcctgtcgaactacatcgccaagaccatcgacgtgaagctcgacccaaacagcatcttcgatgtacaggtcaagcggttccatgcctacaagcgccagcttttgaacatcttcaaggtgcttgacatctacaaccgcctgctgaatgatccggactataagccgcaaccgacgtcgttcatattctcaggtaaagcagcacagagctacgattttgcaaaggaggttatccgtcttatcaattccgtcgcagatgtgatcaaccacgacgatcgtgtgaacgacactatccaggttgcatttgtgccaaattttgcggtttccaatgcgcagctgatctacccggccgctgatatctcagaacagatctccaccgctggcaccgaagcttccggtacctcaaacatgaagctcatgtacaacggtgcgattacgctcgggacctatgacggcgcgaacatcgagatcgcaaaactggtaggagacgagaacatcaagatcttcggtctcagaactgaggaagtgaacgacctgaaggcttccggttactatgcgtgggatgagtacaacgcagaccgtaatcggttgggcagggtagtcgacgagctggtcgatggcacgctcagccacctctccggcaacttcgagagcatccatgactacctgatggtcaacaacgaccccgaccttgtcctgaaggatttccactcctatgtggatgcgtgggaagagctttccaacgattatccagacacgatcaaatggaaccgtgcggccctccacaataccgctaaggccggatatttctcttctgaccgtactatccgggaatatgcgcgcgatatatggcatatagatattgaggagtaatgtttttccatgcactgaaaagtgctgagtaaagctgaaaggggagaagtcagcatgagtaagaaaaatgaatgcttagctatgcttcttgctggcgggcagggttccaggctcaaggctttgaccaaagaggtcgctaaacctgctgtttcgtttggcggaaagttccgcatcatcgacttcgcgctgtccaactgcgccaattccggtatcacgacagtcggtgtcttgacccagtatcgcccctatctgttgcactcctacatcggatccggtgaggcatggaatctcgacgtcagaaacggcggcgtctccatccttccaccgttcgcgacccagtcaggcggcgcgtggtacgagggcaccgcagatgcagtgacgcagaacctcggttacatcgaacacaacgatcctgactacgtgctgatcctctccggcgaccagctctaccgcatggattacaacgatatgcttgagaaccacaagcgccataacgccgatctgacgatcgccgttatgccggtagcctgggaagaggctccgcgtttcggtatccttacgactgacgacgatgagcgcatcctgaagttcaccgagaagccggcgcatccggattccaacctggcctccatgggcatctacatcttcaacaaggacctgttggttgagaccttgaaagaggatgcaaaggatccgaactcctcgcatgacttcggcaaggacatcatcccgaagctcttaaacgagggcaagcgcctgtatacctaccgcttcgagggcttctggcgtgacgtgggcaccatcgcctccttccacgagacgaacatggagcttctgggctctgagccagccttcgatctgtacgatcaggcttccccgattatgtccaacaccgtcccgatgccgccgcactacgtcggttccgacggctccatcgatgactgcatcgtggacaatggctgccagatctacggagcagcgaagcattcagtgctttcaagcggtgtctatattgggccacacgcggtggtgcaggactcagtcctgctcccgaatgcccgcgttgagcgtggtgcgcaggtcgtgaacgcgatcctcggcgagcgtgcggttgtcaaagaggacaccgatttcggtagtagtgacgaagatacagcagtcgccggaaacgatgctgtatgtggaaaggaggagtaaccgtgcctaaggtagttggtttaatcacttccaattattcagtcaaaaatccgagcccattcgtagagggcattcggccggttgccgccgtcccgttccttggcagatatcgcatgctggactttacgctgtccaacatggtgaatgccggtatccgtacggtcggtctcattatgccggataactatcgtcccatcattgaccacgtcggcgcaggcaaggactgggggcttgaccgcaagaacggcggcctcttcccgcttccgggttcctccttcggcaccagccgcatcggcgtagggggtcgcttcctcatccgtgattttgagtcgaaccgtgagttcttcgagcggtccaacgctgactatgtgatcctttcgagctgcaacttcgcctatacgaccgacttgaacgagctcgtgaagtcacacattgactccggcgctgacatcaccctggtggtctaccgctccatcgaggattccaaggacgtcaacgcaatcgtgaccgacgacgacggaaacttcgccggtctcaagagcggctgcgccttcggtgagaccgcctttatggacctggccgtcgtgaacggaccggtcttgagagagctcctcgactggtacaagaacgtcgatcacctcgatctgttcgaggcaatgacgcaggacctctccatggtcgatagtaagctccacgagtatcagggctacgtcgccccgatcttctcaaaggcggcttacttcaagcgctccatggaactgcttgacccgaaggtctccaaacaactcttccagccggactatccggtcatgacaaaggcgcacgacaccacgccggccaagtatgagccggatgcccatgtctccaactgcctggtttcctcaggctccaagatctacggtaccatcaagaactcaatcatcggccgcgcctgcgtcattgagccgggagcttccgtcaccaatgcgatcctggtccgcagcgtccatgttggagctggcgcccacattgagaacgcgatcatcgaccgcagcaacgatatcgccgaaggtactgagatgcgcggtacgcctgaatcggtgttggtgcttccaaaaggcaacgactagaacgacaagtaggcgtaagcgatacgttctcaaaacaaatggaagataagatgggtgattcaagacaactcaatgtactctttgcctcttccgaggttgttccgtttgtgaagacgggcggattggcggatgtggcaggctcacttccgcgggccctcaaggacgccggatgcaatgtgtcggtgatcatgccgaagtactctcgcatcccggatgagtacaaatacaatatgcagcacatctgtgagttctacgtgccgctgagctggaggaacgtctggtgtggcatcgataaactcgcctacaacggtgtggacatctacttcgttgacaatgagggatatttcaagcgcgacggtatctacggatactttgacgacggggagcgcttcgcgttcttctccaaggcgatcctcgagtgcctgcagtacgtccctgagctcaacaacatcgacatcctgcactgcaatgactggcagactgcgttagccccggtcttcctgtgtgagttctaccatggggtcgggaactacgacaacatcaagacggtcttcaccgtccacaatgcgaagttccaaggccagttctccaaccggatgctcaacgatgtcctagggctcggcggtatcccggctgcggcagatcagctctactgcgaccgcgactcgatcaactttatgaagggcgcgctgtgctacgcagacaggctcacgacggtgagcccgacctacgcttgcgagctgcagatgccgttctacggcgaaggccttgacggtatatttcgcagaaggtccaatgtgctctccggcatcctcaacggtatcgatacccaggcctggaacccctccagcgattcgcagatcgccgcctactactctatctacgatatgagcggcaaagcggagtgcaagcgtgcgctgcaggaggagctcggcctcagacaggatccgatgcggcctctggtcgcaatggtcggccgtctgaccgagcaaaagggcatcgggttggtccggtacgcaatggactacctgatgagccgcagtgtccagatcgccgtcctcggcaccggcgacaaggatctcgaagattcgttcaagtacttcgattggaagtacggcgacatgatgtctgcccgtatcaccttcgacagcgcgttgagccaccgcatgtatgcaggtgcggatctcttcctgatgccttctgagtttgagccctgcggcctctctcagatgatcgcaatgcgttacggcaccctgccggttgtccgtgagaccggcggccttaaggatactgtgaagccgtacaacaaatacacgggcgaaggaaccggcttcagcttcgccaatatcaacggcgatgagatggtgggagccctaatggacgcctgcgaggtattctggactgaccaagacgcgtggaagaaactccaatatcaagccatgactcaagattttagttggagaagagctgcaaatgactatgtaggcttgtatcatagtctccacccggaagtatagaggtaaaatattttccggaattcattcggagagaaagttgagtcagtttgcgcgttcaacacacgagctctaatgcgtatttccgcaatcctgtcggtgctgtccctgtgggcagcaccgtttacttgtctctagacatttgggatgaccccaacgccacagcccagatccgtacctgggtcgatgagcgcggagagacgctgattgatatggatagacatcaggagggcgatcgcctgcatttcaccggcacgatcactcttgatacgccggagcttctttggtattacttcaaaatcaaagccggagatggtgggacgtgctattacggcacgctcaataacgctacaactggagaaggcatactctatgggcatgaaccttccagctggcaggtaacggtgtatctgacccggcaggtcaggccaaagtggtggttaaacggaattgtctaccagattttcccggaccggtttaaccgcgggaaggattggaaggcgcgtgtccagaagggactcgtcgaggactgtaaggaccgcaaaggccccggccactatcttgtcgaggattggaaccaaccggtccgctatcaaaaagatggggatgggcgtgtcaccagttgggatttctatgggggtaccctggaaggcatcaccgagaagctcgactacctggcggcgctcggtatcacggttctctacatcaacccgatctttgaggcctcgtccaaccaccgctatgacaccgcgaactttatgaagatcgacccgttgctgggcgacgatgagagcttcgagcgtctgtgctccgaggctgccagatacggcatctcgatcatgctggacggtgtattcaaccacaccggctgcgactcggtctatttcaataagtacggcaactacccggatgtcggcgcctaccagagcgctgactccccctaccgcagctggtaccagttcgatgagaacggcaactatgccagctggtggggcaacggggatctgcctgacgtcaatgaaaaagaccccggctaccatgagctgatctgcggcaaagacggcgtagtccgccactggatgcgcctcggtgcccggggatggcggctcgatgtcgccgacgagctgccggaatccttcatccaggacatctacagcgcggctagagctgaaaaatctgacgcctgcgtgatcggcgaggtctgggaggatgcctccaataagatctcctatggatatcagcgccactacctcttaggtaacgagcttgactccacaatgaactatcccttcaggggagcggtgctcgacttcctgctgaataaggtcggtgccccggagaccgtgcagcgttttgagcagctgttcgaaaactatccacacgacgctttctacggcgccctgaatctgctcggaagccatgaccgatcgcgtgtactcacgcttttgggtggggcgccgaacccggattcgatggacgacaatgcgaagttcaacttccgtctcagcgacggtcagctgagcctagcgaagagtcgcctgtgggctgcggcgttgatgcagatgacgatgccgggtgtgccgagcgtctactacggagatgaggcaggctgccagggctataccgatccgtacaaccgtgggaccttcccctgggatcgcatcgatcgggactgcttcaacatctaccgcaacgcgatcggcctgcgcaagacgctcccggtcctcacgaacggtgacttcaagcccttcgcaatcaacgataacgtcttcggctacacccgttacaacgacgactgctgcgtgatggtcctcgtcaacgcaagcctgagcgagcgtgcggacttcaccgtcgatatgcgctacgacctcgtcgacgacgtcgtgagcggcaagaacatcgaggtaaaggacggcaaagtccaggtcggcatgtggccgctgggcaccgtggtcctctatttccgtaaagcctcaacgctggcaaagccgcttgagcccggcgccggtgtcctgtgccatatcacctcgcttcccaacaaagcggggcaccagggtacgctcggcaaaaatgcgcggcgcttcgtcgactacctcgctgacacgggggtgcgctattggcaagtcttaccggtgagtccctgcgatcaatacgggagctcgtatgcgggactttccgcctttgcgggcaacaccgcgctggttgaaggcggggagaaggagcttaagaagcaggctgagcgtatcagctgccttgaccccggctttagggacttctgcaagcgtgaggaagtctggctcacgccctatgcgctcttcagggcgatcaaacacctgtgcagagagcttccctggcagaagtggcctaagaagtggcgcacctatgatccggagcttgagcacgatccgaagctcaaagccgaggtggcaaaacacaggaagcgccagtacatcttctcccgtgagtggggggatctccaccgctatgccaacagcaaaggcatctccatcatcggtgacatgccgatgtacgtctcgctcgattcctccgacgtgtggagccaccctgagtacttcatgttggatgaggacggctatgccgcggagatctccggctgcccacctgatcagttcagccaggaagggcaggtctggggcaatccctgctacaactggcagaagctgaaagaagacaactacgcctggtggctcaaccgcctgcaccatgcgagcaggctctacgattacgtacggcttgaccacttcttgggattctcgtcctactacacgatcgcagagggcaaatccgctaccgaagggcagtggaagtatggcccaggagcggatctgtttatccgctactgcaaaaagtacggaccgctcagtgctatcgcggaggatttggggaatataacccctgcggtgagagcactgctcgcccgcaccggatttgccggtatcgacgttatccagttcagcgatgaggacgtgcggcagggctacactccggcgcaccacaagatcagctataccggcactcacgacacgcagacgctcaggggctgggtcaccacctgctttccagatgcggatgccgatgagctgaccgctcagctgactgagcgggtactcaagagtgacgctccggtcgcgatcatgcccctgcaggatgtcttggggctcggcgatgacgcgcgtatgaatgtgccgggtgtcgccgaaggcaactgggcatggcaagctacctgggaacagattgacggtgccaaagagcatctgactgagctgatcgaagcgtcggggcgttcgacacacaagcgcgaaggcgcgccatcggacgaacagtgactgtttggtatggagccacaaaccgaaaggcttgtggctctcgtgcccctgtcggccgtgagaatccggctctagaatatctatggaacccttaagtgaggtaattcttctctatgtttattaaccgtgtggcgaaaaagctctatacggctcctgaactgcgcaaaatcttgccggattttgatcacggaaacgacgtgaccctctcggtcggacagagcgcccgacctttggtcttagccgctctctggtcgcgcagtccccgccctacgctcttagttgtttcaggggaggaatccgcggagcgcagtgcccacgccctcgccgcttggctcggtatggaaaacgtgctgcgctaccccgagcgcctggactatccctggtccgacagagcgccggacatggcgctgattggtaaacgttgccaagcggttgatgcgctctccgcaggcaagccttgcgtcgtggtggcaagtgcgagtgccctgatgcgccgcgtgccgcctaaaggctcaggctacttcgcttcgagcacctttaaggtgggcgacgtggtacctctcgaagaggtttcacccttgctggtcggtatgggctacgcgcaggagcgcgatgtgaatgctccaggtgaattctacgtgcatggggacagcgtcgatgtccatcccgctcaggcgacttcgccggtgcgcctggagttcttcggggatgagattgaccgcatccgtcgcatggtgccttcaaccggtcagacgatcggtgagctcaaagaggtcacgatcctgccgtgtcgggagatggcgtactcgcctaagcgcatcgcccgcgccactgagaagctctatgcgcaggcgcagatgaatacgaaggtggcggaggatctcgagctgatcaagcaggcctcgagcgcccctgcgcttgaccgctatatgccggtgctctatgggggatctgcctctcctttggagttcatcgcgaccgacaccttggtgtgcctcgctgagccgcgggcgctcttcgataactgtcagcgagccttcgacgatatcacctccgccgcgcagagtgcgggcgagcatatcgaggggctgtatacggctccgcgtgagatggacttcggcaagcagcagcgcctgtcctttgcctcgatcctgcagcaggggacacgcttgagtactacgcttcgagtccatcatcccaatatcgcgggatcagacacgaagctcacaggctcagtgcgccagatgctcaacgataagatgtcggtgatcttcgcggtgcctgaccgtggggcacgcgaagcgttggaacttaccttcaacgacgaatccatcccctttatcgagtctttgggtgccgatccgaagaacagagttcctgtcctggatcccatggcgaacaccgatgtggtgccgctgccggaagctgaagtcaccttctttgacgcgccggtcccggcgggcatcattattcccaccgccaagttgggcgtgctttcgatctccgacctgacggcccatatggccaagcaccatcaccgcgtgcgccggatcgacccgacgagcgtgaccttcccatttaagccgggcgactacgtcgtccatgcgacgcacggtatcgccctcttcagcaagatcgtgcgtcaggaagttgcggacaagatgcgcgactatttcctcttgcagtacgccggaggggacaagctctacgtgccgctcgagcaggtagaccgcatcactcgctatgtgggacccgacggggaagccccacggctcacccggctcaacaccgctgactggtcacgggcgactggtaaggcgcgcaagagtgccaaaaagctggccttcgacttggttgatctctacacccgccgtgcctcggttgctggattcgctttcggtcccgatactccggcccaggaagagatggagtcaagcttcccctatgagctgacgccggatcagaagtcagcgatccaggacatcaaagcggacatggaatcccccaaaccgatggaccgtcttctgtgtggggacgtggggttcggaaagaccgaggtcgcgctgcgcgcggccttcaagtgctgcacctacaagaagcaggtcatggtcctctgtccgacgacgatcctggctgagcagcacttccagaccttctacgagcgcttcacgccctttgaccttacggtcaaagtcctgagccggtttgtcacgccggcccagcagagaaagaccctgaaaggctttgaggacggatcggtggacgtgctgctcggaacgcatcgcctgctctccaacgatgtgaacccccacgatctgggattggtcattatcgacgaggagcaacgcttcggcgtgcaggcaaaggagcagctcaagaatctccgtgagcaggtcgatgtgctgaccctcaccgctaccccgatcccgcgcacgatgcagatggcgatgagtggggtgcgcgacatgtcgctgatcatgacgccgccactgggaagaaagccggtcaaagtgagcgtctctgagtgggaccctgatgtggtgagtgcggcgatcaggcgtgagatccagcgcaagggacaggtgtactatgtctcgaaccgtgtgcagacgatcgacgatgcggtcgagcgcgtgcgccaggcggtgccggaggcgcgcatcggtgtagcgcacggaaagatgagcccccgtgaggttgaggacattatgatgcgctttgaggagcacgagattgacgtgcttgtctcaaccacgatcatcgagtccggcatcgataacccccacaccaacactctgatcatcgaggactcacagcgcttaggcttggctcagctctatcagctgaagggtcgcgtgggccgtggcggaacgcaggcatacgcctacttcatgttccccggagaggtgccgctcacccctgaggcacaggaccgcctgaccgcgatcaatgagtaccaggacctgggaagtggcatgcgcgtcgcaatgcgcgacctcgagatccgtggcgcaggttcactggtgggagccgagcagcacggcaacctttcctcggtgggcttcgacctcttcacccagatgctgggtgaggcggtgagcgaagcgcgcggagaggcgccctcgatggatcaggacgaaatcacgatcaatctgccggccgacttctatctggctgaggagtacgtcccggcaatcgataaacgtgtcctcatctaccggcagttggcttccgcacaggagctgcgcgtcgtggacgaactgcaggagcataccgaacatggattcggggcactcccgacagccggaaagaacctcttcgaccgggctcggatccgcatccgtgcacagcgcatggggatctcggcgatctcgctgatatcaggcagattggtctttcagggcatcgaagtcccacggaacaaagcgcgggatttacgggcaaagcacgcgctctactacgccaaaagcaaactgctccgctatcccttccacaaggaaagcgaggacctcctccccgccgctttgggcatattggaagacattggcggaggagacgacgaggacgaagaggcaagcgcgtagaatgcttgcggagatcatctccacatacccgttcctgatatacagtaagtaggcacaggctgtagacaaacactaaacgaagcaggcagctatgagttttaatggggatacaaacacgatgaggctcccgcacctgtcagcccaaagccgcagtgatcgcaatgcggtctcccggctcagagcagagggtggcacacagaaggaaatagttggttggagacccgcggtttttgtgggccccaacaatcatggagttcggctgtcaggtgaccgcacgaggtctgtccaacgttcccatgagcggacgtctgcccgcgatgttgatcctgaggtagctgagcgtcgctcacgccggcgtgagcgtgctgcccagcgccacgcaatgcaggtgcaggctcaagacgggacacgacgggataccagaggcgcctcgcggtcacacacccatcggagaccctcaccgtcatttgctgagattgcctctcagcacaaggggcttgtcgccctcattatcgccgcactggtagctctttcgctctacgggccgttgcagggttggtatgtcgcgcagcgccggaatcaggatctccaagcacagttggatgcgctatctgcttccaatgaggatctgcaggcagacgtagaggacctgcagtcagaagagggcatcgaagacgaagccagacggcgtggctatgtccaggagggggaaaccccggtggcgattgagggctcccaaggccaagacgattcagacaacagtgtgcaggataattccctggcggacggtcaggcaacccgcgctcagacgaatatcggaacggatatcttggacgttatcttccagtatcactttcaggagtgaagggctatgagaatcgcggccatagacatcggtaccgtgacagcgcgcctggcggtcgtggagcagcttggagcggagcccccgcagctgttggtcaagctctctaacatctgcaatatgggcgaaggcgtcgcgaagaccagcaagctggctccggcggcgattgaccgggtgcgtgcctgcgtcgaggactacgtggctcaagctcgcaactataaggcagaaaccatcgcttgtacactgaccagtgcggcccgtgatgcttcaaactctgatgaactcttggatgcgctgaagcaagccggggtagcgcccacggtgatacccggtacccttgaggggcgcctggcgctgctcggggtcgctcaggatttccctgatcaggagattgctgtaatcgattccgggggaggctcaacagagttctcgaaaggctgcctcgatacgcacaaccacgaactttctgtcgctgacgttatctccgtccaggtaggagcgcgtcgtttgactgaactctttctttcagaggaggcccccgaccctgaggcgatctcacgggcgcgtgacttctgcgatcaggccttcagaggtgcggttgatacgttgcgcaaatacctgccgcgtgcgcaggtaccggtgttggttggcggcagcgcaacgtccctggttgcaatgcgcgaagcgcttgacccctacgacagccggagggtacatctctcaacgctgacccgtagggatatcgaaaaacagatcaagcggttggcgggaatgacagtagtggagcgtgcccaaatcaaagggctgcaggcaaagcgagccccggtgatcctaggcgggtccctcgcgatcagcgaggcgctctcctgcggcggctttgagtccgcccgcgtcagcgaacgggaccttctgtggggactttcgctcgtctgcctcgatgaggctcaaggcaaacccgaaccgctcaagtgggctccgacgctgcagtcgctgtagaaattccgccgttttgttcgtctgtgcttcacccaaggcgcacacttgcgctattcttaagcagtgcgcctgtgggggcgtggtgaaattggcatacacaagagacttaaaatctctcgctgcaaagcttgtgggttcgagtcccaccgcccctaccagcttttattgtgtatagagcgcacttcccaaagccggagatattgcgaactttagccgtgaggcccacgtggagctgtattcacgctatcattttctgcaagttgtacagaacctgtcctgtccataagttgtctcttcgagagaccaaccggtaagggagtgttcgtatggaaacagaaaatatcggaatacagtcacacactgtacccgcctttgatcaacagacttcatccagcacagcctcaacgacgttgagagcaagcaatgagagccaattgctgcatgaactgcttgcgcatgtgctgaaggatcggatcatctcaggggagtggcctgctggcagtcgcatcatgagcgagcatgccctccaggagcgctatggagtctctcggggcacggtacgccgtgccttggcgcagttggtgcaagaggggcttttggtgcagagaaaaggcaaagggacgtttgtgacccgctctggcgtcgcccatcccgccggtgcccgcccgctttcgtttgcccgtgccctgaaagagcagggctatgactttgtgacgcgcgtgctgaccaaagaggtcctcccggcaccagcagaggtgaccaaaaccttaggtttggctcagcgtacccccgcgctgtttatgcgccgcgtgagatatgttcaggaccacccagtggtgtgccaggagagctgggaaaatctcaacgcgtgccccgacctgtcgacgcatgactttgagcacgaatcgctgtttgatgcggtggagagaagctcgggtcataccatcgctgcttcacagattaaaagtaccgctcagaaggctgggcgtgagcatgcgggctacctgggtattgcacctgatgaaccggtcctagtcctcgagcaggttatcagcctggacaaccatgtgccgatcgagtggagccttacctggctctgtggcggacagggcgtgttcggggtggcctcacagcaggaaatcagcccggtaaaggtaccgcacgccgcaatgccgcaacctgccgcagaagaggggctctcaaaggagaaagaacgggaactgcgccttgcggccctcgatatcaggcaagctgttgtcaacaccgcccatcgctatcgcgacctcgccttccacttcggtggagcgttgagcgccgctgagatctttgcgaccctcttcttggatgttatgcacaccggccacgacggaacaccgtgggagcagcgtgaccgctttgtgctctctaaggcacatgcggcgattgggctgtatcccgtgctcctcaaagcaggctttatcagccagaaagacattgaccgcgggctcttcggaaaagatgcggtcctcttcaagcatccgcagcgggacccgagccgaggccttgagacttctggaggatctctcggtatgggcttaggctatgctgcaggattggcgttggctctccgcaagaaacatccaaaagttcgggtcttctgcctggtcggcgatggggagtgcaatgagggaagcatctgggaggcagcctcctttgcagggcactacaagctttccaacctcgtgtgtatcgtcgatgcaaacggcatgcagttggacggtacgacagcgaaggtctcagactccggaccgctggcggcaaagtttgcagcctgcgagtttgaggccctcgacgtcgatggccaatcagtgcaggagctgcatcgggccctgacgcatccacacacgcttccactggcgctgatcgcccacaccaccaaaggcgagggcttgagcttcagcgaaaacaaggtggaatggcacgaccacaagctggacgagggtctcttcgagcaggcctgcgcagagatagagcggcaacgggaggcaatcgagcatgcttagtgtggatacaagagagccgaccatggatactgctcaggctcgggcgctcgacgcactcgatgctcgcgccgtattcggctccacaatggaagagctggccagacagtatgaggacctgcgcgtcgtggtatccgactatgggagacgcctcgagttgggtaagctgcaggcacagcatcccgatatggtggtccaatgcggcatcgcggagcagaaccagattgagatcgcctcagccttagctaacgaggggtcactggtctttgcggcttcctatgccccctttatcacagcacgggtgcttgaccagatacgggtgaatttggggatgatgaaaagcccggtgatcctggttggattgggcggtggctttagctcaggggagttgggaacctcccatatgggtcttgaggatatcgctgatctgagagcgatccctggtatctcggtgattgccccctctgacaacgcccaacttagcctggtcctgaaggatctggcacagcatccccgtccctgctacgtgcgcatcactaccgggcatgatgcaatagccgcctcaagcgaggggactcggtttgacttcggcaaagcccgtaccctgaaggcattcgatacaggaaagccccacagtgtcgccatccttgccaccggtacgttagccggaagcgcgctccgcgcggcacatcagctcacagaccagagtataaacgtctgtgttacggaagtcgctacgatcaaaccgccggatactgcagcgatcgcctcacttactcacggtgtacggctgatcgtcacggttgaggagcacagcatcatcggcgggctgggaggggctgtcgccgaataccttgccggcatccccgcaggagcaccgctgctgcgcctcggtgtgccggacacctatctggaagcggatgttcaggaacatcttctagagcgctgtggccttactgctgatggcatcgcgcaggcaatcagcgctgctttggtcaaacagagcgccccttcactccgataatcggaagaagaatgaccccggcagatcagagacctaccggggtcatttgtgttcgaaaatggtgcccccaacgagattcgaactcgtgtcgccgccttgaaagggcgatgtcctaaccgttagacgatggggaccgcgaaacagagtataccagagtagtggacacaaacgaagtgcgactcagccgaaactgaagttccacagacggtttcccgtctgtggtacacgcgtatccggaatctactgtgatagcaacaagggacagtggttc

SEQ ID NO: 400 - DNA, 6788 bp, Unknown
  Metagenome-assembled genome
tgttttcgatgtgctcgacgtgagtagtccatcatcggtactggtcgtgaatttcgccgtcagcctcgactttgtcgtaggacccagccattctcgaccatgaagagcggaaggccatagggtccgtgagccagctgagcgagtagcgaagccccacggatcgacctcccagcccggtcggaagcgctgagatagggattgcggaccacgtccttccactcgcggaagtcgtagtgcgaatgtcctcatcccacttgattgccttgtatcatgtggtaggcagccgatgtagtctacggttccctctgtcagatgcttcaggtcgtcatcggtcacactaccatctctcagccacggcgctgcccaagacgcggatattggacggataggcgccagcgcatggacatcggcgtaatagaaacgctctcctccatcgccttggggtgcaagaaggatgtcctgcggacgcagctggcagatagatgggaaccattgcgatcatgcgccgatctggaagcgcggatttgaggcatggcctatcgccacgcccttcgcagaggcgacgagctcgtagtgggcagcctgatacatcaggtgcgctcagagtcctccctatccttcgccacgatgcccgatcggtgagcagcgcaacatcatcatggtagtttgcctggttgttgatctcgttgaaggtcgatccggtaggtgaccttatcgcggtagcgctcaaagcataccgtggcaaagcgcacgaagaggtctatgagctggcactacgctaccctccatatctttcgacaagggcaacggcatcccgaagtgcgagaacgtcacgacgggttgtatgccataagcctagcagcagcaaacattcgtcgtagaatgtaaggccctcctcattgggaacagcatcgtctcctgcaggaaagattctcgaccatgcaatcgatgtgcggaaacacttgaagcccatctcggcaaagagctcgatgtcctcacggtagcgatgatagagatctataccatcgtggttgggatagctctccccttccaggaccgtgccagtaaagcgtatgcgcatctcccgccgtctctgcatccatgatgctcgggcccttgccaccctcgcgccaggcaccctgcgttggtgcggcgacggcgcctcccacaggaagccaagccatccctcagcatgggctgccgtcctcccccagctttgcctccagggcatggatgcggcgatacagggctatggcttgctgggccatgaccttaaacgtctcggtggaaaccatctgatcctcagcatgcaccagaaggatcgagataggggtatgctcgccagctgcctccttctggatcatctccgtgtggggtgcatggcctttgatgagagcctcgtctgcatccttgatgcacttctccgcagcgtcgaagttgccgttacttgcctcctgtactgcctgcatgtatagggatttcgcggctcctgcagctgtgatgagcgagaagcacgtgagctccatttcctcgtctgtcatatgcgagattcccgtcttgttccgtgttgcgtgtcgaaggcggggctgccagcacaccaggcagccccgcggcgttcatgccagctgcttcgctattctgcagcctgctcctcctcgcctgcctgctcctgtgcaaggcactgcttgtccatgagcttcgcgaagggaaggtaggtgaagaagctcatcacgaggactgcagtttgaagcagcgctgtcctccagccgcctacgaggaagcccgagatgatggcaggtgttgtccacggaacgatgacgccactatagagcgggcacagtccggaagcgagagcagcatactcgatgaggccggacaggaccggagtcacgatgaagggcactgccatgagcgggttaagaactatgggcagaccgaagaggacaggctcgttcacgttgaagatgccagggacgatagcaagccttccgaggtccttcatctgcttggacttggcaaagacgagcatgaaaactacaagtccgatggtgatgccagagccggtgacggtcatgaactggtcgaggaactgctttgtcacgatatggccgccatttgcaatggtgagcgccatgccggaatcgatgatggcctggttctctgcagagtttgcaagaagcatgggacccatgatgccgtcgccgatgatagtggcgccatggatgccgaagagccagaagaacggaatcatgacgcccatcgtgatgacgccgcccagcgaatcggtcatgccctgaagcggcatggagagatacgtatagatcatctggataggagtgccgccgagcagacccacgcacagggcatagatgacgccggcaccggtgatgatgacgaagccggggatgagggaggtgaaggcattggcaacgccttcagggacgcctgcgggcatcttgatggtgatgtccttcttcatgaagaaggaatagatccagccgacgagtaggccggcaacgatggcaccgatcatgcctttgccgcctgtccagcctttgaggatcgcaccgaccgacttggtggggttgacaagcagcgcagaatcgaccgagccgggctgcaggacgaagaaggtgcaggcagagatgatgcctgcaggaaggccggcatatccctcattcttgacgtaggtataggcaatgccgacagcagcgatgatgccgatgacgccgaacgtggaatcgctcagctgggagcagaccgctgcaatgcctgtggccttgagccagtctgtcacagatgcgactgggaagttgccgatgagcataaacagagcgccgaccatgatcatgggcatcgcgtacatgatgccgtctttgagtgcccgcatcgccttcgtattgacgaagcgcatgatgcctggcactaccttttcgttgagaaactctcccattgtccgatctcccctattgttggacccaatccgcacgttcttacagctatttcttcgcgagcctgcgtgcgaactttaggaccccttcgccgttgcagataccgtagtcatgcatgggcacgacatccatgggaacgccttcggcctgtgcgaccttcgcaagctgagccttcatgtatgccacctggggtccgaggagcgcgacatcgacgcccttgatcctctggtcgaattcgctgaccggataggccacgatatcgacgtcgattccctgcgacacggccgcctcgcgcattttgttcacgagaaggcttgttgacattccctggttacagaagagacgaatacgaagcacagcaatctcctttccttgtccgtaggccctgcacctgcggcacctttccgtcactgtcttaagattaggaagagagagtcgtgaactccatcgcgtctatttccggcaacttccggaaatagacggaaatgcggcaggcagaacccgccgctcgcggtttctgcactgccgctaggcggtcgcaacgctgcaagttaccggatttggatgatagccagatttgatagcctcaggaacccagaagtgtgcggaacatctcgtatgtcggattctgggcaaggtgccctatggcctttgcgtcgaaggcaaagcgggcaagcgtctcgtttagcacgcggcggcggtcatccccttcgtcagtacgtcccatcgataccagaatggcaactctgatgctatcattgtgccactcgacaggacagggcaacactgccacataggcaaaggtcgcgtcgctcgcaatgccataggggtgcggcagggcaactcctgtgccaagagatacctgaataaccttctcgcgggcaaagacaagctcggtgaagtcctcatcaacactctcatgggcgcagatacggcggcacatctcctcgagaacgccctcccgtgtggtggcaaagacgtccgtcaggaagcgctctggcccgacgaatgcatccacgacatcgagcgtgacatcgcctctcagcatatcctccacgcgatgggcatcgacatcgtcgagaaacggccctatctgcagaaccggcttgggcacggggaccatgatgggaaacgtcgtgaagacgaagtcgaccttgctgaagtcatacgtctcgaggccgaaccgatcgcagagatagatcttgccgatatggctgccaaggcattgctcgaggcggctcctgagcagcgctgacgaacttcttcccagatcagatacgatgaggacatcatgcttcttaataagcctgccacgctccagtcccagttgtaggatgatggcaatgtagcccagctcgtcctcgggaatggactcgcctccgaagtggcggcgcagcacctcgccggcaatgattgccatctggcacgctagcggatagttccgcttgatctcacccaggagcgggttgtgggcacgtatgccatacctcagccttatcgccattggtgccagatgctgattcagctgcatcctcaggtcgaagttgtcgagcaggttgatgccgcactcatccgtgagcaggcggagtatctccacggtgagccggtcgcaacgctcgttgataacgaagttcgagccgttcctgccgccgaagctggcaatgcgggagccttcgagataaagctcgagatagcgcctctcgtctgagaggacccgctctccgcagagggcgtctgtgaggtccatcgcatccaggagccgtcctgcgacttcgtgcacacgtccatcgacttccggaatatcgtcgttctccagcttgagcgtgaagcctgcgagcacccggctcctggcaacgacacagtagtccatcaggctctcgaaagagaactccgtgagcggcagatcgtactcagcaagaagacccctcgccgtccgtaccaggcgtgccagaaacgtccggacatcatgccccagctcggctggatagatctgctcacgcacatagcgttcggcaatgagccggcgcatgttcgtctcgtcgcctatcacgcgcatgccgtgattgggcctgcggtcgagcttcaagtcatactgggcgtatatctcctccgccgccctgagacacgaggaaagcgtggaacccgagatatagaagacattgcagaggtcctgggccttcacgtagtccatgagatagagcatgcccacaatcagatagtccgtgcgttcacgtgcgctctgcggggcgctgtcacctgcaagggcagactttgccagataggcatcgaaagcatctttgtcgtccacatgcagccggtagccgcagcgcggctgcgacactatgcgggctccatgcccttcaagcatgccgttcagctcatggatatacgtgcgcaccgtcttctccgagcggcctatctggacagcaagctgctgcgctgttgaccactcatctgtcttgagcagtccgagaaggtggcgcaaacgaatactgctcatgcatcctcacccccatgaattcctgcgcactcagtctaaatgaaatgcacctgaaatatgaagaagtctcccgagcgtcaagcagaaggacgagcaggaaggtacgcggactctgcggtggcccaggcatgaaaccttctcactgcattccacaggactttccggctggcccctgtatgcgcgtacaggccgcgcaacctttcgctccaaggcagaaatgccacgctgcacctatgaaaacggcttgccagttcaacgccgctgccccatgacggaacagcggcatcctcctgaggcaccgctccggggacgtagcgcctgaggtggctcaccgcagagtccgcagttgcagcagccattgcagatgagatggctcccacaggacatgcacctgcttctatagcgtggctgatacagatactcagctgagatcgaaagacccagaggatcggttaggtgccacctcaggggtgcgcccgtgcgctcgacacccgagcgatacgcctgctgggcctgcacggatttcctggggatgcggtactcgcgctctccaacgacgaggcgagcgcctgtctcgatgaaggcgaatgtgacgtcgtgcgtgcggcactgcgcggaaagccactgcacccaggagaagtggcacgggcgcgagtcatcgtagttctcgcccccgcacttgaccccctcgataccacagcggcgcaccgtaagcccgtcgagagtcttgtatgaacagccagctgcgcttgtgtctttggcctggttgccagcgtaaaggtagcgctcgatgtctaccgacccgatgaacggcgcacacatgatgcccttgtgggcggccggtgtcgttgccaataggatcggtatgcgctcgtccgcgcggcgctggttctcgcacgtgacgttgagcatcacattgtcccagccgtcgccccagtccgcaggcaggcactgcgccatgcgctccggtcgcttggtcagcaggtagaacttgacgtccgggcgcgcgtggatgatgctccacgcctcgtcgcgccacgggtccgcctctggcacgaagaagtccgattcatgcataccggatgagctcgccgctcttcaccttgtacgcgccagaacggtcgcgctgcagcggtagtcgaacgtggtcttgttgcgccgcaccacgccgccgttcagccgcgggtcttgtccaggtggaacatgtagcatcgcgcacacccttcgctgatcttggtacagccgtgccagggattccagatgtcgtgcattgccgccttcgcgtcgagttacctgatgtgtggtcaatcttagcagctggcgtacgtctctctctt

SEQ ID NO: 401 - DNA, 6117 bp, Unknown
  Metagenome-assembled genome
atccttgaactgcgtcgtgtgattttgccaggtttagaacccaagcccacgatctcaacctttgtcgttgagcgcctgtgggttgatgtagccctgggtgagttcgggtagcggggcgcacccgttgcctttgtgccataggtgtgccgaccatgggcgcataccttgccaaggtcgtcgaaggccgtttgcctgatatgcagtccaccttcaggaaaataaaatgctgtctgggacgctgccatagacaatctgaggaaccgctgcacgcattgcgacgttattgcttcgcagacaagttcattgttgagagcttcgagaatcgtcttttccaggcataatctctgctgcataagctgcaagtttttccggagcacaccgatggtcctcgatcaggcacctgtcattacgccttttttgtattgaggctgagctgcagggcatccactgctgcggtgcgcaccagcctatcaccgggctgtaaccagatatgtctgatctctttcttcgcctgaacgcccatttccccttcctcggaattggtgcagttccgtgtcgctggcgcccttggcaaacgagggcaacatcctctccacttctgcggaatccactgccatggattctcctctccaagcatcagacccttcttccttatgaagcagggcgtgtccttgttcctttgatgatagcgctaggaatgtctttttaggcgataaaatgcggtgtattgctgtaagtaaatgaaaagtttcgtagagctcggtcacgtccgtaaagtggtgtatacagagaaacgaaccagaggctcgagcttcaagtattatttgcaattgccaaaagtcaaagagacttgaaggttcaaccatggctcagatcaaacttactcttaaccaggacgagataatgcatctgctcgaaggctccagcaaagaggcactcaagctcatgctctaaaagtcgctcaatgcccatctgctcgcaaagtcggagggtcagctgggtgcggggtacttgcgagcgcagcgacagccgtagcggtagaggaggcgcttcctcacgctgcgcttcgacacgatagatctctgggtcctaaggaaacgatgattaatgccccataacgtgccagagaggaccgactacacggcttttctaggcctgcatgcggaaaaggatgcccatccagcacgtgcaggagccgccatcctggcatctgtcctgccccatacaccacatccggcagaaagccccaagacggaatacctcccatctggtcttcttcctaagaccttaggacttaaggtcttgaaagctcatctatctgtccatatctgccttttggatatgctggaatgtgtggatgtagctataccatatccagaagacagataggcatctatgtgggtatgagcactgcgtggttcgagacattttgagccggcgacatacagtgtgtggctccagcgacctcatcgaggcgaattaatcatcatttccctagcgcgatcgattccggtgctcttgactctccccgcacccggccacacgagcgggcccggtgctatctgcacaggaaggggaagcgcacccacaaaaaggcggggcaagatctaggtctcccagaagctcttagaaaggctaagggaggtcttctgagcgcttctgtctgggtaagtgggcaaaccgacactgtcgtggggccaacctctgcgtgcctgtaggtcctgcccgagcactccttgtggctgctcgtgggcagcaagggtgcgctacccagctcagcatccttgaggggtccccgctcaagacactcccacctgtttgcgccaagcagctctcccggcagggctaaggctgcaaaagccctgggaagtgtacagttttgcttctgcgagccgcaccacctgtggcagaagccaacggttaagaacaccgatgtcctcatctgtgagttcttcccctaagggtgtagcgacttttcctgggtctcacacaaggaggtacaacatgtcttggatctgatctgtgacaggccaagaaaggtattaggctacaggacggccaacgaggtctttagggagatggtgcactcagcttgacaattcgcctactgattggattggttcgattgaccctgtgattgatctgtttgatcttgtgactgatcagtctggtcttgggcctgatcctggctctggtcatctccgttcttgtcgctcacgtctccgacggcgttgaccatcagatcggtgtaggccttgataccctcatcggtcaaactctgaccaatctcatccatgtactccggatgctcttggacctcagagttccaatcgatcacctgaacgttcttacgcgaggacgccatatctgacaggatctggttgttcgcatcggcaaagcttgcggtgctgtacccgttcacaagccagacctcgacgtcatccccgatcgtgttgagcagtgagttcacgtggtccctcgaaagcggcacatccgcctgcagggcaatcacgacacgcttgccggcagtcccggagttcacgtagttctgccagaccttctcaagctcgtcggaacttctgcccgcagagcagtcgatcattgtataaggccacgcctgtgaaagtgaatcagcggccttgatcgacaccccgtcgcccaggaagattaccttgtaggtggtgttctccttggtcgggacttcgtagcccatggtgttgacgatgaggtctacaaagttctgcgcatagttcggacgcaggtgcgttccatcatcccagaaccactcgttgtgggactgtgaatcatcgtaccagtcaatcacggagacattgtcgtttgctgcggctagctgattcaggagtgtgttgttcggtgagcaccacggcttcggcacacggtcattcacgaaccagatctgcttgcccggccccacggcgtcgaccagctgctgcaggaagtcttcagtgaggtatccattggaaccgattgagaacacaacgttgtcccccacgacgcccttgcccgcgtagccttgatagaccgcgagggcatcggttggttgccgtccgacttcagcgtcgaccatcccatgcgggaaggcggcattcagattgtcgatcgcgcctaaagatactgagtccccgataaagaggacgtcatattccccatccgtcagcggtttcttcagggtcgcggcgctcaccacttcctgcgcatccccgttgtccccgacggcagcttcagccggaacggtaattaaaccgacaattgcgacggcgagcaccgccatagacgcgatggttctgatcagcttcatcgggcacagatgcaccgcgcgcaccaggccggtctcgttgttctctttgacctggcggcgtgctcttctgcgggccttagggcctttgaagtaaccgtgcttgagcaccgcatgcaccatgtgcttgcggaacggggtctcaaccacgttgtagctgatgtccgctgcgatcaaggtcaacaccaactcgagcaggattagataccacggctggttcacaccagcacgtggagtcaaaagctcgatgataatgtagtgccagatatagatcgcgaagctgcgcttaccgatccacacgagcggcttgatggagaggatccttcccatcaccgtatcctgcacgagcaagccgtagatagcgaaggccgccagcacggagcaggcaagcgtgcctccccagtaagagaaagcggagtaaccgttcgtcacgttcatcataacgagcagggcgatggtggcgccagctgcggagagctccagcttcacacgcttgtcggtcggctggtcctgcgcgcgaaagctcgtttgcttctcaagcgggcaggcaaaggccagcaggcatccaacgagcagcgactgcgcgcgggtgtcggtgccgtagtaggcacgggaagggtccgcttcaggcacatagagcagcgccatcgctgccgcagagagcccagtcgcgatcgcaagcccgatgatcagttgttttttgtttgccttgtgacgcaggcagaagtagaggatagggggccaagccagatagaactggaattcgatcgcaagcgaccagaagtgcgtcataggtgacggtgcgcctgctgctgcaaaataggactgctgtgtaaagatcttgaaccagttgatgaacatcagaaggccagggataatatcgggccgcatctttgttaagagctgatggtcgaagatcgtgcaggccgccagcgcgattgccacgtaagccagacaggtcggcagaaggcgcttaatgcgtttgacatagtaatgaccacaggagatgcgcccgctctgctcaaactcacgcagcaagccgccggttgccagataccctgacagcacgaagaggacactgacaccgatcagacctccctggcaccagataaggttcatgtggtagaacacaaccgccagtgcacacagcgccctgagtccatcgagcgaatttatgtagggcacatgggtacgcgtctttgtattcgttcgtgattgctttggaactttgaacgtcgtcgttgtatcagaaaccacaggtcctccgggcaggaaataaaaagtctaacagataaagaaaacttagtctgtcaagacagaattttcactagttttattttagctctatagaatcttaaaacgctgccttcacccacaatttttaggctcttcgctgtttctagtgggtagtacaggccagctgcctctgggccgagaagttgagtttcccagtctgaggaagatcatcgcctcgaagtaggacatgttcctgaagcccctagcagtgttccggacggactggacgagggagttaagcccttcgagaagcgaattggtcaaactcctctcccaccagctcaagatctcttcccgctccttcctaaggatacctgctaccctcttcatcttagccacggcagagtgcatcatctacaagcaaaggcggtttggggccttggctgtagattttctgttaaggcagccatagacgtcctgcatcgctttgccatctgacaggcacgcgcccccctgagatgtgtcttcgcagggtcgagctcctctctcttcgcaagctggtactctgtgaggctctccctcatatattctttctgccacttctcgcacagtggccgcgctcttttcctgtagacgcgaatatgggataaagtgcgtgcatgaggcatcgctgcggtgactcccagggagttatgactttgctatgttgcgtatgacctctaagaccttcgtctggtccctgtgtgttccttaagctcatctcagagcctgcctgcgtcaccctcatcctttgccttccgtaatggcgcgggcgcgcaggcggtcgaggtcggtcatgatgctgatgcagctttggtcgcaccttttggcggtgttgcctgtacccacacgcacgactctggaatagtctgctgcatccctcgccttcgatgtcgccttcccaagcggcctctatatgcacgtgggctgtctcgtgcagaggcttatggccacaacgctcatgccaaagagtaccatcccttatcgcctgggcctcaaagagcgccgtgatgcgtcttcgggcacacctttcagggcatccttgcggcaggcacgctgtctttggggccctcaacactgttccgtgtacaatcgtctcgtattgccagatgtcgagatgccacaaggtcttctcgcgcgtgtcgtaggtgccgcagcgccggtggcaggcagggctcaccacttacctggccccttctgtgcgctatccgcacagggagttcgttctgcgctcatctgcgcttctcgaaccagacgtctgtgacctccattcgcccctaagccccctggggcttcttaaagagccttgtcagcatgccttaccttaagcatccatatcgcgccttagggccgcatccgtcgccaaaatcttggctgtccgggtaccacgtgctcgaggggatgcaggagtgctacccaccataagtagcgaagagcctttttacccaggagcaaaaagctccctgaaaaacagcgctcataactcagcattgaggcgcactgaacgctaagatcatagctaaggg

SEQ ID NO: 402 - DNA, 4084 bp, Unknown
  Metagenome-assembled genome
ctgcagtgcttgtctcgcctgcttgctgtggacaaagcaggcgaagcattcgaagcaggacagcaaggcgatgctctcagggacagcccacagaaggcagctatgtacacacgaggcgcgcttgtcggcatgccccagtctctctgggactggtggaggaacaggatcgatgtcaatggtggtcttacagagagtttccggtaagaaagaagcaatgtcgtatcgctctgcaaaagaactgtttgaagatttggggatctaagcctattgacatgtgctatcgcagcacagttagaaatatattgctgagatagtgaaaatgagagggaagatactccgctgggagtatcttccctcgaactggtcctatgcagccaaattacatacgtttgtcgagctcctctctgattgccttgatgaacttctcggtggaaagcttctgcgggttggggagcttggtgatacgtgtcaagtcgccggtcattctcccgctttcgatagtggcaagtgttgccttttcgagcttatcggcaaaagctgtgaggtccttgagaccatccagctctgcgcgctttctcagagcaccggtccaggcaaagatcgtggcgacggagttggttgatgtttcctcacctttgaggtaacgatagtagtggcgctggacggtgccgtgcgctgcctcgtactcgtaatagccgtgtgggctcaccaacactgacgtcatgagcgccaagctgccaaaggcgcttgagagcatgtcggacatcacatcgccgtcgtagttcttacaggcccagacgaagccgccttcgcttttcatgattcttgccactgcgtcgtcgatcagcgtatagaagtaggtgaggccgttcttctcgaaatccgctttgtactctttgttgtagatctcttggaagatgtccttgaagcggtggtcatagatcttggagatcgtgtccttggaagcgaaccatacgtcccgcttattctgcaggccaaaggagaagcagctgcgcgcgaagctctcaattgaagcatcgaggttgtgcatgccttctacaacgccgggctcatcgaagtcgtggatgaggacgcgctgctcttcacccttctcgggggtatagacgagctcaactttgcccggaccggggatgcgcatctccacgtcgcggtacacatcgccgtaggcgtgacgggcaattgtgattggcttcttccaggtggttaccaccggctcgatacccttaacgatgatcggggtacggaagacagtgccatccaaaatggcacggatcgtgccattggggctcttccacatctggtgcaggttatattccttcacgcgtgttgcatttggggtgatcgtcgcacacttgacagcgacgccgaggcgcttagtagcgttggcggcgtcgatcgtgacctgatcttgtgtctcatcgcggtgtttgagccccagatcgtagtattcggtcttgagatcgatgtagggctcgagcagattctccttaatgagcttccacatgatacgggtcatttcgtcgccgtccatctcgacgagcggcgtcttcatctgaatcttggccatagtccctccagaaatcggtgtcaggtgcattactcttcagtgtatatgcaaatttggcacagcggcaaacctgttgccagaatgtaaaccttgcgaggggacttacgatgagtgagcttatggagtacctcaagaagaagggtaccgtcgtggtgttcgatatcgacggagtgttggccgcctatgagttcggctatcactgtcatgctgcggtacctggtggggactggagaagctatgttgagatctaccacccctatctcagcgccaaacccctgcccgcacttgaggactttgtcgtgcagaaagaccccgatgagctctatatctgctcggtggcagcagactttgaacagcaggataagagagtgttctgcgagcgatgctatgggatcaaccctggccacatccactttgtggcgagcaaagcggagaagctgcggtatgtcacggatttggccgagcaacttaagatcccgcaggagcgtgtcgcgctcgttgaagatagtgtgaaaacactcgatcagcttgccgctttctcgcactgcacaactgtacatattacttcattcttctacggatagcgtatcctatgggtagggctgaaggcagtaaagggcattgatacggtcgtgtgtacaggagtgtccccctggacaccctcgagcacggcgaacagctttcccatccaaaaggtggcatcagacctcctttcctctctgctcattgacgcgaagctgtcacaggagaatacctggagcaggaaatcggagtacaccgacagcgggagcttgcggtccttgaagatcgtgcccgtctgcgggaagaacgacttcttgcagactgagcagagatagcgctggacgccggttgcgtccttgccgcgcttggacacctcggcgctgttgcatcttaggcaggcgcgccgttcgcatcgccgttgaggtggcaatgcctgaacgagtacatgcttctatggctcgcatccacgagcgcctgagctggtttcaagctcgctttctgcaaggccgtcccaaggcgtgaccgaagcggcgagcctgcgcttcgcgtgtttgccctttgtggtagtctttggcggcccagaaggatagcgggggccaggactaccacatccgcaagaaccttgccgcccatccgggctttcttgtggatagacgagcaattcccatgattgtagacctgctcttattaataggctgcccagattagacctccagaccgcaaggagggatttacaatttaatagggccttcgtcagcttctgtaggtaaggagttcatctaggcagcctctctctttccggtctttccggacctccctgggagcgtcggcttgcaattggagcatctcagtatgggcagcccgacgaggctgccagcatcgcggaagccgcagcccatcttgaccgtcaccttgattttgctgctgaccgacttgacacgaccgtcgccccaagcacggcgtgcaggccctggacaaccgcgaccccgccttcttcagcgactcggtctcggcgcgttggacgctggcgagttcctcgaggctcttgacgagtgcggagctgctgcccttgatcgccctggccctgggcggccgtgtctggagatcgccggtggtgtgctgctccatgcgcgcaagccccacgacggcgccagccgtgcagcacaccgccaggcacgccgcccagccctcgaagccacgagcgaagcgggacctgtgcctggcccacgggaccggctcgacgagtactccgtgcacatgacccgcctcgtggcgcattccaggaagcacatcggcctcgccatgtccatcgcctcggggccggcgaggcgtcacagcactcgtatctgcgcccgcacgccagacagcgcaggccgtcccgcttccacggtcgcaccccgacgacggcccgatctccgccgatgcgtacgtatccgatcgcggtgtgcgccagtgtgagcgcgtagcgtagcatcctgttcatgtgctagggcaggctgcacccggcacgcagatcctgccttgcccgatgcggagacagcccctcacggggccatctccgcatcgcccgtcttttcctactctcatctgggtgtctgttggagattcacccacagagactatcgaagagtgtaactttcttatatactcatgtatgagtatatgagcaaatggtcatatactcaggtaaggagataaagtctcatcagaggtatccaagagaaggagggctatggcttcgcaaacgggcaccgaacagtatccgaagaaggtgccgaagtcgagcagttgctcttgcgctacggatacacagacgcatgaatttgaggaagaggaggacgaagacaaactggagcctgcagtcctcaaacgcagaattatcatctccgcaatccttctagttgcagcaatgctgatccagcatttcactgatttcaaactgtttattcagttgctgctgtttctgccggccta

SEQ ID NO: 403 - DNA, 13138 bp, Unknown
  Metagenome-assembled genome
tcattgggccttgcgtaagtacgatgttcggatgcgtgagctccgtgtgcctgatcgaagtacgtcttaagagtggtaagcgcttcagcgcccttgccacgtggcgacggtgttatcgatgagaaggcggaatgtcagaagtgaaatgaaggcataacgcgaatggatagtttcttccgatcttggactgtctgtaggcccaggtcgtaggggtagagaatctgctgttttgggccatgggtgggtcgcgcgatacgtttgacgacgagctttgccgcctctttattacttacccatctccttctggatcggtctcgttaggtttagatgcccttgccaaattttgcagccagcccaccccaccatacggcgtgcccagccccattcatcgggtgccgcacaggccatagggttggggattgtaaggtcatctcgcggattgattgtaagtggcgatatcgtacagagtttgtggcgaggatgcagcaggtctccagcttcccgcgttctccttgagctctctacgagcttacttgagggcgagcccgcaccatgttggaatgacaggggtccacgattcagacatctccatcggcttcttcacgccgaaagcctcgctgtcgcactgcacaaaagcgttgagtctggtctctcgtggtgagttctcttcgtagggctgggtgaacatcgcgatgtgtcggtagccctcgtcgtgtgcgtgcatcagaaggtcgatggttggcttgctgtacggggcgagcacaatatcaaagttgtggtccctgataaagcggtcgatcagtacgatcggggtgcccgcatttgagagctcgatcaggttgcggttatcctcggtggtggtgttgacaatcaagccgtccacctggtgcgacatcagtgattccgtcagcctaagctcggtttcgggtgaatcctctgcatccgcgaagatcgggttatagcctgcatcgcgcaggcccatgctgataccgtggagaagcgaggtcgcaaacggcgtggtgatgtttgcgataacgacaccgatgaggtaggagcgctgggtcttgagcgagcgtgccaccgcactgggatgatagttagagaggtgaatggccttttcgatgcgtttgcaagcggctgcgctgatcatgttctgtttgccgttgatatagcgagacacggtcgttttagagacgccggctgcgattgcgatatcggaaatcgtggtcttctttcttgcgggcatactgctcctcagccaatatttggtaacggtcacattgttagggagtcctacttaaaaaagcaagtgcaaatatgtgagcggttagaatatgcagatgcattgggcgccagcaagctttggcatatacacttgaacgatagtgcccaaagtctatagggtggtatacagaagctcttgttcagcacggtaggcagggggatagcgaagaccgcgtacagcatccatgccccggtaagggctgcccgatcgcagtgtgtgctgtactgtacgatgcaatctatgcagtggaattctggacagagcgctgcgaggtgtgcgaaaacttcaggtgattgaaaccttgaaatagatgtgaatatgaaaccgtttgcatatacgaagcctccacactcgggcgcctcagagagcactgacactagtatttcggttctttaaagaaaatatcttgcaaaaaacaaggtaattggtatacgttcaaagtgtcagaactgacgtgtcagttttcatcggtcaaagcaagcgcaagatagagcgaatggaaacggttccataaaggtacgaaacatcaacagaaaaaggagcgtgtggggatgaaagagtttctgagcgacaaggatttccttctttcgaccaagacaggcgagcaactattccacgattacgcacagggtatgccgatcgttgactaccactgccacatctcaccgaaggagatctttgaggacaagcagttctcttcgatcaccgaggtttggctgggtggcgatcactataagtggcgcctgatgcgcgcaaacggcgtggacgagcgctatatcaccggtgacgctcctgcccgtgagaagttccagaagtgggctgagacccttgagcgctgcatcggcaacccggtctatgagtggagccacctggagctcaagcgcttctttggctacagtggcgtcctgaatggcaagaccgctgagaaggtgtggaacctcgctcatgagaagctcgcaactccggagttctcctgcagaaacctcatccgtcgctccaatgtccgccttatctgcacgaccgatgatcctgctgactcccttgagtggcacaagaagatcgcagcagacaggagctttgatgtacaggtgatcccggcaatgcgtccggataaggctctgggcattgagaaggagggcttcggagcctacgtcgacaagctctcaaaggtggcagagatgccgatcaattcctttgaggacttcaaggaggccctttcaaagcgttttgacttcttcaatgagatgggttgcaaagcatccgaccatgcgctcgactatgtagtcgacgtgccggcaaccggtgaggagctggagaatatcttccaggcccgtcgcgccggaaagcaggtatctgagcgtgacatcctcaagtacaagacggcattcatgaagtttgcagcgtctgaatacgtccgccttgattgggcaatgcagatccacttcggctgcaagcgcgacaataacaccgcgatgttcaagcggcttggccctgacactggctatgactccatccgcaacggtcagtctgcggccgatctggctgacttcctgaacgacgttgatgggacctgcgggctgcctaagacgatcctctacagtctggatccgaacgacactgagatgatcgacaccgtgatccagtgcttccaggaggctccgatcccgggcaagcttcagaatggttccgcctggtggttcaatgactgcgagcagggtatgcgcgcccagattacgacgctcgccaatgaggcagtcctcggaaactttatcggtatgctcaccgactccagaagctttttgagctatccgcgccacgagtacttccgccgtgtcctgtgcagcctgttcggtgagtgggttgaagacggcaagtatccaaacgaccaagaggcgctcaagaggatcatcaaggacatctcctacaacaacgctgtccgttactttggcttcaagctggatgaggagaaataaccgatggaaaatctgagctacgagttactcaagcggcagggttatcggggatatcttgttcctcaggatgcacctgaaaaggtactccagatcggtgagggcaacttcctgcgcgcctttgtagattgctattttgatcttgccaatgagaagagcggttggaacggcaagatcgtgatgatccagccgatcaaatcctcaccgcgcttctccgacgagttcaacaagcagcagggcctgtacacggtgctggtgcgcggtaagctggacggcaagacctacaacgagccgaggatcatctcttcctgcagccgcagcctctatccatttcgtcacgaggattacggagagctccttgattttgtcagatcagatgacctggagatcgtcgtctccaacaccactgaggcaggcatcgcctatgatccaagctgcaaaccggacgatgagccgcctgcgagtttcccggcaaagctggcacagctgctgcatgtgcgctggtcagcccataaggcgccggtgatcatcctctcctgcgagctgattgaccacaatggagcggagctcttgaagattgtgaagcgctactgcgctgactggggttgggaggacgaatttatctcctggctcgagaacgactgcaccttctgcacgacgctcgttgacaccattgtcccgggccgcatccgtgatccgaaagaggctgagcaagtcactgagaaattaggttatgaggatccgtttctcagcgtgcgggagcccttccagatgtggggcatccagggcgatgataaactcgcggagaaattgcccttcatccaggcagagatcccaggagcgtttgtaactgacgatgtggccccgtacaagaaacggaaagtccgtatcctgaatggcgcccacaccggctttgccccgggcgcttggcttgccggcttcaacatcgtgcgtgactgcatgcacgacgaggtcgtgagcgggttcatgaagtcagtgttgcacgacgagatcatcccggtcctcaccgcagatctggataaagatgacctggagaagttcgcttctgaggttgaggaccgctttgacaatccatatatcgaccaccagctgctctccatctgcctgaattcgaccgctaaatggcgtgtccgtgatcttgtcagcctgaaggattatgttgagcagaaagggagactcccgacgtgtctgaccatgagcctggcagcattgatcgccttctacaccaccggatacaagaggttggatgacaggggcttggagcttgaacgcgcagatggcaccggctatacagcgcaggatgatccggcagtccttaagttctatgccgagcatcacgccgacagcgacaaggatctagtgaaagccgtgctcagcaaccaggacttctggggcgaggatctcaccacgattgccggacttcaggatcaagtcaccaaggatctttccttcatcagagcaaacggcacggagcaagccttcgcgcagtgcttacagaaataggttttcacatgaaatcattactgcgcattaaacctcaggacagtgtcgccgtagcgttgaagcccctgagagcgggcgagacagtacaactaggcggtacgacggtccaggttaagcaggatataccgcagggccacaagattgcgctggtacccataaaatctggtcaagatgttatcaagtacggcgttgtcatcggacatgcgacagaggacatccagcctggctactgggtgcacacgcacaacatgaagacaaacctcgacggggaagtgcactacacgtatgaaccgagtttccctgagctaccgaaggtgaggccagagacctttatgggttaccgtaggtctgatggtcgtacggctaccagaaacgagatctggattatcccgacggtaggctgcgtcaacgagatcgggctcagtctggcgagacgctgccaggatctggtggggggcgccgttgatgggatctttgccttcacgcatccctttggttgctcgcaaaccggcaacgaccttgagaccacccgtaagctgttagtctccctttcccgccatcccaacgccggtggcgtattgttcctgtcactcggctgtgagagctgcactcaccaatcagtgctcgacgagcttggggactacgaccctgaacgggtgaagttcttaacctgccaggatgtgactgacgagctcgagagcgggcgcaagatcatcgcggggctcgcaaagcgcatcggaagatgcgagcgtgagccgatcccagtctctgagcttgtcatcggtatgaaatgcggcggctctgacggcctgtctggcatcacctcaaaccccgtgatcggccatgtgagcgacatggtggtcgagtgcggcggatctacagtcttaactgaagtccctgagatgttcggcgccgagagcttcctgctcaatcgctctatcaacaaaaaggtgttcgacgaagcagccggcatgatcaacggcttcaaggactactttatcagccacggggaaaagacgagcgacaacccgagtcccggtaacaagcagggcggcatcacaacgctcgaggataaaagctgcggctgcgtgcagaagggtggcaccgctccgatcgtggatgtactcccgtatgcaggtatcgtccacaccaagggcctgaacctgctctgctctcccggtaacgatatggtctccactaccgcgctctgcgcggcgggctgccacctgatcctgttctcaaccggccgcggcaccccgtttggggcaccggtaccgacgcttaaggtctattccaactcagcgcttatgaagaagaagccgaactggatggacttcaatgccggcgtagtcgctgacggtaagctctctattgagcaagcaggggaagagctctacaaactggtacttgaggtagcgagcggtaaaaagacctctgcggaacttcgaggaagccgcgatatcagcatttggaaagacggagtcgtgctgtaggtgaacgccagctctctgtttggaggaaacatgcaggcaagtgttatctggaggaatgcgcgtgctgccatcattgaactcaatgatggcgggttctttgagacggacagcacctgggacattgaggtcaatggtgagaaggccggcacaaccgagcgcattgaaacctttatctcagacttgacaccgggcatccgcaacgtcgtaaagttcacccacgatagggaaacagtcgaggtcggcgtcacgactccggacgagaccgctacgatcaatgtgcgtgactgcggcgccaagggtgacggaaagcacgatgacacggtcaatattcaggcggcgatcatggcatgcccgaagggcggccgtgtgctggtgcctgcaggtacctacctggtgaagtccctgttcttggtgagtgacatcaacatcgagcttcagaaggatgcacacctactcgccagcatcgacagaaagacgcttgcctatattccgggcacgctgcacggtgaagccgggaagggctatgcccgaagcgatctgtatccgctaggccgctgggaaggcgtctcagtcaacacctactgctcgctgatcaccgggctctcggtgcacaatgtgagcctgtacggcgaaggaaccatcgatggccagactgacttcggcgacgataactggtggcacgatttcaagaatctctaccgtccggaagagggcagggagattgcccgtccgcgtatggtattcctgtcccagtgttcccatgtttcactggtcggcattcacgtccagaatgctccggcgtggaacttacaccccatcctgtcagaccatatcgacgtcctgtgcctcaagatctccggtccaaagaactctcacaacaccgatgggtgcaacccggagagctgcagttttgtgcggatcatgggcgatgagttctcagtcggagacgactgcatcgcaattaagagtggcaagctcggcatcgacgagcagctgcgtcctgccacgcacgatatcctgatcgcgcactgcctgatgcacgatgggcacggagccgtggtcctcggcagcgaagccgcgggcggtatcaaggatgtcatggtccgtgactgcgagtttgtgcgcaccgatagggggttgcgcatcaagactcgtcgtggccgtggtgagaaagcgatcaatgagggaatcaccttcaaacatatccgcatggaccaggtactgaccccgtttgtcgtgaatgccttctacttctgtgataaggacggaaagactgactatgtccagtccagaaagccgttgccggtcgatgaacgtaccccgggctttgggcctttaaccttcagcgatatcaaggccaccaactgccaagctgccgcttcctatatcaccggcctgcccgagcgcaagattccgagcctgaccttcgaggatgtcgatatctccttcgatccggatgccgagccgtcaaagcccgctatggcctcaggtgttggcccgatggcgaaacaggggcttatcgtgcagaacgtccatgatctggtgctgcacaacgtttcagtgacgggccagatcggtgacgctgtacaggcggagaaggtggacaacatcatgagacgctagagttcattcagctctctgggaggcccctcctcgcggagcttctccttaatccatcacatgaaatcggtttcataaaatagcaggaaaactctttctgatccctttgaaactgattccatcaaccgtttaccggaagatacacgaagggatcaggggatcagttgacgcatcgaagcgatgctcttataaatgaaagtgcagataaaaccggttcttcaaccgcttcattcgatagatagaagctttctctatcaacgattgggactctaaaattcggtgcagcgtgaaagacaaaagagctctgaataggagaagaaaacggtttcattaaatgttcgggaatgcggggcttaaccgattggggaggagcgagttaggtatatgagtaagatcggtaagaagaggaagatcactaactggacgcgaataggctttggctttggtggcatggccaactccggtgcattgaccttcacacacagctacatggtcatgttcctgtctacacaggtcggcctttcagctgctgaggcggcaatcatcgcatcagttgcgctgtatctgaacgcttttctgcagccggtcatgggcttcatcgcagataacttctatacgacaaaagttgggcgtaagttcggtcgtagacgtttctggatcctgatcgctatcccaatgatggttgcagagccgttcatcttcgtcgtgacgccgttcggtgtgccatactatctgacgctctacatcatctacaacatcgcctactcattcgtcgcaagcaacctcgcaccactgacgattgaaatgaccgatgactacaaagagcgctcactgctcaccggttacaagcacatcttcggtaacgtctccggcttcgtgatggcactgctcgtcggcttcggctttggtatgttcggtgaggataacgctatctcctacttcgttatcgctaccatcaacgcaacgatcatggttgtctcctgcattatcgtttactgctccacttgggaacgtacaccggatgaggttgcagatgagaccatcaccaaccttggccaggcgatcaagaagttcttcatcgacctcttctccacgttccgtaaccgttcattccgtcaggttcttagcgttatcctgagcatgaagatcgctgctgcctgctggtctgcctgcctgtccttctttatcgtctacgttctcggcatcgcaaagtcctatgaggccgttatggagatgccgggcaagatcgtcgcaatcgtcttcactgctgtgtgggtcgcatggatggccaagaagggcttccacaccccgtggactgtctctacccttggcgctgcagcctgtatcattgccttcaacttcttcggcttcggccgtgtctttggtggcttcgatgtctccgtcgcaatgatcgcgtacccgatcatcttcgcaatctggaagttcttctacatcggcttccaatatctgcctgatgtgcctctgaactatgtccctgatattgacgagctgatcacgctccgtcgtcgtgagggcatctacagctctgcaaaccacttcgtcattcagatcgcttccgcactggcctccagcatctgggctgctgtcatcggtgcttccggattcatttccacctccggtagccaggctgcagacgttgtccagccgatcagcgttcctatctccatctgcgcttacatgctcatcggctgcgctggcttcttcatccttgcctgcatcctgggcgccaagcttcatctagacaagaagcagtgcgacgttatcaccgacgaggtcaagcgtgtccgtgagggtggcctgatggaggacgttaagcccgacgtcaggaagctctgcgagcagctcagtggtatcccgtatgagaagtgcttcgctcacaacaatattggttaccaagaggaaggcattactcctgctcaatgatgtgagtgagcaccgtatacaagcccgtgtcgtcgatgatggcgcgggctttttattacagaacctaaggagcactgagtatggcagcatcaagtttccttgaagtatctcccgccggtgaagctccatataacacaatcaacgcagcgctcgatgcgttgagcgaggtggcgcccgatgagacccagccggccaccatccatctcaatcccggcacctatcacgagcgcgttgagatcaagcgtccgaacctgacgcttgaaggtgaggtagccgaccaggttacgatcaccatgtcctatggggctaacgatcagatgcccgacggcagcaagcggggtaccttccgtaccttcacggtctttgtcgatgcagacaatgtgaccctgcgcaacctgacgatcgagaacgaggcaggcccggggaagatcgcaggccaggctttggcgctctacgccgatggggaccggctggtcgtcgagaactgtcagctgatggggcaccaggataccctcttctgcggcccgcttcctcccaaggaggtcaagcccggcggcttcattgggccgaaggagttcgctgcgcgcatcgtcggccggcagtactaccggcgttgcctcattgagggggatgtcgacgttatcttcggtggggcctgcgcctacttcgacggctgtgagatccgttccctctctcgtcatgagcccgtcaacggctacgtgaccgcaccttcagcgccggaaggggagccctatggctttgtcttccacggctgctcctttactggtgagggcgtggagccgaagaccgtctaccttgcgcgcccctggcgtgactggggccagacggtcttgatcaactgctggatcggcccccatatccgggacgacggatggtgcgactggaacaagccccacgcccgtgagtgctgcctctttgcaggttatgacctgaccggaccgggtagcgacacctcttcctgggcgagcttcgcaaaggtcttgacccctgagcaagcttctcgctatacccgccaacaggtgctggcaggcaacgatggctgggatccgctcggtggcgcagaggaggcaaccgagactgagtctctctctgacaatggtcgcacgctgcacatcggacagtactatgaggacgaagcgagcatgcatgagcgatttgcagaacaagcccgtcaagatgccttcacagggacgaccaagcaggagtttgaggactggcagcaagcagcccgcaccaagctcgccgatcttctcggtacccgtaagctcacaaaggcagcgctccaagttaagaagctcagccacactgaactctccgggggaatcgtgcgcaccaaagtgttgctgcaggttgaacaggatgtctggatgccgacttacctgctgcaaccaaagcatctccgcactgctccagatgggaagatagagtgcttcatctgccccaatggccatcagggtgccggcgcagcctccgtcgcaggcatcatgggcgtgcctgcggtcgacagcgccatcaggatcttcaactatgactacggtttaaggcttgcacggatgggctactttgttgtctgccccgaagcccgcggttggggagagcgccgtgactacagagggcagggagacgatgagcgggaattcctgcagggaacctgcctcaatcaggcacgcatggcagaaccgctgggcttaagcgtcttaggccttttgagctgggatctgatgcgcctggttgactacctgctcagccgtggggatatcagtgagcagacactcggctgcttcggcttctccggtggtggcatgcagacgctctacttcaccgcactggacgagcgcatcaagaaggtctttatctccgggtatttctacggggtaaaagattcactgctgcacctgaacggcaactgttcctgcaactacgtaccgaacctctggcgctcgttcgatgtgggcgacatcgcagggctcatcgtgccacgcccattgatggtgcagagttgtcgtgaggaccatctgaatggaccgcggggcctcaagaacgtcgaggagcagcttgatatcgtgcgttcactctacaagctcgagggcgctgaggccaatgtcagctgggagatctgccccggtgagcaccatcttggtatcgcccatctcgcagacgatgtggcctggctcgatgacagagctaaacagtcaagatgaaaagggtgatagacatgagccttaaaggagagaaaatcgcgtgctttggagattcaaccacctggggtgataacggaatcggcaccggtggcaaccagatctcctggacgacgcagatcaagccgcttgtgaaagcctctgaggttaccaacctcggcgtcaaaggttcccgcatgggtatcaaggcggacagaacggatagtttcgtcgagcgctggcagaggggcatcgacctctccggtgatgtgatcgtcgtcttcggtggtgtcaacgactttgagcgtgcggtcccgctgggcaagatgggatctgaggatccgtataccttctacggggcggtgaatacattggtgaccggcatcgtcggacgttaccccgaagcgcaggttgtattcctgactccgtgcaaatcaggtggtgttgtccgcaagggactcccccccttctaccagaagaatgaggtaggggagtacgaggaagcttatgctgacactgtgctcgaagtctgcgcacactacgcagtgccgaccattgacctcttccgcaccagcggcatctcgcccctgattcctgagcagcagaagctctacatgccagatgggctgcactactcctgtgccggatacggcaggcttgcacaccgcattgctgcgggactcaacgcgctcacttactttgaggactagctgagagtaatatacctatattagaaagggctgggtacgtgcatgcgtgctcggtctttgctgtctgtctcctaaatgatagtgcggacgttgggtacctcaaaccttctctgcgatacagcggaacaccgaccgtgccgggggattcacacatggccgaggctgccgagaatcacccacaccgtcgtcctcgtcactcatcacctataaagccaccccccccgggtaagtggaaggcgaaatgcagtgatcgaacggatccatgagtgtggagttcagcatctgctttagagcagctggcagctcctcaccccaatgtggtttcctcctctaccgaggaggggccagtcctcaccgaagagatcagggagaccaaacttcgctttggttccgc

SEQ ID NO: 404 - DNA, 7749 bp, Unknown
  Metagenome-assembled genome
cttccaatcgtagcgagacggggccatgcctctttatgcggctattcgattttcaaaagtgcaaaagaaactgtacgtcatcaaacctaagttagaagaggaccagatatcaccatccactgctccgacggattagcattctgagtgcaacaggatagcccgctgaatgcaagcgtggcacactccggaaggctacgatgttggttgtctcaatcaacgtcgaaagctaaaaggaatgtgccactacaagcatcgtaagcctacaggagagggactgcatagccacgctgcatgcagagggaaggtcaatcgcctatatcgcggcagagatcggcagggacagctccagcatctgccacaagctcaagaggaacgcacgccacggacgctttagggcatgtgctgcccaaaaggagggcggatgagcgccgcaggagatgcagggcgaaaaggcggctttcagaccctgcacttacgcagaaggtgcgcttactcatcatggacagacactggtccccagagcagatagacgacatctcaggctcgagggtggtggcaggtgcgtcgttgagcctctcgactattctaccgtgaggtccatagccgccacgctcgagctgccgggatccggcccgcaaggccaggtgcggcaccacctgcgcagcaagaggcctaagaccaaaggcaagatcgagatcttacataccgtaaaggagaggccaaagcaggccgatgagaggtctcgtctcggagagtgggtagacgacacgctcgtggcagcgggacccgtgtgcctgctcgtgcttgccgacagggcagtgaggctgcttgccgcgaagagatgccaccacgacagcaggagcgtctctaaggccgaggtcgggctgctgcagggacgtcccctcgagacgctcacccctataagtggggcaagcagttcgcagggcatacagggctcacagatgccctttgaggcgtgcagttctacttctgcgacccccaccatctatggcagaagctaacagttaagaacaccaacgggctcctgcgcgagttcttgacttcggaaaggtcacaaacgaggaggtgcagcatgcggtggagttgatctgcaacagagcgagggaggtccttggatacaggacagtcaacgaggtctttagggagatgttgcactcagtttgacaatctgccgcccgaaatattgacacaggtcactctacagtgaggctttgtattatagcaaggctttgtatcaaacaaggcagcatctcttcattgcaggcgggcttttcagctgaaagaccaactatcatctgtgcaaaaccaacgatacctacaagatgttgcaagcctaagtggccacgcacacgataaagggtgtcgcctatagcttgaaagcttcccctacactattgagaagatgcaagagtggcaactacagctgctctcaagtgttgatctcacactacagggcaaaaggtagtgtgttcttgttgatacttcccacgaacgggttgtagaaactgcccgctcacacaaacccatccgggccatgtcgaacgtttggatgggcagtgtatcaagggcatcctctctagacagccagcagctgctttcaaaatccaatatgtgcttaaagtccaacagccccttagcttgaatgagtgctgtgttatgggagtggatatagaagctgacaatctcgccgtacggctcacctccggccatgggcgcttggttggcaggcgatggctcaagtcagccaaccactattgcaacaggcacttggcatatctgaaaagccgactagacacagacaagttctgacaggtggccgacaaagggagtcggcgtgtgcgagactgcatgctcaaagcggcacgcaccatcaccaacttgtgcatacagaaagaacacagacacactgattgttggatccaacattggatgcaagcaggaagcagccacggcagaaagaatgatcaagtgttcatacagattccctgtaggctgtccaaacgctagcttacataccgatacatacagcagaaagagacctacacgtccaaagcatcctatatgggtggggatcgaatatacgcccgctgacaagtaagcacaccttttcttagacaagcgcatctgaggcggcctatagcgaacccaaagatagcatcttggtgaagtgcagacatcaacgctgccgtaaacattgcacacaagcaaaagccagcagagcggcaactgtgtagaggtgttgtggcaacaccccagcaaattcatgtcgattaaggcatgggtcacgccgaaatcccgtaaactgtagtttacgggaatatcaatttcccattagcaagaaagagaggggatatgtatggcaaacaagcctatacctggtacagatggtgacaactacgtaccatatgatcaacgttccagtcaggagtcagcagtttactttacccgtgacctttctgcagagggattgatcaaagccttcaatacagtcggtggtcatcttacaggaaagactggtgtcaagcttcacactggcgagccgcacggacccaacattatcccgcgtccatgggtcaagcagttgatcagcgagaagctgcctgacgccaatatcgtcgagacgaacaccttctatgtgggcggtcggcataccaccgctcagcaccgtaagacccttcagattaacggttggacgttctgtcccgttgacattatggacgaagacggcaccacggacctcccggttcgcggcggcaagtggtttgaccacatgactgtgggttctcacatgctcgactacgattccatgctggtactgacacacttcaagggccacgtccagggcggctttggcggttccaacaagaatatcggtatcggctgcgcagatggccgtatcggcaaaaagatgatccaccagggtcggcatccgggtcagtgggacatcgccaaagaggaattcatggagcgcatggtcgagtcctccaaggcgaccatcgattacttcggtgacagaatcgtctatatcaatgtgatgcgcaacatgtccgtgtcctgcgactgcgagggtgttgctgcacagccggtcgtaactccgaacgtaggtatcctggcctccacggatatcctggcaatcgaccaggcctgcgtcgatctggtttacgctatgaagccggaagagcatcacgatctggttgagcgtatgacgtcccgtcacggtctgcgtcagctctcctacatgaaagagatgcacatgggcaatgacctgtataagctgatcgatctggaccacgataacaagcgcattgttgcagcggatgcggtacaggacctgatcccatttggcgaggatgatcgataactcatagatattgatcgatagtatgagcggtgctcccgaataagaccgagggcgccgctttgactatctatcggctagaaccttgggcattgcactgagtatgaataactcactgggcatccggatccttgagggtgtgggtgatttcaccaatatacatggtgtggtagttcatgttaagctcacccttgctgtaccacttcttttttgcctcaggatcagtgaaagattgcggggataggaactggaccaaggctttgtcggcggtgaaggcaagcttggcttccttgagcactggagttccgtctacgaagagcggggtgaggccggttgccttgaacttgtcgatattacggcctgacttggtgccgatcagattcatctctttacggtaggaagccgggagtacgctgataccgaaggtgtcattgttgtccaggaactctttggtgtaacgggactcacgcacatagatcgtaacggaaggctttgtccagatattgccaaaagctccccaggcggcgaccatcatattgactttctttggggtgccagcagagacaatgagccaatcactgtagactgtggtgaaagggttcattgtggcgtctttgattgagatttccttaagtggcatcagtgctcgcatcctttatcgttgagttatgataaacagttaagtctatacccgacgtttgtctgctttaacaataagcgtgagggtctcaacagttgcgcacatcgagggaccacagcggtttggcatactgaactgcatacgcgtcgagcgaaatccaactgacggcatgatcgatcacggcgctgtcgttggaggcgacataggatagccccttcagagccctatcggcactcggcaccaattcagcgttgactgtaaaagaatattgatcacctatctcagtgatcagatgggcgagtcgtcccgaattcgacactggcgcatcgagatagaagtgcatacccttcacgtgtccttggtttccgattctgagcaacagctcgatcgcgcgtggcgtctcctcgatcggatggtaggtgcctgaaaggcccgcgagatcccggatggttccgtcttgcgcgaagatgataagggcgcggttcaaggctacctctagtgggataatctcgttgaatccgtcaattaagagcgtttgtccggcgagctttgagaactcaatctttttgaaacgccgtgcggtagccttattatgccccgagatccctcgggccaggagcaaccgctgccgttcggtgaactggtagtggttcgacacgaaggtgatggaagagtcacgaggataaccatgatcgagcagaaagctgagctctgtacccgccttcagaagcatctgaaatcgggacttgctgaaatcgtgttggtcgctgttttgaaatccgcgacatgtatgccgcaattcaccgtcacccatatccattcctgactcccactgtttagcctctatataccacacattcatatgagagagcggaatggggcacagaactactcctgagagggtgatatagccgatcccctccgtatgccaggaataatgccaggtaacaatacaatcgggtattttctcctagtcttactgcgcactgagtgtgagtttgttgcagtgggaatcctgcgctgtgggttgggagacccctgattctggtcacattcccgcatgtgtggaggaactgcgctgatcggattatcttcaagcacatatacctatgaggggtatattgatgccggtaaagggataccccttctgggtatcaaatacaaataatcctatgctaagggaggataagcacagctgacaatatcttggaggtgcgcaacctgaagaagacctaccgcacgaggttcgatggtttcgaaacggtcgaaggaatcagcttcgatgttccccatggtgaggtgtatggtttttttgggccccaacggtgcagacaaatcgatgaccatttcaatgctggccacacagctggaagcaaccggtggtgagatctactcggatggccactcagtgattggcgattcggtcagggcacatgcagagatcggtgtggttgcacagcacaatgtaggttggctgcccatgagaacctttcgtctcacgctcgttacttcgggatggacatgaaggaaaccagtgagaaggcagaccagtacctggagagcttcggtctcgtagactgtcagaatgactatgtctctacctattccggcggtatggctcagtgcctgaagatcgcgcgcaatgatgcacacaccgaagatcctgttttgaatgagccgaccaccggctttgatccgacctactgtgagatcctttggaaggagatactcaaccacgaggccgggaccacgatcttcctcacgacgcactacatagacgagccggagcggttttgcaagcacatcacgatcgtcagccacggtcagatcgtggcgcaggggactgtacctgcgctgaaggccttagtgccgacggacacagtcgtgaatatccggatgtccggatagacaaggctgtggtattctctgcggagaagctctcggacgtctcacaagcgaagctgcaggcaggggcgcgctcgctctacatcaaccagcaccagtcgaacttcgatgagatcttctgttgggctgagcggcttcacgagacgatcttcgatatcagcctcgaacagaccacacactcgacgatgtattcgtgtgcttgactggggagggaatgaataacaatgacaactagggtagtggaacagcaggactacaagaagcaggagagtcagattacccgctccgcgctctgggctatggtacagcgtgatctgttgatccaatgaggcaacatctgggagctcgtcttctgtgtcgcgatgtttccatctgtattgattctgatctatggctatattctgccgatgctgaacgtggtaccgcagtctttcccatctcagatgtttgcaggcatggttggtatgtccatagtgatcatggacatccacgggacggcggtgccgatgatgatggacttccacaatctgcatgaggttgagggtaggctgctcgtcctgatttcgacccgcatggtggccttctccaagatgtttgtcggcatcatcgagtcctttgtcagcagtttgatcgttctgttgatctcgctcatcttcatgggtggcaaactgaatgcgtcgatcatcctgcgggacattccgctcttcatcctgatcctcatctcgcttgtctcggcttcgcttggctttctggtcggtaccatcgtcgagtactcccagatcgcgcaatgttcccgggcttcctgggcgttatcttcttcacctgggagagcctttccgcgatccctgtgctgcaggtgatcgtctcggtcaacccgctggtctatgccaatgggaccctgcgtgcgatcatgttctcctgaatccccatatggctctgggctggagcctgaccgggctcatcgctgcgatcctcatcgtggacggtttcggtatgaagcgcttcatccggatgacgactggcgttgagaagtaggctcaataccgtataggtatcaaagcgtcttagggagaggtgctccttaaggtgctttttgcttagttgtcgggcccctagtacaattgcctgatttaagatcctgctttgaggtgatgccatcgcagtgtatcgttgaagctacgcagataccgaggagagggttttcatatggatatcaagaaggtcacggttgccggcggcggtgtgttggggagccagattgcgtttcagagcgcctactgcggctacgatgtcacgatctggttacgttccgaagcttccatcgggcggtgccagccgaagctggaccgactctgtgaaatctatctgcagacgctggaagcgatgaagactttcagccggcaccatgcggttcgacttttgcaaaggcaaaccgtagacctccaaaggcatatgtttcggaggtcttcgcctgacgctcacctcggcggtggattttttcacagatctcgattggcaaagtggagggccagatacgctttggctgcggcagcaggtccgcgaaactgaccccggcaacagcgggctcgagtttgtacacgatcactctggacaggtacgtaccaatgttgtatagaaagcagttttggcccgcattccactgcgatggcatacaatacaacgtcggcatccacaaaggctccgcataggaggtcgtaaggttgattgaagaataagcgtggaggacctgctgcttggtcgtccaggtgccaggccttacctcctccctttgcacaccggccgtaggcataggcttcggatcctt

SEQ ID NO: 405 - DNA, 13598 bp, Unknown
  Metagenome-assembled genome
ctgtaccgaacagacgactacacagaagcgccatgtgttcagctacacggacagataaaacgatcgatctctatacaacaggtgcaggaaaatatcaccgccgtactggcgagcttacctacccgaacaagcacaccctgcacaactggatcaatgagtatgagaccggctagggtacccgctccctcgcaggaacggccacagcagaacctactaccaccaacaccgcgtgactaagtgcgctgcgatcgaccacatacaagcaagccacgcatgatcatcgccttcacacaccgcaggcttagcttctctcaaggaaaaaaagctcctgggagaatggttgtcggacccaaaccccaaatattgccacccttgagcttaaagaaaaggcgcccccctcaaatgctttctgttagcatggcttttgcgaggaaagcgcaaagagcttgagccaccgtaaggtacactgacttgtgcagtacctagcttctcgcaaacgaaagagtcccccgtaaaccaaagccacaacgacaatgactggccagaagcgctgcaaagaggaccgagcctgtctgggggcagctcgactggtgcccgaattcagaatcgtccttaagcggggatgcatcgctcgctcacagacacgacagccaaggcgctgtggcgcgcaggaagacaagtcgcctcttaacaaggcgcaagccgctataacgtagagggtacacgctattgccacaaatccaagctgacgctgcctccttagcgcaccttcgccgctcacgacgcacaccactaccttacaggcgacgacctacgtgtcgtagcttgcgcctgtcacactgagtcgtctgcaccttgagctggacactgccatatcggcgatcacatatccgcgcaaggaagtcttatgaattcggcctactgtcaagcgtatggcgttttcgctcattggccaaagtacgtgtcccacaccaatgcgtgcttttaggtttcgacagtcggcgataggtgagctctttcggatcatgaagttcgaggtacaacgaaggctggccctgtgacagcgctactcgtcaagattccaccaaaacgatacaaaaagcctagtttgtctatcacatagagctttcgagagcctctatgactcaaagctgacgctttaggatgtggagtggtgtgtttaaacagctacgcagcagatgcacttaaagctaattagaatgagcccgatcgattttagggaagagtccctcacgtattccgtcaatagatgtttgccaatcccaaggcaacctctagcccagaccgcatgaacggctcaggaggaccttcaagccgccttaagcgcagtgcgcatgcacctggagagggcttgccgcatactgcaatgatcgcacctgtggcggaatctgagaagaagtcaggcacagacgtaccgacatcgtggcgccgtcgactctagactcggcagtgggcgcagtggattccgatcaacaccaacagatccggtggtgctagcctaagtgtctatgcttacaagaacacggacaatggtatcagctggctcgtgtactcgcgctgctcggacctggcatcctgcgatttcctggagagagcgagaggagacaggacaaggtcgaggccagcagaaacggtcgtaccctgtaagcggtcagtgacaggcgtcgtgatgagcgcttcttccgctgccgcctagcttcatccacaaggaccaacgtaagctacaaaaatactcctcgttgtcgtcagcgacgacccgtccctcgccacggactcacacccagtactaaactcggcacagctcgtagggcttacttctgttcgggaactgggaaccaaggtgtgaccatcccctgccataatcgactcgaccaacgaggaatattccttgtgagggaacacgtgtaccttcaggtaggcgcatagcaacacataggcaaatatatatcgcatactggttcgtaaaaagaagagctcgactgccattagtgccgctggctcaactgcattgctgcatagcgcatattgagcccttgcctgaaccgctttttcgatctcctgcgcgtagcacgcacctcaaccatcttctgtcgcgctgatttgcgttgccaccctcatcgggctaatttctttcacgcttacggcggtataactaccgtttatcggaaatatcgccctgtcgcctaaaaacatgactaattaccggagaacagtttgtaaatgcatcctacatatatacgagttttgaaacatctaacaaataaaataagtattttaacattgcaaaacacctggtaaattatgcatttaaactttatgtgcaaaatgtggaagtaaacttatgcatattgtaagaaaattatgcaaaatagtaacaagaactaatccaaaataagctgagagagaatcgtgttagatattgaaaaccgttacatttgagctccgtaaaaatgcaaggtctttggaaggaaaagacatgaagaacggagtacaaattcacacattacacaattcagacgctaccgggaagatctccagtgggaggttctttgatcacatactgtggaagaacagctcagagctgttaggggagctcgatgcgaatcatattgtttgcattgagacgtgcctgccacagaacctggagtccctctttacgcatatggccgaagcggtcgagagacggggaggcgacgttgctgcctgctcatatgagcatgtgaaagtttcggacctcgctgaaagcctggaaggtatagttcgacagttcgcttccaaacacaccggtgggcgcacgattgttatcgtctgtgacttgcccgagattccacaggatcagctctcttcaattgcccgtctcttccgctatctcaatcgtcatcacctcgaagtcgtctgcctagtggagcccaagaacgctgcactgcttgagtacctgaaccgtgccggggtgatgggctcagacaggttccgcatcactcaaggggagggggatctctgggacgctccggtcgcctttgatcaggcgcttgcactctcaaacggtgcgtattctctgatgcaggttttggagggctgtgagggagatgaggcaggagggctcacgcaggcagactgtgcccacttcggggaggtgcttgaccgttctgtcaccgaggcggcacagaccttctcaagcgagcagcgtcaacttctctatacgatgatcgcctgtgggaaaggccgcctgagcgatgttctggcagtcacaggacaggggagcggtaaagatctttccttcatcgcacactttcttcccctcgtttcggtcgaggagaagacgaatagcttctggtgcggcgccgtcgccgatgagggggtcttcagataccttccgaagactgttgcggcaatcaaggccttcccacaggagcagaagcggcggctcatcgcgatgacggaacagcagggcgcctatgcgcgcagcgcgtatctcattgccaccttcggcctcaccgatgcagtggctcggcatctggtgcgtgaggcgcctcactatgtagcggccggaagcatcaggctgatcagacaggcactggcggctacgcaaagccaatcctcgctttcccactaccgtgagcaggccgaactggcgtgcacgctggcttgtgggaaccacagggaggtacaggctgccgaaaagcagttcagccgacgggaccgctctcaggccgaaccggtgcttgtggcgctccgtagcatgcgtgagagcctgaacagccccaaggaggccgagcaggcgctctcaggagataccattcctgtttcactgcgatcccatatcgcctgttggaagaccgcctgcacgaaacccgaggaactgcgggcgcgcctcaccgaggcgatagatgagcaggatcagtgtgcggagctcttccaggcagactgccgttttttccacgctctactcgatgcgcagaccggggtttggccacagcagctgttgagccgtgaggatgcatttggcctgtgggcccagacactgttcctcggctacaaggcactcactgccggtgaggctgtcctgggtgaggcccaaggcatagccaaggcgtgggataccttcggcgacgcattgggctcagcccttgcgcaccttatctgcgcggtgcagctgatgcgtaacggctcgcctcaggcagcgtatcctgcgcttctgaaggcgcagcctatgctcaggggtcaggacgcgccgtcgctgactgagataatcgtgctgctgcgtgcgcagatccaatacgacaagcagccctcggtggcagaacagctcctgggctcctgccggagcactgacggtaaggcgatcggcgcctggatccgcgccgcccatggagggtatgagctgaagggaagcgaggcgccgctgccggaccacctgctgtggtttgcgaagctgctgcgcgaaagcgaccggaagttccagaagagcgcaccggtggagtgggacatccaagccggacgctggggcacatccaaacaccacggtgagtctcaggcctcacagctgctcggcggcagaccgtgcgtacgggcaaagggagaaggccccaagctgctggaggtctcgatgctcggacactttgaggtcaaggtggacggggagccgatcctcctgaaccgctggccaagaagatcctcccgcgtgcttttgggcatgcttgtggccaaacgcggccacacaatcaggcgcgtggacttcctgaatgcggtgtggcccggcgtggactatctgaccggccgtccccgcatctatgcagcagtctctacgcttcgggatgttgtgaagcagaaggggaccaccacgaagttcatcgtcggcggggatggcaggatctcgctgaaccccacctgcgtgatctgcgatgtggataagtgtgaggcgctcgtgcgggagatcctctcccgcggcaccgacgatgatcggctcttccaagcgacccaggacctgctggagctctatcagggggatctggttgtctccccgcaggatacgtcgggcatgatgctgagaagagaagaggagctgaaacacgcctatgtggatgccctgactagggcggcacagcgcgcgcttgaggtcggccccatcccctcagcagcgctcttcgctaaacatgcccatgaggccgccccgatccgcgaggatgtgatggcggtgtacgttaaggtcctcgcccgtcagggccggtacgcggagatctggggagcctaccgggagttctcccagcagctcttcgatgtgatgggaaccgcgccctcagcgaagctcaggatgctcctggaggcgatccagagtgaggaaggggttgcatcacccgaaaaccgatccgatcggttgctctgagttttgtagaaagcctgcgcctttactattctgactcatcaagagttaggtgaaattgggtattgttattctaaatgagatatctctacgtgcatacgacggatgggcggagtatgcgcttttcctgtgaggagtagtatgccaaattttatctcccgattactttcgatgggcgcgaataagcagctcaaggagtttcagaatgtcgttgataggatcaatgagctcgagtgctcgtacagccccgacaagatggacgatgaggagctctcccatcagacggtgctcttccgtgagcgtttggcaaacggggagtcgctcgatgatctgttgcctgaggccttcgcggtcgtccgtgaagcttcacgccgcgtgacgggacttcgccacttcgatgtccagctgatgggcggcatcgccctgcaccgcggcatgatcgccgagatgcgcaccggtgaaggcaaaacgctggtttcaactctggcaggctatcttaacgcactggaaggcaaaggcatccacatcgttacggtgaacgactacctagccaagcgcgatagccaaaacatgggtcgcatctataaatttctgggtatgtccgtcggcctgatccagaacggcatgtccccggcgcagaaggttccggcctacaaggccgatgtgacctacggtaccaactcagagttcggtttcgattatctgcgtgacaacatggtcacacgtcccgagatgcgcgtacagcgtgggcaccactacgcgatcgtcgacgaagttgactccatcctgatcgatgaggcgagaaccccactgatcatctccggtgccggcactaaatccgcaagcacctacaaggactttacccgagcggtcagagggctcatccccgatgaggactttgagatggacgaggcaaagcacacgattgccacgactgaccagggcctgaggaaggttgaaaagcggttgggtgtcgcagacctctactccgacgagtctggacagctggtcaaccacctgcagcaggcgctgaaggcggagtacatgttccaccgcgatcagcaatacatggtcatggacggggaagtcaagatcgtcgatgagtttaccggccgtatcatggagggcagacgctactccgagggcctgcatcaagccatcgaggccaaggaaggcgtgccgatccgtgaggagaaccagacccttgcgaccatcactctgcagaattacttcaggctctacgacaagctcgccggcatgaccggtaccgctatgaccgaagacgccgagttcagggagatctataacctgccagtgcaggtcatcccgaccaataagccggtcatccgtgtggaccacgatgacctggtctaccgtacgatcaaagccaagtttaacgcggtggccgatgacgtggtggggcgccacaggaaggggcagccctgcctggtcggcaccgtgtccgtcgagaactctgagaagctgcgccgcatctttgagaagcgcggcatccatccgcaggtcctgaacgctaagtaccatgagcgtgaggccgcgatcatcgcgcaggcaggtcgctacggcgcggtcacgatcgccacaaacatggccggccgtggtaccgatattatgctcggcggcaacccggagttcctggcgcaggatatgatgcgcgaggacgggatcgacccgaacccggaggcagagatcgatctgaaggatccgagatcagtccttcaggcaagtatcgagcgccaaaacgtcgatatgcagatgccgaactatttggcgaaagccaagaagatcaccgacgcggaaaaggaaaaggtcaaagcggtcggcggcctctacgtaatcggcactgagcgccacgaatcccgccgtatcgacaaccagctgcgtggccgttccggccgtcagggcgacccgggcgagacgcagttctacctctcgctcgaggacgacctgatgcgcctcttcggcggtgcccgcatggagaggatttcggccatgatggagagggccgacatgcccgaggacatgccgatccaggccaagatggtcaccaaggccgtcgagggcgcacagcgcaaggtcgaggagatcaacttctcgatgcgtaagaacgtccttgactacgatgacgtgatgaacaaacagcgccaggtcatctacgaggagcgcaacaagatcctcgacggtaaggacctgaccaagcatatctctgaggtcacccacgacacgctcgaacgcaaggtcaacgagtactgcgtggagggcagcgagccggctgagtgggatctcaagggcctgaacaagtggcttgcggatctgaccggcgccaaggagctgccggagatctcagacgagatgagccgcgaggagatcctcgagaagttcttcgacttcgtcaccgaccgctaccgcaagaaggcggacttcatccgccagatcggcacgtcgatgcagaaggcgaacagtgacacctcaaagaccgacccgatgaacgacttgtcgatgcgcatcatgctgcgtgtgatcgatacgcggtggatggcatacctgcaggagatggactacttgaagaccggcatcggattgcgcggctacggccagcgtgacccgttggtcgaatacaagaccgaggcctacgccgccttcacgcagctcgtgaatacgatgtatgaggacttcctgcgcgtcatcctgcgtatccaggttgtggcccaagcccagagggtgccggattcaggtctgccgaaaggcgcccgctactccggaccctccgatatggacggctctcagcacccggtcccgcggcaggtgcgctccagtgcagccgcgaagcgcaacccgcagcgtccagccacccctccgcagggcaagccgcacacctaccgcaaagaggaggatcctgatccgtatgccaacgtcggcagaaacgatccctgcccctgtggaagcggcaagaagttcaagaactgccacggtaggaaccggtaatggcagacgaacagagcgtcactgcagaggaactcgacggacttgagcagcgcctcaaggccgtcgagggctacttgcacgtgccgcagaaacgtgagttagtcgcagagcttgaggccaaaagcgccgcgccgggcttttgggacaatgcccaggaggctcaaaagacgatctcccagctcaccgaagcccaggaggacgtgaaaggcatcgacactgcaaaacagcagctggacgatgcccgggcagccttggagctcgccgatgagaccggcgaagaggacctgcgtgtggaagctacccatgaggcagcctccctcaaaaagactctctccaacctcgagctttcgagctggtttaccgacccgatggaccacggcgacgcgatcgtcacgatcaccccaggccagggaggcctagaggcgcaggactggtgcgacatgctctttcacatgtacctacactactgcgagcggaaaggctggagcaccgatgtgaacgatgccccgcaggccgaggtgatcggtatcgaccgcgccacgttcacggtgcatgggaagaacgcctacggcatgctcaaagcggaacagggcgtccatcgtctcgtgaggatctcgcccaccgatgagaagaagcggcgccagaccacctttgcgggcgtcgaagtgctcccggtccttcctgacgatatccacgtggatattgaccccaaagacatccgggtcgacgtctaccacgctacgggccacggcggccagggcgtcaacaccaccgactccgcggtgagaattactcacctgcctactggcctcgtggtgacctgccaaaacgagcgcagccaacttcagaacaaagagtttgcgatgaagatattggagagccggctctatgagttggagaagcagaagcgcgaggctaagctcgacgagctgcgcggccccaagcacgagatcgggttcggcaaccagattcgcagctacgtcctctacccctatcggatggtcaaagatttgcgtagcggggttgagacgggtaacgttgactccgtacttgaagaaggcgatctcgatcccttcatctatgcctatcaccgctggaaggcggataaggagcagaaagtttgatcaagaacggtgccgcatcccgtgcagtacgtgacacagtgattatcgcagccggatccttgctctttgcagtggggctcgactgttttgagctaccgaacgggcttgctgccggcggggtctcgggtatcgcgacgatcatcttcgccctcggtcagcgcgtcgatgtctacatccccgtaggccttcagaccatcgcaatgaacatcgtgctgctggcgctcgttgtccgccaacgtgaccggcgctatttggccaagaccgtcgagggcatcctcttttccggcctttttaccgatatcctacagccgatcgtgccggttttgggcgaaggtgagctgctgctgtgcgccctctggggcggtgtgatcaccggtgttggtttgggcctcgtctttttggctggcggcaataccggcggtaccgacatcatcgcccagctcttggcgcgccgtaccggcatcgcggtggggacgatgatggtcgcggtcgatggggcgatcgtgttggcctccgccccggtcttctcggttgagaatgccctctacgccgcaatcgcgatgtacatcagcggccgagcggtcgatatggtcgtcgacggcccgcgtgcggcccgcgcggtgtacatcatttcccaaaagcacgaacgcatcgcacaggggatcttgcactcgctcgaccggggctgtacgcagctggaagcgaccggcgtctacagcaaagcgccccgtccggttctcatgtgcgttctgggacgctccgagacgacgaagctcaaagatctagttgcggagatagaccccgatgctatcgtgataatcgcggaagtgcacgaggtgttcggcgaggggttccgacggctggaagattaactgtgtgagtcatgcgtgagctttttgcgtgagcgattccaaaaagaggctgaatgtctctctttccgctgtgtggtgtagctatagtgaaagagagctcatatgggtgagccgtcttgtccacagtgacgggagttatatgactgctacgagcgagagcatgccagcgcgctgttcagtgcacgaaataaagctcatggccaacacgatgcgccatgaaatcatacagatgctagcacgggccggctcgggtcacccgggcggctcgctttctgcggtagacgtaatcgctaccctctatttttccggcttgatgaactacgacgagaacgatcccacctgggagggtcgggatttctttatcctctccaagggtcacgcggccccagcgctctacgccgcgatccaccagttgggctgggtcaccgacgaggatatcgactcactgcgtactctaggctcaaagctgcaggggcaccctgattctaagatgaccccgggcgtggaggtctgcacgggctccctgggacaggggctttccgtaggcgccggcgcggcactgggcttcaagctcgatgccaagcgcgccaagtgtgatgcgcgccgggtttttgtgatgacgggagatggggagcttcaggaggggcagaactgggaggcaatcatgtttgccgcgcagtatcacctcgataacctgatcctctactgtgatatcaacaacctacagatcgatggcagggtcaccgacgtcaattcgctcgggaacctctcggcggagctgtgcgactttggctggtatgtccaggaaatcgacggaaacgacgtcaccgcgattgagaacgcaacgcgcgcggcgcttgcctatgggggcaaaccctgcgcgatcctgtgtgacacagtcaaaggcaagggtgtctcctttatggaggatgcggtcggttggcacggaagtgcgccgagtcaggaacaggctgcaattgcgcttgcggacctagaccgcgagcgtcaggagcttgagagtgaggacacttgtggctgaagtaaaagcgacccgcgaggcgttcggcgagacgctcattgagcttgccgatcaaggggtggatgtcatggcggtcgatgcggatctcgcaggctctactaggaccgctcagttcggcaaggcctaccctgaccgcttcgtcgatgtgggtatcgcagagcagaacatgatggatgtcgcggcaggcttgtccctgaccggcaaggttgtctttactggttcctttgcggtcttcggcaccggacgctgctacgaccagatcagaaacaccgtgtgtgactcaaacctgaatgtgaaggtctgccccacgcatgccggcatcaccgtgggcgaggatggggcgacccaccagatgctcgaggatatcaccctgatgcgcgtgctccccgggatgcgcgtgatcgtgccggcggattactgggccgccaaagccgcgatcaggctcgccgccgcgacggacggcccggtctacgtgcgcttgggccggcacaaggtgccggtggtctacgataagaccttcaaaggcaagctgccactcgccaatgtggtgcacgagggcaccgatatcacgcttgcagcctgcggcgttgaagtctccaaggcgctcgatgcggctgagatccttgaggagcagggaatctcggctgaggttctcgacgtcttcagcgtcaagccgctcgacgaggaggcgatcctcacctctgctgcaaagaccggccatgtgctcacctgtgaggagcattcgatcgaggggggcatgggctctgccgttgcggagcttttgggagaggagcttccgacgtcgcttcatcgggtcgggatggttggctttggcacttccgcacctgccgatgtcctgttgcatcacttcgggctcgacggcgagggggtcgctcacgcagcttgggcgatgcttgcttaactgcatggccttgaacgacgcgccggtacaggtttgtttaaggtttaccggctaaatcgtgcatttttaggggtgcttgcctcttcgatttaaagaggtaggcggttgcttgctatactttgtgagcgtatatgctaatccagtacataactgggaactattaaggagcttttgtggccaatcacttccgcagtgcggaaggttcggataccgagtcactcgattccaccggcgatctgaaccagcccacagaaaacacgaacgaagcgccaggcgctaagccgaatgaagaagcagataggggggatagcgtggcagacagcactgaccaaaatccagaggtgtcagatgcggatctcgaggaaaccgatgatacggcaaccccatccccggacgataccgctgcgacggagcaggatacatcgtctgcagatgaggaaccggaccgtatcgtgaacgtgccatcacctgcgacaatctcgcagaatggtaccgttgagcagcagatgacgccgaaggagccggtcaatccctatgccagcttggcccgggataccgcgaatatcccgcacgagggaacaccgacgatctcctttcaggatgtaaccctgatttatccatcacagccgaataagccggcgctgcagaatgtcagcgtggatatctatcccggtgaatttgtctttatcgtcggacactcaggatcaggcaagtcgaccttcatccgcctgatcatccgcgccctgaaggcgaccaaaggccgtgtcgtggttgcgggccaggatctgacgaacatgagaaactggaaagtcccgtacttgcgccgccagattggctgcgtctttcaggactttaagctgctgccgggcagaaccgtgtctgagaacgtcgcattcgcccttgaatgcatcggcaaacccaagtccgttatcaaggcacaggtccctgaggtgctgcgcctggtcggcctgcaggacagaatggatgccttccctgatcaactctccggcggtgagcagcagcgtgtcgccgtggccagagccatggtgaacaggccgccgcttttggtgtgcgacgagccgaccggaaaccttgacccggcaatctctttgggcatcatgaaactcctcgatcgcattaaccgtgccggcacgacggtggttatggccacccacgaccgtgagatggttgactcgatgcgtcggcgcgttatcgcccttgaggaaggccatgttgt

SEQ ID NO: 406 - DNA, 3484 bp, Unknown
  Metagenome-assembled genome
tcgcccacaagaagcgggcaccgaagcgcgattccaaccagatcgctctgaacctggaagcggtgggcgccaaggacgccgatgagggagagccaatcgatgtcggcggagaagaagagatcgacgaagattctctcgaaggtgacagcgacgaataaccgggtggattgtcaagctgagtgatctccctaaagacctcgttggccgtcctgtagcctaataccttccttggcctgtcgcagaccagatccaagacatgttgtacctccttgtgtgagacccaggaaaagtcgctgcccttaggggaagaactcacagatgaggacattggtgttcttaactatcggcttctgccataggtggtgcggctcgcagaagtaaaactttacacctcccaaggcttttgcgaccttagccctgctgggagagctgcttggcacaatcaggcgtgagcgtcttgagcgaaaacccctcaaggacactgaagttgggtagcgcgcacgcccttgctacccacaagcagccacaaaggagtgcttggacaagacccacaggcacgcagaggttggcctcacgacagtgtcggtttgtccacttacccagacataagcgcttagaaagcctcccttagggaaacgatgattaatgcctatgccagccgagaaaagtcgtgtggtcggtcctctctgacacgttatgggcattaatcatcgtttccctaatgcctttgcgatgttgctgggtgagtagtacctgacgtacatcttcgcgatcttgttgcgctcatcagcgctaagataagtgtagtgccgtgggaataggctggatcctcatctcatctagttgcaagctttcccacttgttggcagtggttagcacctattggcacgactaggacaaagacacctggactttccgggagtgaaaaacaacagctgccccgaattcagacgatctcgtgggggcaattctattgctgttgaactgggaaaatacttctgcatagctttcaagagagcgccgcgatgacactcgtttggatgagagacgaatagatgccaaaacctgccaaagcagtgacgggcgttttcaccgcgtttttagccatggaggcgtttggtgccgtgccatgtagtcacctcgctatttcagcccctttttacaaagccgcaggtaggagcgaagagtgaaaaactgcccggaagtgcgctttttgccgcttccagtccgatttcaggactctagaaatgtcgttttctactcttctcactatgctaatcggccgatttcggagatggattaggccccaaaggagggcaatagtaatgcgagagcgaagatcgttgtgtttctcgaagcgctgtcaccgatgcgatggccttatcagaaagacgcactgcgccgccttcaagagagtacggcactgtgtattatccttaagccgacggcatgttcgagtctccccgtgaaccgccgcctgcccttagcgctcgtttgcctcaagctcctcaagggcagcagttgtctgggcagggtcgttcgctcccaggaggtaggctgtgccgtccttcgtgcgcacaaggagccacgggcccgcttcggggttcaggcacaccttgagaggcccgtactcctcactcgagaagtcaccctcaaggaaggtgtccgcggagcctccgaacgtgcgcgtcatatctgggagccggtcaagcacctcgacggaagccacgtcgccgacagcgacctcgtagtccgtcatcgcatggttcgcgcggaccgtttgtccggagagctccagcgtgaccggcgccgacagctcctcggcgatgaacacgccggtcaggggcaggcagagcagcgcgagcgcgagcgccgccgctatcgcctttccagcgggccgcgcgaagttgatcgacgtgccgactcctacgcggtcgttcaccatgaggctggagtcgtcggggttgaagtagaggagcccaaagacccagtggtcgtcctcatcgacgtagaacccctccccgctgccccttgtgaggcgttcctgaaggccccgcacgcgcatctcggccgcgaaggaggtgatgaccaaggccgcggtgagcagaaccatgctcacgaggtacaaggtgggcgagccctggaagaggagttgcagccagctcatgagcgcgaacgatgcggccgcgactaggcccacgtgcccccaggcgcgtctccggatgcgcgtgagcgcctgtgtgagagcctcgttggcgtccactacctcgctgcggtcgcggtagcaccagcggaagatcgcccacgttgcgagcgcgccggcggcggagagcaagtagaccggcaagctcctgcggtcgagcaacacaggcgccaagctggctgcgacggagaggagaaaccaagcgttcgaggtgcgcatcgggggctgggcagccgtggtgatgtcggccaccgtgatgcgctgatctccactcttccctccgtgttgccacccgcgttcgcccttcagggcggcgagccttgcgtttgcgagcgcgaagacgacctccggggcgatgcaggcgacgaggacccatatgctccagcagaccacgagcggtcccgcgagcgtgcgaactgaccccgcgacggcgcccgccagggcgatggttacaagcgtggcggcgcaggcgagctgccagcggcgataacccgagaggattgccgtgacctgttcgtctccctgcgcctcgcgcggaagcgtcactcccactgcgatgttcttcttgaagcgggcgctgttcctgagcgtgagccatatggggatgggaagccagcagcacaaaagccagattgcggaaacagaactcattgcagactcctatctcttcgagaggaaacttcgtccaggaggtgttcgcagagcacaagcacgtcctcactcgacatgccgcctgctacgagctcgtccagcgacagccgcagcgactccacggcgccagggctgggacctgatccagcgtccggttctgtcacgaaggtgccgccgtgccggtctccctgtacgtgcccttcctgcttgaggagctggtaggccttgcttgcggtcatgacgttgatgccgcactccgatgcgagggctcggacggtcgggagacgctcgcccggtgcaagctcgccttccgctatggcccgcacgatctgattccggacctgccggtagataggggtcgtgtctgagaagtccagcttcaggagcatgatgtgcgcctcctacgattaatgtactgtatatattagatacagtaatacataaatgcaacaattgtaaggaaagagggagaaagtactagtcgtccattacagtttgagacgcggttaattcgaatatctcaaccctgatcgttaccgacggattaggattggcgcacgtactttccgacccgccgaccggacgcccgcggatagccgtctgcccctgcccctcgagggctcctggggt

SEQ ID NO: 407 - DNA, 29568 bp, Unknown
  Metagenome-assembled genome
tatcaacgcactgcaagaggggatttagcgtggttatatatgttgtgttcagatgggtattctatactcaatctgtatgtataaaccagaaatgagaggacgagtcatggctgaggaggcaaaggacccgaagaaactcttcaatatgtatgtagcgcacgtgggcatcaacgcttcgaccgacgaagaagtagagtccattgtgagtgagttccagacgctgatggggcttaaacgcaacgaagtcactccggcctcactgtttgccgatcactttattgaagtcatgcgacccggccgtggccgcggtgagaaaggccacatcggcttccacgtggacaatgtcgacgaggccgaaaagtggttcgagaagcgtggctttgagatcaatgaggattcacgcgtgaagaatccggacggctcgaccttcttggtatatttcaaacatgagattgcaggctttgcaatccacctgactgttcagaagtagtgggagtttttatctttgattgtacttgcagataagataacgaaatcatttggcagccgcgtcctctacgcggctgctaccttgcagctcaacgcaggggagcgctgggctctcgttggtcccaacggagcgggcaagacgacctttttgcatattctgatgggtctggagacccctgatgaggggaccgtgtcctttgcaaaaggcaccaccatcggctacctggagcaggagacggagatctcgggagacaagacagcactacaggaggttatcgactccgccaaagaggtcaagcactgggagaggaaagtccacgaacttgagaacaagatctcggtgacacccgaaggcgacgcgctcaaccatctgcttgaggactatgcgcacgcccaggagcgctttgagacgctcggcggctacgagctggattcccgcgcccgccagatcctcactggtctcggattcccggttgaggatctcgataaacctgcaaaagatttctccggtggctggcagatgcgcattgtgctctcgaagctgttgctgaggaatccggatctgttgctgctcgacgagccgaccaaccatctggacttggaaagtgtccagtggtttgaaaagttcctcacctcctacaagggtgctgtcctgatcgtctcacacgatcgtgcctttatggacgcctgcgtctctcatgtagctgctatcgaaaaccggtgtattaccacctacgtgggcaactacaagagctacctcaagcagcgtgaggataacctggagcagatgcgcgccaagcgtgctgctcaggaacgtgaaattgcacacatgcaggtctttgtggacaagttccgctataagccgaagaaggctgcccaggcgcaggaacgcatgaagcgtatcgagcagatcaaaaaggagctcgtgatcctgcctgagggcaccaaacacgtacacttcaagttcccggatcctcccaggaccggcgatgaagtagtctcgctcaaggaggtctccaagtcctttggggacaaccatatgtacacagatgtgaatctctccttctaccggggagatcatgtcgcgctggtgggtcccaacggcgccggtaagtcaacgatgatgaagttgatctgcgggatcttcaagcctgacaccggaaccatcacgttggggcaaaatgccacctgcgcctattatgcgcagcaccagttggaagagctgcactccggcaacaccgtgatgcaggagatcgactcggccgccccgggttggacgagctcgcaggagcgcaagctcttgggtgccttcctcttccacggggacgatgtggacaagcgggtctcagtcctctccggcggcgagaaggcacgacttgcacttgccaagatgctcgtcgagccggcgccactcttgctcttcgatgagccgaccaaccacttggatatcgactcggtcgatatcctggaggatgccctcaaggatttcccgggcacgatcatcctgatcagccacgatgaacacctggtgcgcaccatcgcaaacaaggttgtggatatccgtgaccacaaggtgacgctctacgatggggactacgagtactaccagtggaagcgcactgagctggaagcccaggcgcagggtgacagtaacaaaatccctattcctgaaaagaaacaggcgccgaaagttgagaagctcaaggagcagaaacgtgcggaggtcggagcccgccatcagcgccagaaagcgttgcgcaaggacaagaagcggctcgcggagattgaagctgcgctcgatccggcgcatgagcgctacgacgagctgatgaagcagatggcggacgagaagctctacaacgacaccgacaaattcaatcagtgtatgcaggagtaccaggcactgagcaaaaagatcccgaagctcgaagatgagtggctggacctttcgaccaaaattgaggaagctagcaaagcatgaataacaggcaaataatgtccgttctctcccgggtagctttttggctgggcattacctggtttgtgatggtcgtgatcgtagctgtctacagcggtacctcacgtcttgtgatcgtcaaccttaccgatgccctgtcacatctcctgattcccgccctaaggggtatgctggtatacccgttgccgtttgggggcagtctgcgcggtgacttcattatcgctggggtaatcctgatgattatcagtaaactattgagctactatgccgatcgtgcccaagcctgaggaaggataggacttgtacacttcgttttctttattgactctgatcagcgccgtcattgaggtggcgcttttgatgttctccgcaatcgtgcacgaggttgcccatgcatggaccgcagataaactgggcgacccgaccgcacgggaagcggggagactcacgctcaatccgcttaagcacatcgatccctttggctcgatcatcctgccgctgatcatggtggtgctgcgtggcccggtcttcgcttacgcaaagccggtcccatacagtccctaccggctgcgcaatcccggccgtgatgacgcgcttgtcgcggcagcgggcccgatctcgaacatgatccaggcgctcgtcggtgccctgatctttcgcatcatcgatgcgaatgtggtgtttaccggttacaccggctggttctgggtgctctatgtcctttccgcctatgtggaggtcaacctgagcttggccttcttcaatattctgccgttgcctccgctggacggctcaaagctgatcctgccgctgctgcacggtgaggcccgtgaccgctattaccagatccaggcttatgcgctgccgatcctctttatcctgctctacctgttgccgatcatcttccatgtggaccccttgggcatctacctcaacttcactgtcgacaacctctcgaatttgctcttaggggcctgatcgagcatgccatcgtatcgtgtccacacgcaggggtatactggcccgtttgacctgttgctgcagcttgtcacccgtaagcgtatcgcaattggctcgatctcgatcgccgaggtgaccgaccagtacctcgaagagatcaaccgcatgcaggatcttgacttggaagtcgcgagcgacttcgtgctcgtggcttctatgttgctggcaatcaaagcggcctcactggtcccagatgaatcggtggaggaggattccagagacgacgaggacgacgagttttcgaacatgacgaccgaggaagctcgggaagtcctgattcagcgactgatcgtctacaggcagtaccgcaatgctgcagcggcactggggagccggatggagtccacctcacagatgatcccgagaacggtgggcccggaccctgaattcctgaacctgatgcccgactatacgagggggatcacaatcacctcacttgctgtgatctgtgcagatctgctctcacaccgccagcacttcctgctggaggcagagcatatcgctttgaagcgagttccccttgctctcgttatggcctccgtcgaccgtttcaccgcctcccgtggaaagtgcaccttcgaggaggcgctgcaggggagcaaagatcctgagcatgtggtggcagcctttctggcgatgctgaccctctgccaccggggatcgcttcagatacaccaacaggagaactttgctccgatcgaaattgtccgggtccaaggggcaccggcgtataatcccgatgagggcttagacgaatatggggaggattaagcagtgagcgatttggaagtatcggattcaggatcgctgaaaggtgcgctcgaagcgctgctcttagtctcctcggatgcggtgtccgcgatagagttagctaaggtgaccggagcccgaccgggcgaggtcgaagaagccttagcagatttgtctgcggagtatgcagacaagaaccgtggtatacagctgcgtgaggttgcaggcggctggcgtctctttacccatccggcctaccacgatcttgttgagtcctacgtcctttcctgggatacaaggaagctctcacaggcagctttggagaccctgtcggtcattgcctatcagcagcctgtcacccgtgaaggggtcaaggcggtgcgcggtgtcaactccgaaggcgtgatcaattccttgattgaaaaaggcctgattaaatcccttggtcgcgaccctcagcagggcaacgcaatcacctatgggacgacgaaagcgttcctggagcagtttgggctccgcagcctcaaagacctgcccgacctggaagactttgccccggatgaggagtcaaagagatacatccgtgagcggctctctgatgtgcccttatccacctcgcctgaagaagctgacgaggatatggaagaggaagatgagctcttagataccggatccgacctccttttcaattcagcggatgaccaagagactacagagggggaacatggcggagaataataagctgtatcccctgcgcctccagaagttcttagctcgcgccggtgttgcctcccgcagaggctctgagaatctgatgaccgcagggcgggttaccgtcaacggcaaggttatcacagaactcgggtcgaaggtggatccgactgaagatgtggtgtgcgtcgacggacaccaggtaaagatggcaacgcatgcagtctacctgatgctcaataaaccggcagggtatctgaccacgatggcagacccccaggggcggccctgtgtggccagcctggtacccactgacagatatcccggtatttttccggtgggcagactcgacaaagacaccacgggccttctgctcttcaccacgaatggcaatgcctcacagcagcttctgcacccctcaaagcacgtgtggaagcactatgtggcagtcattgaaggtaggttaacgcctaaaaatatcgaggagctcaaagcgggtgttatgcttgcggatggaaaagcacagcctgctgaggtcgatttccccaaagagggaagcgcgtcctatgaggcgctcgccccgtttggattacggatcggccaaagcgtcgtgggacttaccatccacgaggggagaaagcaccaggtgaaacggatgctgcgtgtggtggggcacgatgtggtcaagctgcaccgtgattcctttgggccgttgcatctgaccaatgtcgagatgggacactggaggatgctgaccgcatcggagcagcagcagcttgagtacgagattgatgagaggatgagaggataatggcggacttgcaacgcatcttagtcatgcgccatccccagacgacggcaaatgtggatcagacgctttccgggaggcgcaatgtcggtctctccgaaaagggggaagaacaggctaagcgtgccattgaggcactcgtgatctggaagcccgaccggatccgctgttctccattgaagcgctgtactgccttggcctttgaggctggcagacggttgggcattgaagccactgttgaaaaccgtctgatcgagatggacttcggcgccgctgaaggactctccgcccaagatgccgctaagcacggttggaagttcccctggcctgtggatgagaacggacactcgattgtcgctcccggcggtgagagctacgagcacgccttagcacgaatccaaagcctgctggaggatatgaagtcctatcgcggacgtaccgccctcgtgacccacggtggtatctccagaagcatcctgcgcgccgtctacaagatcccagcccagaccttttggcggattcaaatttccaatgcctgctcgtttgtgctttcctgggatggtaagcgctactatttagccgcactcggcctcacaccggaagaggttatccgccgcacgaaagagaacgtggttaaagatctggacaactgggacggagacgcaaaatgaaggttgcaatcgatgggccggcaagctcgggcaagtcgacggttgcgcgccgtctcggcttcacctatctggataccggcgcaatgtaagtcgcgcctgtgcgttgcgctggagcgccaccatctccgatcttgacgcgctcacagagtgcgtcaaggatattcagatcacattcggaccgtttaccgataagactcaggtcttcctcgatggagaagatgtctccgacgcgatccacaccgcccaggttgacaaggatgtctcggtcgtctctggcattcaggcgatccgcgatcagatggtggccttccagcggaaactgggctctgagggcaacatcgtcgccgaaggtcgcgacatcggctccgtcgtcttcccggatgcggaagttaaagtcttcctgattgcaaccgcagatgctcgcgcccaccgccgggcagtcgagcgtgccggcggggatactgcgacgggcaaaaccgcgcaggtcaaccttgatgaggagcaggcgatcttgaaagacattgagcgcagagacaaagtggattcctcccgcgcctccttcaaactagagccggcgccgggtgctgtcacgatcgattcctctgacttgagtgtcgaacaggtcgtcgatcagattgaggagctcgtaaaaaaggcccaaacagtttcaaagcctgcaaccgagagggaagccgaaacagtatctcagccttcatcgaatacgaagcctcaggcctcgaagccctcctcagcagagaaaaagcctgagacctcttcgaaaccagctccgataaggagggcgaagcgtgacacaaggtccacgtttgagccgatgaagtcctttggccactacaagatcaaggactactacgatcatgggatgaaagagttcccgctcggttcccgggccttcttagcaatctctgagaatgcgacctggctttacaccaagatcgtgttcccgtggaaggtggagcaggccgagaagttctggaagggctggaagcccggttctaccggtcgtgtactggtgatgaaccacgtgtcaatgctcgacccggtcatcctctcgatgctgctctaccaccacgggatccgtatccacccgatctcaaagagtgaattcgataagaacagattcgtctcttgggccttctcccgctatggctgcatcccggtgcaccgtggcactgcagacctcaaagcgatccgccatgcccgtgacgccttaaagaaaggtgattggatcctggtctttccggaagggacccgcatcaaatccgacgatcaaccggtcacgatccacggtgggtttgcgctgatggcgcagctcgccaatgcgacggtacagccggtcgcaatcgtcggtgcccgcgatataaccccgaaaggtacgcattttccacggccaagaagggtatttttaaaggtaggggacgaaattcacttcgaggatttaggcatcgaaaaaaagcatgaccaagtcgacgcaatggagaaattggcgatggacaaggtatatgagctccgtgccgagctcaggaaagagcacccggggaagatgtaggggatatggcgacaatcagcattgcacaggaagcagggatgtgcttcggggtggcacgagccttgaagatggtacgcaaagccgcggcagccgctgatggtccgattgcgacgctgggaccgctgatccacaacccacaggtcgtcgacgacttggcccgccagggtgtctcggttgccaccgatcccaggcagcctcaaggcaccacccttgtgatccgcgcgcacggcgtgggtcccgacacgctcaaagaggcccaggaggccggtgtcaaggtcgttgacgcaacctgcccctatgtcacaaaagtgcatcacatcgcggggcagctctcccatggaggctacacggtgcttgttgtcggtgagtgcggacacgctgaagttgaaggcacaatcgcccatgcctcgggcgctcaggtcgtcaacagcgcgcaggacgtgcaggccttggcccactcaggagagctgggccgcaaagtgggtgtcgtggtgcaaaccacccagaccgtcgagaagctgaccgaggtcactgcggagcttttgcgccactgtatagagctgaggatctacaatacgatctgtgaagccacctcaaagcggcaacaagctgcggccgaccttgccaagaaatcagatgtgatgatcgtgatcggtggcagaaactcggcaaatactacccatctggcagaaatatgtgcgaatttctgtcccaaaacgtatcatattgagcaagcaggcgaacttcaatcgacctggtttgctggtgcggatcgcatcggtatcaccgcaggtgcctccacaccaccagagcagattcaatcagtctgcgatgctatcgaaactgtaactgccccgtaaacgtatcgtctcgccagcaaggagttagctatgccactgcccatggttgctatcgttggccgaccgaatgttgggaagtcaacgctcgtaaatcgcctcagccaaaccaaagatgctatcgtccacgagtcccgcggtgtaacccgcgatcgctcctatcacttctgcgattggaacggccgtcaatttacgctgatcgacaccggcggcgtagaggtacagaagagtgacaacgtctttgcgtcttcaatccgtgagcaggtcatagcggcatgcgaggaggcccaggttatcatcttccttgttgacgctacgtgctccgtttccgaagaagacgaggaagttgcgcgcatcgtgcgcagatcccccaaaccgattttcctcgttgccaacaaatgtgacaatcccgcccgtgagcccgacctgtgggaatttgacgccctcggagtcggacaggcccgcgcgatctccgcaaatcacggctatggtaccggggacctgttggacgatattgtggcagtgttgccggcagagatgactggaaacgatgaggacgatgtggataccctcaacatcgccgttgtcggccgcccgaatgtgggcaagtcctcgctgaccaacgatcttctgggcaagaggcgctcgatcgtctccgatgtggcaggcactacccgtgatgcaatcgacaccgtctttgagcgcgatgggcagctctaccgcttggtcgataccgccggcatacgcaagaagaacaccgtgcatgaagacattgagtactattcgatgatccgtggccttgaagcgatggaccgcgccgacgtggtcttgctggtgattgactccgttgacggcgtgaccgaacaggatcagaagatcgcagagatggcgatcgaccgtggttgtggcatggttatcctgctcaacaagtgggatctcgtccgcgacagccaggcacgtcaggaagtgacccaaagcgtccagaagcggctctcttttgcccagtgggcagagaccctgcgcatctccgcaaagacggggcgcggcgtcgataaggtgctggacttagcaaacaaggctgcccgtgcccgcgacatcacgatctcaacggcccatctgaatcgggccatgatagagatccgcaagagcggctatactgtcgtaaagaagaataagcggctcaaggtcaattacatcacccagaccgggcatcggcctccagtgttcacgatcttctgcaacatgcctgaacttgtctccgataactatcggcgcttcattgaaaacagattgaggggagcgttcgatctgaaggggacgccgatacgtctgcgttttcggagaaaggatatgcgtttatgacagggaagatggttctgtggctcctacttagctgtgtggttacctactttgtgtgcggcatcccgtttgggttgatcgtcggctccaaagagggccatatcgatatccgccgcgtcggctctggcaacatcgggactaccaatgtggcccgctcagtcggtgccaaagctgccggcttgacactgctcctcgatgtgctgaaaggatttctctccacactgatttggtcgcatgtttttgccaatgtcctctttatggggaactttgagcgcatggccccgaccgcggatttcggatggatgccctcgatcattttcctgtttgcaatcatcggtcacgtcttctccccgtatctaaaattcaagggcggcaaaggcattgcggttggcttcggtgcggcgttgggctatatccctgctgtggcaatgggattgttactcgtcttcttggtgggtgccgtcccttcgcgctatgtttcggtcggttctatctccaccgcgatctcgcttccgatctgggcggcgatcttcggttatgctcccacgacgatctatcccttgatcatcatcaccctgatcgttgtctgggcgcaccgggagaacatcaaaaagcttgcccaccaccaggagaagcatttctcgttccaccactcaggcgacaaggataagaacgcatgaaggtagcggttataggcctaggatcatggggcactgcagtcaccggactcgtagcgccccatgtggattgtgtcggagcttgggcgcactctggagaggttgcccagggggtcaacgaaacccaccacaacccccgctatctgaaggattatcggatggcagacaccgtcgaggcgaccacctcactcaaagaggcaattgagggcgcggaggcggttttcttggtggtaccctcacccaatctagcgcaggtctcagctgagctcgcaccatatatctctgcgacaacccccatcctggtcctcaccaagggcatcgaagatgtcacaggttgcctcatgacccaggtggttggagacgccgtcggaaaccccgagcgcatcgcttgtctctccggtccgaaccacgccgaggagatctgccaggggaaaatctctgcagcggttgtggcggctccgacgatggagctcgcctctaagttgcagcagttggtcttgagccctaccttcagggtctatgtcacccaggatatgaccggtgtcgaggtctgcggggcggtcaagaacattatcgcaatcgcctgcggtgcagctgctaaactggacgtcggcgacaatgcgatcgccgtcctgatgacccgcgggctcgcagagatcagccgtatcgttgttgccttgggtggggatgcaatgacctgcatgggccttgctggtatgggtgacctcatcgccacctgtacctcacggcattcccgcaaccgcagctacgggcaggcactcgtctcaggtattggcctgaaggagtacgagcagaagacccacatggtcgtcgagggggcgcacgccgcccgctcggtctatgatgtgtgttgtgaaaagggtatcgaggcgcctattacgagcgccgttcacgctatcctatatgagcactcctcagttgacggtgcgatcaacaccctgttggggagaagcccccatgtggagttctacggaatcagaacaagagaatagagaagcgatgttggatcatatcgggattgcaccctccatcttgtcggcagacatggcaaagctgggtgaggagatcgactctatcaagactgctgactacgtccacttcgacgtgatggacggtgaatttgtcccacagctctcctttgggcatccggtgctcaaagccgtcaagaagatgaccgacgtacccatcgatgtccacctgatggtcgagaaccccgatgagacggtcgcttcctatctcgaggccggtgcgaacatcgtgaccttccatgtggaagctgccacccacgcccaccgcatcattcggcagatccacacggcccaggctctggcaggtgtcgcgctcaatcctggcacgtcaatctatgaactcgattcgctcgttgactgtgccgatgtcattcttgttatgaccgtggacccgggatttggaggacaaagttacctcccttcgagcgccgacaagatcaaagcggtgcgggagctctgccgcaaacaccacgcgaacccgaccatagaggtcgatggcggcatcaacaacgacaccgccgcaaccgtcgcccgggcaggggcacggcttctggtcgctggctccggagtcttcaagtgccctgaccgcgctaaggcgatcagacagctgaaggatgccgcgcgcttggggttatctgaacaagcataagaaagtgcactaattgtatggcaaaaaaatttgtatatttggactacgctgcctcggcaccgcaggcgccagaggctgcagaggctattgtcacatatgagaaaacaccctatgcgggggccaatcctgaatcgctgcacaccttaggtagagaggcggcgcaggcactcgagggtgccagatgtgatatcgcccgttccttgggcggtcacttccgccccgcagagatcgtgttgacctccggtgggactgaagccaataacttagcgttacaggggatcgcgcaggcggtccggatgcgccagcgcaaccggacacagatcatcgtctccgcaatcgagcacgactccgtgctcgatgtggtgccctccctcaaggataaaggcttcgatgtggatatcgttcagccaaaccgagagggcgtgattacgccggaagcgctacaggctctggccagcaataaaactgccctcgtgtcggttatgaccgccaacaacgagaccggtgtcgtgcagccgatcgaggagctggctgagatcgcccacaaggcgggtgcgcggttccataccgatgcggtggctgcctttggacgcatgcccctacagctggaccatgtcgatgcggtgagcatggcggcgcacaagatcggtggacccgtgagtatcggtgccttggcgccgagaatgcgctgcccctatcgcccccagacctttgggggaggccagcagcagggcaaacggcctggcacccaggatgtgcggggtgcccttgcctttgcggcagcgtttaaggcctgtagggcacacctgaaggagcggcaggagaagaccgcccacgcggcacagaggctctacgacacaatctgcgccccggggaccggtgtcttcccgacgaccaacacgacaatcgacgggcataagctcccgggtattgtgagcgtttatgttccgaccctcgactcagagaccctactcttacaattggatcaggcaggctttgaggtctccgcaggctctgcctgctcctcaggatcactcgatcccagccatgtgctgatggcaatgggtgtgaagagaagcgatgcgcagggttcgctgcgcatctcatttgattacagagtgagcgaggatgatctggacaggtttgctgacgcactcttgaaggtcgtcgccgagcacaaacgttaaaggacgcgtacagatatgaacgaagcacaggcgctccagcgtctccaagagatcgacctctccctcatacgcctcagggctgaggtgcacaagcgccccgaggttaagcgtcttgaggcaataccattggcacgaaagaaaatcgaacgggatcggatctcaatcaccggacagcgcaaagacgccgagctcgagctcaaggacaatgaggatatgcagcagcgcttgaagaaacgtgaggatgaactcaaagaggaggccaaccaaaacggccacactcaccggcagatccaggtccttgaggagcagctctcaaatctggcaaagcgccgcgagaagctggcctttacccacaagccgctgcaagagaacctagagaagttgctggatgccgaggaaaactccggtgagctggtggagcgtctggaagccgaagagatcactctgaagaaatccttcacggatgccactcaagagattacaggcaagaccaaggatctcgtggaggagcgcacccgggtactgacgcacctttctccagagatgcagcaggagtatgagaaagcctacgagcacttcaagggcctggcggtcgagaccctgcacgggaacagaccctctatctgccgcgtttcgctgcagccctccgactatgcggatatccagaaggtagcccccatcacgcgttgcccctactgccaccgcatcctgatcgtgaacccgaccaaggaagtggatgagtaagatgccaaagctcacgcacacgccccatgtcctcgtcggggtgaccggctgcatcgccgcctacaaagccgccgaagtggtgcgactcctgcagaaagcagactgcaaggttagagtcatgatgagcgcaggaggggagaaatttatcgcccccgccaccttctcaggcctgacccgctacccggttctggatgatctctttggttttcccacaactgagatcccccatatcgactcagcggagtgggcagacctgcagctcatcgtgccctgcactgccaatgtggcggcgaaaattgccaatggcttagcggatgacgcgctaacctccacggtgcttgccgcaatgggtccggtggcgatcgccccggcaatgaatgtgcacatgtgggagaatccagcaacgcagcacaatatgaaggcacttcaatcccgtggtatcaccatcattaaccccgcctcaggccgtctggcctgtggggatgtcggtgcgggcaagcttgcggatgtgcagacgatcgccgatgcggcgttgcagctgttacatacctcagacgaactcaacggggtcaagatcctgatcaccgcgggaccgacccatgaggcgatcgatccggtccgctatatcgccaatgcctcctccggcaagatggggtatgcgctagcacaggaagctgagcgccggggagctcaggtcaccctgatctccggacccgtgagtcttccggcgccttacggggtcactgtgatctcggtcacgagtgcacaagagatgtacgaggcggcgatgaaggagtggaaggatgcggacgtcgcgctctgcacggcggcagtcgcagatttctcgccgaagcatcctgcagaccacaagctcaagaagggcattgacgcccctgacacgatcgagctcactgagaataaggatatcctcgcaagcctggcagcgaccaaggacgatcgcattgtggtgggctttgccgcagagaccaccgatctgctcgagcacgctgaggagaagctgagcagaaagcacgcctccctcatcgtcgcaaacgacgtctcgagaggggactcgaccttcggctccgacacggatcgggtgagccttatctatccctcccacatcgagcagctggacacgctcccgaagactgaggtggcctgccatattctggatgcggttgagaacctcagagcacaggactaattgcatgaagcattacaacgataggtttgatgtagtttggcaatattgatcggtttggaacatgtgagccaggagtggcctggcaagcaggtattgaacgatgttaccctcgggatcgatgccggcgagcgtatcggtatcgtcggccgcaacggagatggcaagtccacgctgttggacctgatctccggcacgattaccccggactccggcaatatcattccccgcaataacctgacgatcggctatctgggacagcacgatcagttggacgatgaggacagtgtcgcgcacgcagtggtaggagatcgtccggaatatgagtgggcctccgatccgaagatccgctccatcttggacgagctgcttgtcggggtcgactggcgcgcaaaagtcaaggagctctccggcggtcagcgccgccgttgcgacttagctcgcgtcttggtcggtgactgggacgtcattcttatggacgagcccaccaaccacctcgacatgcacgcaattacctggcttacaaaccacctcaaacaccgctggccggaaggtacgggcgcactcttagtcgtgacgcatgaccgctggtttttggatgagatatgtgaacacatgtgggaggtccacgatgggaccatcgaacccttcgagggaggctactccgcctacatccagcagcgcgaggagcgcgctcgtctggtacagaacgctgagacccgccggcagaatatcctgagaaaagagctcaactggctcgcgcatggcgccaaagctcgcagctcgaaaccaaagttccgtatcaaggaggcccaagccctgatcgccaacgaccccccgctcagaaactcggtggagctgaagcgcatggcagtgtcccgcctgggcaagctcgtaattacgatggaggaagtgggcttcagctacggtgacaagtcggtcctgaaagatatctcctggttgatcgggccgggtgagcgctacggtatcttaggcgagaacggtgtcggtaagtccaccttgctctcagtgatgaccggtaggcttaggcctacgagcggctatgttaagatcggtaagtcagtgcgctttggaatcctcacgcagaacctcgatgagctgcatacgaaagatgactggcgcgtctctgaggtcctttcaacctacaagaaatactacgccgtcgacggcaaagagcagactccggagcagctccttgagcggctcggctttgagcgcaaagagctctccacctacatcagggatctctctggcggacagcagcgccggctggcgctgctctgtgtactgatgagcgagccgaacgtgctcgtgctcgacgagccgggcaacgatctggataccgacatgttggcggtgctcgaggacctgctcgacacctggccgggtacgctgctcatggtaacccacgaccggtatttgatggagcgcgtgaccgatgaccagttcgccctgatcgacggccacatccgccatgtcccgggcggcgtcgacgaatacctgaagatgctcgacgcgcagccgcaggacacctccggtatcagcaagagagctgcctcagatgccaatggtggtgggcagagcaagagcgccaccatgtccaaccaggagcgccgtgagctcaagaagcgcttcgacgcgacggatcgcaagctcaagagacttcaggaggagccggacaagatctgcgaaaagatgaagtcggtcgatccgagcgactatgagggactcgaaaagtgtcaaaacgaattaaatgaggtcaaccagcagatctccgatctggaagatgtatggttggaactctcagatgagctcgacctagagtaggtagcgcatgggaaaagaattgtggaggaaataccagggccgcacgctgatagggatggcgaccaaggtcgttgaggtgttctttgagatcctgacgcccatcatcgtggcccagatgatcgatgtcggagtagccaatcacgatgcaccctatgtgctgcagcacggtgccctccttattctttttgccgggatcggctactgctttaccttaatttgccagcgcatggcggcgttggtgtcccagggtgtgggcaccgatctgcgccgcgccctctttaagaagatcaattccttcggagccgcggaggtcgataccttctctaccccgacgcttgtgacccgtatcaccaacgatgtcaatcaagttcagctggcgatcgcgatgagtatcaggcagtttgtccgctggccgcttttggcaatcggctctatcatcgcttccttcctgattgactggcagctaggattgatttttctgtgctgcaccctgatcgttgcattggtcttctatctcgtgatgcgtaagtcaattccgtactacactcagatgcaggagaagctcgaccacatctcactcgtcacccgtgaggcgctctcgggcgtccgcgtgatccgtgtcttcaggcgggaggacaccgagtacgaccgcttcaaggatgccgcgcaggatcagcgggacaccgcaatcaccgtcggcaagctttcatcaattctgaaccccgtctcatacctgatcatgaatcttggtgtcgtggcagtactctgggccggcggcttcaaagtagatgtcggtgtgctccaacagggcgagatcgtcgcgtttgtcaactacatggccttgaccttaacgagtatcgcctatgtcgcgaacctgatcatcctgatcaaccgtggcatcgtttcggcgcaccgtattcgggaagtgcttcacaccgagcctgcggtcaaatacgagagcacccatccggtagaggtcgagacgcttttgactaccgttcctgccatcaacttccacgatgtatccttctcctatggtaaaggtaagcccgccttggcgcacgtcgacctttcccttggccaagggcagaccttgggtatcatcggtggcaccggctccggcaaatcgacctttgtgaacctgctgacccgcctctatgacgcggatgaggggagcatcgatgtcttgggcatcccgatcaaagcctggcctcaggagcagttgcgtcaagcggtctcctgcgtcccgcaggatgcacacttggtgagtggtacgatccgctccaacttgacctggagaaaatcagatgccaccaatgaggaactgatgcgagcggtgcagcttgcgcaggcaaccgatgtagtggaaagcaagaaacacggattggacgaagaggtcgaatccggcggcaagaacttctccggcggacagcgtcagcgcctcacgatcgcgcgtgcactcgtcggggatccccgcatcatcatactggacgatgcagcttctgcgcttgactttgagaccgatgcgaagctgagacgggcgcttgcgggcttgcgtccccgcctgacccaagtcatcatctcacagcgcgtctctgcggtgatgggagctgacgagatcctggtcctccaccacggaaaagttgtgggactcggcaaacaccaggagctctacgagagctgtccgatttaccatgagatctgtaactcacagctcaagggtggggaggtgcactatgcctaatccatatgtcggcggtgtctccacctcaaacatcttaaataacgctgcgggaaaagataagaatccgcagaaccgcaatttcgatgcccccacgacacctgtctcggtggtactgaagcggcttatgacctatgtgaagccgcacataggcctgctcgtgctctcttttgtctgcgccttcgtctcggtattggcacagatcctcgtgccgatctacatcgggcgcggcatcgaccgccttatcgggcagggatttgtcgatttcgcaagcttggtcccgatcctgatccagcttggggtgactgtggcgatctcagctgtggcgacctgggcgagcggctatgcgaacaaccgcctagcctacgaggtcgtctgcgatgtgcgtctggacgcctacaagaagttcaacgaggtgcctctctcctttatggattcgcactctcacggcgacctgctctcccgtatcattaacgactgtgatgcaatcggcgatggcctgctccagggcttcaaccaactctttaccggcatcatcacgattgtcggcacgctgatcttcatgttcacgctctcggtgccggtggcgctggtcgtcgtggttctgactccgctctctattctggttgcaacgttgatcacccgcggttccgcaaagagctttgccgcccagcaggcgctccaaggtgagctttccggctacgcggaagagatgattacgaaccagaagcttgtctacgcgtttggctgccagaagcgcaacatcgcaaactttgaagccatcaacgagaagctctataccgcaggtgtcagagcgcagttcgtaagctcactctccaacccttcgacccgccttgtgaacaacctgatctatgccacagtagcgatggtcggtatctcctgcgtgatcactgggcagccttcacctctgacggtggggcaggtccagagctttctctcctatgcgacgcagtacatgacgccattcaaccagatctccgcgattgtaacgcaggtccagatggccttcgcctctgcacgccgcgtcttcgcactgatggacgctgagcctgagaaaccggatgcccccaatgcggtggtccttgaccatccgaagggtgcaattaaactcgataaggttacgttcagctaccgtaaggacgccaaactccttgagggcatcagcttcgaggcgaagcccggtgagcgcctggcgcttgtcggccctaccggctgtgggaagaccacgctgatcaacctgctgctgcgcttctacgacccggatgagggcacgatctctctggatgggcacaacacccagcacgtggcccgatcctccctcagaggctccgtgggcatggtcctgcaggagacctggctcttcgaaggcacgatccgtgacaatatcgcctacggcaaaccggatgcgacgctcgaagaagtcaagcaggccgcggagcgtgcccatgcggacggcttcatcgagcagctcccgcaggggtatgacaccctgatcaccgaggacggcggctccatctcacagggccagcgccagcttctctgcatcgcccgcgtgatgctcactgacccggctatcctcttcctggatgaggccacgagctccatcgataccagaactgagctgcaggtccaggatgccttcgacgagatgatgaaagggaggacctcgctcgtggtggcccatcggctctccaccgtgcgcaatgcggactgcattctcgtgatcgaccacggtcacataattgagcgcggcacgcacggcgaactgctgaagttgggtgggttctacgcgaagctctaccagagccagtgggacgcactcccgaagaagggcatccgagaacgaaaagtgaggtattaaagacacgctatacggatgatgatcacgcttaccctgcaggtactcgaggtgttcatccttgcagggatcggctttttgatgttcaagacgggcaagatcatgtacgagggcaacaagaccttgggcaacatcccgacctacctctctgcttgcagtcatcatccgtggctttatgattggcccttctcccgagatcacaagggtgtccctaatatcggcggtcttcggggccgggcttgccctcttcgcaatctggttttcacagcttgtcttgtccgatgtgccgatcgagaagttcgggtcaagtccgaatccgtgtgtaagatcgctgccgcgtttcctgccttacgccttcgccatgtccctctggttgcgcgctatctttgcgagctcgtcttccatctgcaggagctgcgcgtaagtcctatccgtagtagctcttcctctgcgtcgagctgcactcgttctcctcggtaaggaccgacccgatcagcctgatcgccgacgccttactcgggaagaccccgacaaagcaggcgtgcctctctatctccctgttcagcctcttcaagtagttggacgtcctcatgtacaggcgcatcgcggcgatcagcaccatcgccgcccttaaggggccaatcgcaaaatgctctgatagcggggtccagctcggcgcaggcctcaaagacggagcacttggagaacgacctttcgcagacctcctctatgaccctgcccaccttcactgtaaagacgcccgcgacaaccatctcggccatctcggtcacgagggcagcctcgcttgcgcttgtagttgtcgaacacgagggtctcaaacgggacattgcgctgccttgacaccttcagctcgatggtggcgaccctggtcgtgaggggccttgccttcgtctcgttgtggctgtcagtgcactgctgcgtttgctcgtagggctgggcgcgcagctgctcggctgacttctccctcagcaccgtctcctggagcagcagcctgaaggtgtccccgtccccgtcggtaagcagccccagtaccacgtcctggtccagtgcaagattgattcgagccatgtccgtcctcttgggtgtcctcgttgtttgccgactgcgatcccaccttagcggcgggcctctggcacgcccgccttttacaccactttacggatgtgaccgaagttcgcggtgcctttctccaatccaagctttttgggttctttgacgtttctagtaggtagtacatgccagctgtctctgggccgagaagttcagctttcccagtctgagggagatcatcgttttgaagtaggcgatgcttctgaagcccctggccgcgcaccggacggactggataactaagttgaacccttcgaggaacgaatcggtggagcctctcttctaccagttcaagatctcttcccgctccttcctaaggggtacctgccaccctctccgtcttagccacgtcagagtacattattcacgagcagagccggtctggggccttagctgtagattccctgtcgaggcagccatagacgtcgtgcattgagccccatcaatataaaggacagcggggtcccagatctctatgcagcctgcgtggccgccagatcagatggaagggccctctcgaagtgctcgaagaactcctgtctggcctttttgcagacacgcacctacctatggagtcgtgcggacaaaagcggttgtagttacgactcgattgagcccgatggcccttgtgctttgtggtgggatgcaggcgcttgtggtggtaccactcgcccttgagtgtttcgagaagcgattctgcttgcgcactgtcgtggcagtccccggtgtgcctcacatcgtgcaaggccgcctgggaggcaagcttaaacgcctatgtattggctgttctgctcgctgtgggatatgaccccacaggcgatatatccccacacacgcgaataagccatcttttaagggcaaagatgataaggcttgccttaaggcgtctttgtatactttagccgacgaccataaggtgctcacagctttattgcgacgctaagctagacgatatatagcaagacggctggagcctcatttaagaaacaagggcccttctgtagggcattgtgggttaggcttcggttgtccgattggcttaccacatttcgcaggaggtctcggccatgctctatcgtgccagcatcgggctcgatgtacacgcacatttcatcgtcgccgcagcatttatccctaagaccggggagataatccagaaggccttcccctacgatgcggctcagctcgccgaatgggcgaagggcctgccctagcccgcatatggcgagaccacccttgctgtgggattccatctgtccttggtctgtctggtgtacaagagatacacgtatcagttgaggtagcttctgcatattggtcatcgacatgcctgtgaagcgccagattcacctgttatctagactgttaagaaaatattttcttacggataacgctacagggtctcatctttcagtaggcagctagtcgttctgcttctgtttgagcgtctgaatgaagtcgatatccttgataaggggacagcaggagctgaagaactggaccttcgactcggctacaatggtatccacgccgggcaggtttctgagaccaccggtcaggttcaccgggatatcaacccttgaggcgagcgcctctgccgcaggcaggaagtcttcgaccgtaaggccaccctccacctcgtcgcttgagttcatcttgacccacatcaggaagtgagggcctattgcatctctgatcgtatagtagatctctcttagaaagcgggcacggttctcccaagaaccccgtacctcatcctcacggtacttgaagaggggagaaggttgcctaaatcagcgggcacagagagcttgtccatgcgatgtccttccagatggtacacatcagcgtaccagggtgttttccccattcataaaataccccttagggtatcgatggtttccctcaggttatttttccagcgttatttcatcacacattcaaacccacgcagtatctctctgcacaagtccgaaagcatgtaagcgtttatcgccgatcagaagcctcttgtatgaaatagtactggagaaagcctcgttcaggtaggataagggcaacgttttcagactgccagataaggaggctctgtatgcaattcgatcctaagcgtacggcactgttggtgattgacgcaattgatgcggacgatacggtatataagcctgatcctgctcaggatgcctaccgccagaatgtggctgagattgttaacctatgccacgaggcacacctaccggtcctcttctgcaatgatgcgcatatccccggtatcgatcacgagctcgagctctggggggaccatgggatcgcgggcaagagccatatcttcccggagatcaacgtacagaactccgattatattatccccaagcgccgctattctggcttctttagcaccgatcttgacctcaccctgcgtgagctcaatatcgacacactgatcgccgtaggagcggatacgaatatctgtgtcctccataccctggcggatgccttctaccgcaactacaagaccgtgctcgtaagcgatgcgaccctgaccttcctggtcggtacacaggatcaggcgattgaacgtgcccagaagtgctatggctcaacgatcgtgaatatgaagaccctgagagagttgctgaagggctaagctacctcagtgcatatcattggtattctgaagcgtctgcatcctgtgggcgcttctatagtatggtgataaaaaggcacagtctggagatttctcgggaggtatgaccgctatgaacaagaacacccgcatttgcattatcggggcagggcctgccgggctctcctgcgctatgtttcttgaaggcaacggttataccaactatgagatctacgagaagaccccacgggtcggtggcaaatgtttctcaccactgatggtggttaccacttccgacggcacgactgaggaacgcagctgcgatctcggcgccacctttggtgatgacagctacctcgcgatccaccgctgtgagcagtttgctcatgtagaccatatgcatggggaggagatctcctatcagctcctgaatccggatggcacgccctacaccgaacccagttgggtagatcttaaagaatcacttgagatcgcaaagctcaagtatttgctgcagacgaagtacaagggctacgagacctacggacataggcgcgtagctaagggagcctatgaggggcatatcgttacggaggacctcaaactcgtccatgtggaaggtaccaacccgcatctgaaggatcttgcgctgccctttaacgaatttctggagctcaaccactgcgaagctgccggcaaagagctgatggtgccctttaccgcacgtggctacggttatttcgacgaagtaccggcagcttacgtcgtgaaataccttaatgcaatggtcctccaccgcctcaagaagcctgcaaacgtctggatctggaaggatgggacccaagcgctctgggaatccgtcaaccggcacctcctacattctgcccacgtgagaaacgaggtgacctccgtgaagcggcaggacggctacgtcttcctcacgctcaataacaataaagtggaggtcttcggtaagctcattatcactacaccgctcgaccagtttttgacttatgggaatccgaatgaggaggaacgtaggctcttctcgaagattcactacaagaagtgtctgaccatggcagtgggggtacctgagaacgcgatgccggagagctcttactactacccgggacacatgaatgaccaaagcacaggacacctgatgggattcgtacggcgttggccagactgcgctatacagcctctcgtggcctatgccctgagaaaccataccgggaaaacggtggttacaccggacaaaacggagagtctcatcagacaggatatggagcggtcaggcttcccggtcgcacagacatatcgggtccgtgactgggtctgctttccttatatcaaagctgaagattaccgtgcaggctggtacgaccaggtagaggagctgcagggcaggctgaacaatacctattacgccggtgagatcatgggctgtggcaacatggaggagactgtagagtactcaagtgatctggtacgccgctttttctttgtgtagcagacagagctgtacagaagtatagaaatcaaatacttgctaggaaaacgatgattaattcgcctggcggattgtcaagttgagtgcaacatctccctaaagacctcgctggccgtcctgtatccaaggatcttctttagcctgtcgttgatcatgccgaatacgcgctgtacctcatcatcggtgagcttggagaagtcggtgcccttaggggaagaactcgcagatgaggatatcggtgtttttaaccgttagcttctgccataggtggtggggatggcagaagtagaactggacaccgccgagcctgtcgctcacctccgcgcaggtggcaaactacttgccgcgctcaggggtggtggtcttgcggtcacggcctaacagagccgtgagctcgaccttgtgtgcgcgtgagccttgtcgcctacgagtagccgcgactcagcgatccgcgattgtcaaccaggcagggccctcccggcttgccgacgagtgtgtcgtctgccccgtcaccgagccttaagcgctcgtgtgcctgcttgggcctttctgagatgccgcaggagaccttgaccttgcccctcctctcctcgtgccccctgtgcgtgcacttccccttcccgcacagatggtggcggagctggtcctgtgggggcgcaccggggatatcgagctcgcctgagccgacggcgcgctagatagacgagccgccgggcccaagacaaagccttttgtctatgtgctcgggtgaccaccgctcgtctgcgatgtgctgcccccggcaggctcagcgtcaaggagtatgaggacccgttcggcagaaagtaggccggcacatgcccgttttgacgggctggccacgagtcaagcggccatgcggcctgaacgaagcgaaggccagggacttgagtttctgaccggcatttatagggctatacccttagagcaaaccacccgctacgcgggtggtcatgattggccgcctgcctcgatagcgccagcttcgtgcacagcgatgtgtcccgacgcggcagcaatgacgccctcccagggagcaagcagggcagagatcgcgacctcgttcgtctgcgtgctgccgacgaggaagaagacctcggcggaaggcgccttgcacgcgtccttgatgagccgctgtgcatggatgctgtgctcatcgagtccatagcctgcgctcttctcgtggttcgttgccacgaggcggtccatgatctcgtctgcacagccctcgagacaatcggaagagaaatcgagcttctccattgtagccacacactttctcaccctgtctgagagggcattataccgacatctctgccagcggaaatcgtctgtcttgtggccacgcctgagctcagctgatactatacgtcgcgcatatccatgattgttgatgcttataatcatgtttggaatgacaccttgtcatgattggcagctctcatggatgcaacgaagtgtgccactctcattgcggctgcagagattggttccttcacggcagcagcgcgccagctcggctacacgcagtccggcatcacgcgcatggtggcctcgctcgagtcggagctcggcttcgcgctctgcatctgcacgaagcagggagtcgcgctcacagagaatggcaggcgcatgctcccgcatctgcgcgagatcgtgagggcagagcgggtgattgaggagtcgggcaccgagatccgtggcgtcgtttccggcacgctcacggtcggctcctactacagcatctctgcgatctggatgcctgaggtcctctccacgtccgagaagagctaccccggcatcgatgtggccctgaagggaggcggcaaccaggagatggggcagtagctcaatagccgtgccgtcgatctctgcttctgcgcgaagccttcccagggcacgtactgcgactggaaggcactctatgaggacgagatcgtgatgtggctgccggaggggcatccctatgcaacacctacgccaccgccaaaagctaccccatgccacaacctggacgccccccccacccccccccaccgacaacggccttctccacacgccgccaaccacgacacggccaggaccgcctcatccgcgaggagggggactccgcgtgccagggacgctacaccaccaccgacgtgctctaccacgtacaactgaggtcgaggcgggcctccggcgtgagcttcaccagcggctcatcagcacgctggaacggccgcgtggccttttttggggggggcgggggggaaaggtacccttcgagcagccacgccggcaacgttcgcgagcgccaaggcctacgcacgtggatgtgggcggaatcaagatagtacgacggagcgcggaatgagaaggcttggccgtggcagagattcggtgcggtgtcacgttgaaggaaatcaaaggggttaacctatagatgaattcatccaaacggtgcgccctcagaggttggatctgtcaaccgggttggacgtccagaccgcattgatatatacaaacgccgccgaagtagtctacattttgatgaatgaccattctggggtaatgcgatagtggtaggaaaaagagaagaaagagcgacatggaacgtaaacgcaggagaagaatatacggcaataattgccttttggacagactatatcaggcgttcaggaaaagggcaagtaggaaaaagacagtctttttcatacataaaacttcggcgcgacgaataactgctaattcgaatggccttgttaggttttatggcaagtcgaaatacgacgtcttaaaacattctatgagccttcacctaatcgggaagatattagttttagaccgtttatgggcggtggtacgaccaatcctgagggccctcagatttggatgcaaaggagctaatttaggcaaggactacagccactgtctttattcggacgagagctctcgtagagccaagggatacaaagcgttgatgcagcggtaagatacctcgggagaacagtcggcaaagagatacaaaaactatttacaagacaaagtgcccttgctgcggtgaaacagcagatgtatgtatacctttcatggagtcaaaaggtaaa

SEQ ID NO: 408 - DNA, 3338 bp, Unknown
  Metagenome-assembled genome
ccttaaggacgcataaagacccacacctctcatctgtgcgctaaagtgttgctaagaaagccttcgactagagaaggccttgcctgtgcgctcttctccgataagggcatcgagtccaggaaggcatgcgttcgctcaaaggtagagcatcccttccttatcgtgaagcggcgcctcaaacacacttaaggaagcgctactaggggatagagaagatgcctgtacactcgagtctgcctcgcccttgcaaaccttgccatgtgcatcttttgccggcaggctgcacctcccggctcccagcgtcgcttgatctgtcttggagctttctgcggtgcatggggcaggataaatgccaggatagcggctcctgcacgtgctggatgagcatccttttctgcctttcccgcataccggccgcgaaaaatcgtgtggtcggtcccctctgacacgttatggagcattaatcatcgtttccctaggccctctgtggcatgagcgtaagcgcgatagcgctacaggtccgtaagttcgactttacgcgtctggttaatcttggaacagggccacctttgaggccagaggtgccgccgactactcgggtgtcagctgcgtggggatcgacgacacggcccgcaggcgcaaccagacctacaccagctcgatggcagacctcgacggccacaagggtcatcgcagccgcgcagggcaaggacaagggggtacaggcaggctctgcgaccagctcgatgagcacctcggtagctgtggggcattcgccgagctcacctgcgacatggcttaaggcgtactccctcggcgtcgcctttgagatgccccaggccgcccagagcgtggagcgcttccacctcatgcagcttttcgccaagtgagctgtaatcttttggtggacagtgggattcagggactggcaacagatatgctctgtccagatacccacctaccaacaccagcagattgaagagatgagatgtcgctaagcgcaagcgagatagagaaggcaaagtcccgcacgaagccggaaacacccaggcactacactgaagaagtattgccttgaggctgttaagtactacaggaaggcacgtaaggccaaccctaagaagagcatcaaaggatgcgccgcgaagcttgaggccaacgacaagaccttaaacgactagatcatcaagcactcaaagaccaaaagggtcacccaggaaaggaccgacgagcacaagcagctcgacgcagtgaacaggcgcatacacgagctcgaaagcgaaaataagttcctaaaaagtggcagccttcttcgccgggagcctctgttgaaggacaggttttagctcatgctggagaagagggcaacctacagcgtctcgatgatggagcgcgtactggaggtgagcagggctcacttctacagatggctcaaggccaaaggcggtgaggacctatggggtcccctcaaggaagccatctgctagatatgggaggaaagcgacaggcgctttagctcctgctaggtctgatccaagctcacaggcgacccgcagtacgcaaaattcgcaggcacgacccgctaccgcgtacggaaatgcatggtcgagctgggataggcggcatctgatccaatgcctccaagaggacgatactgcccgcacctgatacccccgagcgccccgacctcacccggcgcgacttttcgtgtcccgtcccgacagccaagctcgtgggtgatacaacctatcgcaggaccacggcaggctttatatatctcgccgtcgcgcaccatctgtgcacacacatggtggtgggctgaagcatacaggacaacatgagggcaggccttgtcgtctttgccctgaagatggcatattcgcgcggatacgtggccggaggggccatattctaagcagcccaggcagccagtacacaagctcaaagctcgccgcctgctcagccgtacccgacgtgaggctctccgtggggagaaccggaagctgccacgacaatgcggtcgtcgaatcgctcttcgccacgctcaagaacgagtggtactaccacaagcgcctcttagatgcatccacgaccaagcacaaggcacacgagtttatcgagtcatactacaaccgcttccgcccgcataagtccataggagatcgcgtaccagcagaggtgatgcaggagttcttcgagcgcttcgagagaggccttgcgtacgatccaaaggcgatgcagaccgcataaaaaatctgagattcctctgtccattatattgacagagctcagtcaagctgagtgcaacatctccctaaagacctcgttggctgtcctgtatttcaggaccttccttggcctgtcgttgatcagctctaccgcatgctgcacctcctcgtttgtgaccttgctgaagtcggtgcccttgggggaagaactctagcaggagcccgttagtgttcttaactgttagcttctgccatagatggtgagggtcgcagaagtagaactgcacacctcccaaggcctttgtgacatctgtacgccctgcgaactccttgcccctatccggggtgagcgtctcgaggggacgtccctgcagcagcccgacctcggccttagagacactcccgctgtcgtggtggcatctctttgcgagaagcagcctcactgccctgtcggcaagcacaagcaggcacataggcccggctgccacgagcgtgtcgtctgcccagtcaccgagacgagacctctcatcggcctgctttggcctctcctttacgctgtgcgagatctcgatcttgcctttggtcttaggcctcttcctgcggattctcttccccttcctgcgcaggtggcgccgcatcttgccttcggggccggatcccggcaggtcgagggcggcggctacggacctcccggtagaatagtcgagaggctcacgacgcacctgccgtcaccctcgagcctgagatgtcgtctatctcctccagggaccagtgtctgtccatgatgagtaagcgcaccttctgcgtaagcgcagggtctgaaagccgccttttcgccctgcatctcctgtggcgctcatccgccctccttttgggcagcgcatgccctaaagcggccgtggcgtgcgttcctcttgagcttgcggcagacgctggagctgtccctgccgatctctgccgcgatataggcgattgaccttccctctgcatgcagctcggctatgcagtccctctcctgtaggcttgagatgcttgtagtggcacattccttaagcggggcacactccggaaggctacgatgtggttgtccacatcaacgtcgaaagctgg

SEQ ID NO: 409 - DNA, 44509 bp, Unknown
  Metagenome-assembled genome
acgtgtccatggggtgttctcccatgcttgcggcaaatgcaatgagaagcgcatcactgccgccctgcggaagtatgccttggcaccagacgaaagtccctcgtggctctggtttcatgctgcggagccggaggttcctcttctcagcaaattgggcgggggagaaaggtcgagcattcggaggttgcaagcgttggttgaggcgttcatctatgtaagcgttggcatcgccaacgctcaccgttcgccagttcgagtctagccgcaaggatgagcggcatatcgtctctgaacctcccagattcgacttgagatggacttcgcctactcctaaggtcccagcccggcttcgatgaaacttccgctccagatgcttctatttcacgagaaaacgccaatcgcatagtttgtatgattacgagtagtataatcgtaatcatacaaaactatagcttgttcgaggggaggaagagacacgcatgttcgtcggacgccagcacgacgattgacaagctcgagaccctgatccagggcggatccagatggtcgtactctacggtcgccgtttcgcgtcggcaagacgggccgctcacccgccatgcgcttctcgcaggggggcaagcccacgcttgcgttcaccgcaaaggtgcagaaacgacgcgctcaaccttgccgacttctcgcgtcaggttgtacaagccactttggcctccgctcggcacgggagcgttcccctcgtgggaggacgcgctcgcgttgtcgcgcgccagggcagggggaccagaccacgtgttcgtgttcgacgagtttccctacgccgcacgccacaaacggccgcctcgtctcgacgttcgtttcaagatcgcctgcgacaggttcttctcgcacgaacgcgttctaatcctccacgggaagcaaccagggattcatggaggagaaggttatgggcacggccgactcgggcgagcggcttggccagaagaaggacaccgctgttgcggcgtgtacggcggccgatccacctgggctccctttggctatcgcaaacgccgacctcatgctccggacggtgggacgcgaggaattctcgtgcgctactaacgccaacgtttggcgggaccgctcctactacctgtccatggtcgacctacgcgacaactacgccaccaatgtggagcggatgttcttccgcaaggagggcctcctgtacgatggagccgatcatgctctgaggcaggagtgcgcgagcctgtcgtctacagctcgatcctggacgccatcgcgccggggcgaacagccgaggagatcgccaacccgcataggcgagaaagcgtacatccctcgccaagtacctgcggacgctgtccgtgcacccgggaggaaggcgacgtgccgtgggggaggacctctcgagtcaggcggttggggtatctaccgcatctgcgaggccggcattcgcgttctggatcgcttcgtacagcccgaggtcgcgtcgtcgaggatggaaccgccggcgaggttgtgggctcgcgagctgcgtccagagcgacgacattcccacctatgtggggccactggttcgagggaatctgcgcagtgggtcgtgtggcaggaaagcacggcgcgctacagctgcggcaatccgctttggctcgtggtgggggggccacggacgtccggcgggagcaggaccgacatagacgtgtggcgtgagcgctcgccgcagcgagctggactggtggggggaggcaagtggcgcaggaagttcgcgaggcgcaccgcgcgcagaaactagtgcaccggggcaggcttggctgggggaattacgattcaccacgtactgtctattctcgcgcaaaccctgtggacgcgggattcgcgacggccttggcggggctggctcttcgtgggacgccgacgatctgtacccggtagccatccaacacacggcgcgatgccttctcgccgggacaggcaggctccgcggagaagagccgcataccggcatgcatcgctggcgtggaaggcaacagtttttccgcaacccttctgggaggttggtttgcctaacccactcttgcgggaacaccgaccatttccggctggtccggttcccgtctatacttaagtcacgaaaggcaacgcggagttgctaagaaccacgatgggcgttttcggaggggtaaggtggacacaggacattcgtgaagtggagtgccacttgtactggcagcagacggagctgaggagcgcatcgcgcccctacggcacggtgaccgaggttcgtggtatccgctcggcccacggcgcaagcgccctgataggcgaggacactttgacaaaagctgggggagaagtacgtcaagaccaacgtgcaggtcatcctgcgagggcacaatccacgccatctgcctgcggatatgtttataattaccaatcgtatgccagcatatccaaaaagacagatatggatttagccgatgagctttaagaccttaaaatctaagggtgggagaaagacccggcgagaggcattcctgaagggtagatggatgcatcgttgtgtggcacacgctggattgttctgggagataccagctaccacggacagctttgtcaggaatgtgcgcagtgcaaagattgatgcttagggatgtatcctgctttagatcatgttcgtctcttaagacgatgggaaccttaaagatgctatccggattgccaccctggagcgcttatgtgcacgtaggacctcatggcaggcgcaggttgcagaatgcgaccacggtgcaaggcggctccatggtggatgtgactttcacctgggccctaaagcttcacgaaagaacaaggaccttgcacgtaccccttaaagcgcacccagtcaagaaaaggggagcctggagtatcggatacaaggcgcatatcggcgtggatgccgcaggtggcatgtgcatggtggagacagatcgcctagaagtattccgacatatactgtggcaagttgtactcgtaagggaaaggatgacaggttctgctgcgccgctttaggctatataggtttagcgaagcgcccttacggagcataaagacccacactctatctagtgcgctaaaagcgttgctaaggaagcatgttcgactagagagggcctgcctgtgcgctctttccgagagggcatcgagtccaggaaggcaggcgttcgctcaaaggtagagcatcccttcctatcgtgaagcgcccgcttcaccccttaagaagcgctacagaaggatagagaaggggacctcctgtatgctcgagctcattctctcgcccttgcaaaaccttatcatgtgatcttttgccggcaggcgccacctcccggctccaagagtcgttgatctgtcttggagccttcttgcggtgcaggggcagacggagttcaaggatggcggctcctggcacgtgctggatgcgcaatccttccctgctttcccgcatgccggcctagaaggccgtgtggtcggtcctcttgacagttctggacacgttatggggcattaatcatcgtttccctagataaatggtgcaatggatatcaggagttgacagcttccgccattcttgcaaaaatatatgctgttgttccaacggggatgtagctcagctgggagagcgctgccttcgcaaggcagaggccgagggttcgaatcccttcatctccaccatagaatctttgatgcccgaatgcttgtatttgagcgttcgggcattgatatatagacggatatgaggcaagtgagcgtgaagatcagcgagaaactctatcgagcctgtgagctatgcccaagacgatgcaaggcagatcggctctcagggcagcggggcttctgtggggagaccggtcagctctatgtagcccgcgccgcgctgcacttttgggaggaacctccgctttctgggaccaaaggctccggggcgatctttttcagtggctgcccgctgcgctgcgtcttctgccaaaacgacaacatttcccacgggaacttaggccatccgatcacggtcagacgcctggccaagatcatgctcgagctcaaggaccaaggggcgctcaatatcaatctggtgacgcccttccactttgctccgcaggtacatgaagcgcttatgttagccaaagaagccggactcaagctgccaatcgttgccaatacctcaggctacgagctgccggagctcgtcgatgcgatggccccggatatcgatatctggctcaccgatttcaaatacgcttccccagagctggcacagaagctctccggtgcgcgtaactatcctgcagttgcgcttgaggcgttgaagcacatgtatgcggcaaccgaggccaaaggcgtcagaaagctcgaggactcgggccggatgctccgaggcatcatcgtgcgccacctcgtgttacccacacacatcgatgactctatgagagtcctcgataccgtctttcaggtgtgtggcaacaaagttgactattccattatgaaccaatacacccccaatgagcgctgcagaaagcgcggcggcgctctgagccatgcactgggttcggaagagtatgaaaaagtactcgatcacgccgacgatttagggattgaccgtatgtggtggcagcaagggggtaccgtgtcagagagcttcattccagcttttgacgctaccggcgtcgacgggccggaactgaagatcaaataagataaactcagcgataccacgagaggctagggatgcaatctatggctgacaacaaagatcaagggggtctgagccccgacgaacgcgccgagcttgaggagctgaggcgtgagaaggcacaggcacagcagaagcagcaagctcagcaagagcgcgcggagctcaaccggctgcgtgaagagaaagtcgacgccgagcgcaatgtggagctcgacaagcgtatcgcagcagagaaagagcgcggacgtaagctgatggagcctgacgaggacgacctcaagatgccacccggtcagaaaatggtcattgccgcggtcatcattatcgcagtcgtctttattctctcgactattttcagctaagacgtataaatagagcaaatcctttcaggtttaacgttttacatgttattatggtctaagtgtgtagattttgcacacccacctaccagaaaagaggtagctcacatggcactgacggacaggacagatccgcaggacgtagcactcaacaccgatctttacgaattgacgatggcacagggattctgggaatccggactcaaggatacctgggcctgcttcaatgtcttcttcagaaagaacccatttaacggtggttatgcgatcgcctgcggtatgggtcagatcgctgatctggtaaagaatttccgtttcagcaaggattctatcgcgtatctgcgctccattaaggcgccgggcgggggttcgatgtttaaaaaggagtttatcgactaccttgaggacttctcactggatgtcgatatctgggcagtgcctgaaggtgatatcatttttccgcgtgagccgatggtgagggttgagggcccgatcatcgactgccagctgcttgagacggcgcttttgaacctcgtgaacttccagacgttggtcgctaccaagaccgcccgcgtcgtacaggcagcagagggtcacacgatttctgacttcggcttgcgtcgcgcacagggcccggatggtggccttgcggtagcgcgtgcctcctatattgccggcgtggcttcaacctccaatgttttggccggtaagatctacgggatcccggtcttcggcacccatgcccattcgtgggtcatggcattcccgtctgagcttgaggcgttccgcgccttcgcaaagtcgagcccgaagaactgtgtactgcttgtcgacacctacgacgtaaagaagggtgttgctaatgcagtcaccgtcgccaaagagatggaggcgcgcggcgagaagctcgccgcaatccgtatcgactccggcgacttggcaaagctctccaagtatgcccgcaagcagtttgacaacgcaggacttccatatgtgaagatctccgcctccaacgacctcgacgagtacacgatccagtcgctctttgcccagggtgctccgctcgattccttcggcgttggcaccaagctcgcgacctgcgatccgcagccctcactcggcggcgtctacaagctttccgcgacaaaggcgaaaggtgatgctgcctggactccggtcattaagctgtctgagatgacgtacaagcgcacgatcccgggcatccagcacattctgcgcttcacgaatacagaaggcgtaccctatggtgacatgatcctggacgactccgtggacactggcgaccggaccacccttgtcgatatcctcgatcacgatatcacgtatgatgtgtccggcttgcagtcccacgagctgatgcaacagattattgcggatggtgaggaagtcccggagggacagaccacgatcgagcagtctaagcagcactgccatgaggcactgatgcacctcgatccgtccatcaagcgtttcttgaatccgcagctctatccggtgggcatggagcgtgggcttgcgaccctgcgcagcaacctcgcaaagagggagaagcgggattctggacgctaagatgattcggtgagttcgtgttaaatccatctgatatcaccccgtgtgcgtatggggtgatatttttgtagagctgctacagtagtacagatatgaaatatgagacaggagctttaaaggagctacgtgtatgagtgagtctctatcggaaatcgtattgaatgccctgaaagcggcacagacagcgggggagcttccggcgtttgaagcgtctgacgcctgcttagagcgtccgaatgagactgctcacggcgattggacctccacgattgcgctgaagtccgcccgctcagcgcatatgaacccccgcgcgatcgcccaagcgatcgtaaatcacttcgagaacgatacttcagttaagaaagtcgaaattgcgggcccgggcttcatcaacttctacctatccaccggagcccaaaacgaggtcttccgccaggtgcttgagcaggggaatgacttcggaaagagcgatgtgggccacggtcagaaagtgcaggtggagtttgtatccgccaacccggtaggacctttgcatgtgggacacggccgctgggtcgccctgggggattccctgtgccgggtgttggaacacaccaactaccaggtggagcgtgagtactacattaacgaccacggttcccagatggacgtgttcgggcgctcgctttccaagcgttatctgcagctcttccagattgagaaagatcacaacactgatctggacgggacttatacaatcctctgtgctgaccgcgacaaattcgttgaggacgaagaggatgagcaccctgagacccatccctacatggatgacttcaataaaaccttaggcgagaacgcctatggcggcacgtacatcattgatatcgctcgcgaattcgcgcaggaagacggcgataagtgggtgaatgccccgagcgacaagcgtgtcgtggaattccgtgagcgcggctacaagaagatgctcgcaatcatcaagcacacctgcgaggaagcccactgcaccttcgatgtgtggttctctgagcgtagcctctacaaaaaggatgcaaacggtaccaacgcggttgagcgtgcttttgccgcgctcgataagatgggctgcctctataggaccgacgacggggcactgtggttccgttccaccaagtatggagacgataaggaccgcgtcctgattaagtcaaacggagactatacctacttcgcttccgatattgcctaccactacaacaagttccagcgtgtggaccatgtgatcgatgtctggggcgctgaccaccacggctatatcgcacgtgtcaacgctgtctgtgaggccctgggatattctggtgagttcgaggtgctcctgggccagctcgtaaacctgctacgtgatggaataccggtcaggatgtcaaagcgcaaaggcgtgatgatcaccctgcaggagctcttggacgaggtaggcccggatgcagtgcgctatactctgatctcaaagagctcaaatcagaccatcgactttgatattgaagccgtcaaacggcacagcaatgacaatccagtgtactacgtacagtatgcgcacgcccgcatctgctccatcctacgccgtgcgtgcaacctctcacttgaagaggcacagaagccgggcatggatgaagtgggaaagcgtgctatcggcagcgattacgacctgtcgcttctgactgaccccgctgaactggccttgtcgcgtaaggtctccgagtttcccggccttgtggcttcctgtgcacgtgagcgtgccccattcaagctcacacactacgctgaagagctagctgctgccttccacgccttctacaacgtgtgccaggtgctgccgagcccgggacgcccggtagattcggagctctcccgtgcacgtctcgcagcctgcgatgcggtgcgtcatgtcttggcactgaccctgcatctgatcggcgtttcagcccctgagcatatgtaattgcaaaatgatttttacagccgagggtggtaacgtaaatccgtaccatttccatcgataatcctaagctgccagagccaagcccaaagccttcctgaactctattgggctcacgcctttaagcgagcgcttgcgccttgtcgtgttgtacctgacgatacagtgatcgatgcactccttcaaactcgtctaaggtggtgccgttccacttgcgcttgcaaaacatctttgtccttgtcggctggcgtggcgccaatctgacaaaaagtagctgaacttcttcaggcaggcagcgcgcagcaggctggcggaaaagcgtccttcttcttctccgagcacgccttgccgtcacacagcttcgaaagggtctcatcagcggtggtgaacaacgaaacacatcctttagagcgtacaacaggacgtcgtggggagccgcaaaaaggacaggcgcatcatgcacaagtcggcatcgtgtggggcaagaagcgcaagaggccctgcaagccgcatgtcacagaggacaagcgccaaggtgggcgatacgggaacgtggtggagatgcaagcttcaggtgcagcgcaccttgaaggtaatctccacggtcaaacactactctgcaaagacgaaggcttcgtttatctctcggggcattattgacgcaagaccaacgtcgtgtcgtaactgaagctaaaacccgatggaggaggatgttcgtgctcggacccttagataccagttcaccgtggcggctcgatctgccgagctgacatatggtctgcacgtcaagccgtgctctaagcacaacagaccccagactacacgatgcaccgcgcctagtcgggacactcaaggccgtaacagagatactagggatagggtacgatccctgtcaagaagtggccggtgttgggacaacactctgcatcgagagcttctggccgacagtcagaaagaaacagatggggccgaaatcgaagtctccaccgacagatgggctcatagcaacagagtggtgatgggactacatgtactgcatctacaagacaatgctcaaggcgttcagcagcacctagccaggaacggatttagaaaccaagacgtgaggcaacaggagggagagcttccggaaaggctcttcaggcagctctcctgcaagctatccggcgtgagcgggaagtgctagggaacgatgattaattacccaatgaagtgtcagaagaggaccagccacgtgccttcgcggccagcataggattaatcatcgttccctatcgcgaatatggcaggggaagaaggaggcggcgcaaaggcctggtctggcaagacgagcgggcggcgtgggccgatatgccgaatccatatcgtgaggccccacattcggcactgaggatgctaaagaggcagggtgaggcatgcccacccgcttacaggctgggaaagccatacggttatcgcccctgctgcctgctctcggcacccagcgggcagtcgagacggtcccgtatctgctgaagggcaagaaagatcctattctccaaaccaggtgctgccaaaacatcaactatatccagacagggggaaggcacaccctaccttggtggcgattcatcgatcggttcagccgacgacatgtcatggaagcccctgacacctgtgtggacaaggaggtcgccacctgcgccaggcaggcctttcacgaagccgtgacccttatccctcagaactttgagagagaggtgtgttggcttctataagtacgcattcgctgacatatcgccttccatgcatgtgggcaggcaggcgtcctgaacaggaaaaggacgtcagaactggaggacagcaccaacagcactatcatgcaacgaggatgggctcggcacgactcaagcggagcaaaatgacctgcggcaaggaggtacgtacagcaggcgcccccgagagcttaaggtgacactgagacgtttggtgcgtggtacagcgaggagcagaccccggtcgttagctgtgacaccgccggtgcacaatggtacaggagcatcgtctgcgaggctgcatgcccttcaatggtactgcccggacgggaggggattcagaaaggatcaggctttccctgtctcacaggttcgaccacttcaatcagatgctccgatctgtacgcctgatgtacagatatttttcggcagccccttttttcgccgtttaatgcataagaaggaaatagtgtgttatagtcctttgtaaggaaatacatcggatcctgaagaaaacccattgatgaaataggtacatcttgtgaaagaaacagacgtcctttcacaatgttatatttctacagtcagatatgctgcttaaatacacttgtgttctgcctgtagaaagtgtttgtttgatacaaagtataagaaagtaggattactttgtcggaaaatccaacgacaagtgacacaacgctgtcactgatttcttcgccaactgcacaaacgccggaaactgctgagactaaaaagccacggcgcagacgggtatcacgcaagaaggctgaagctagcagtgatgaagctaccgtcgaaacaggtgtcgaggctaaaaagcccgcacggcgtggacgtccccgtaaggtaaaagcgcaggccgaagaggctgagggcacgtctcaaagtgaagacacgcctacagagggaaaagccccggtccgtcgccgccgtgcccgtaaagctactgctgagaaagagccccaggggcaggaaaacggtgagaataccgagggaaaaggcgctccagctgcccataagggcgaaaaagagccacaggagtctgtgcaggatacaaaagcagcccacgaaaaggaatcaggctcaaaggctaaggaacctgctcataatgctccggagcgtgcgcatcgcacccacaatcagagcaggcgttttgaacacaacgaacggaataaccgtttcaataaccaacacaatcagaacaataatcacaacagaaacaatcgccggcgcaatagccgccacaatcagccggacacgaacactgagccttcgctcacgcgtgacatgttgaaatcgatgaaagtagcagaactcagaagcagggcggctgagctgggcgtcaactatgtaggtgtccgtaaagcagaactgatcgagccaatttaccaggctgccgcaaaagcggaagggttccatcccatttccggtattttggacgtccaacctgaagggtacgggtttatccgtaccggcaattacatgcagggggacaacgacgggtttgtttaccagcagatcatcagacagaatggcctgcgctccggcgataagatcgaaggggtcgttggccccaaccacagcaattctaaattcccgcctttaatctcaatcaagagcgtgaacggcaagagcctcgaagagacaaaacaccgtccacggttccgcgatctgaccccgatctatcctaatgaacgcctgaagatggagcacggcaaggactcaatcactggccgcgccattgatatagttgctccgatcggcaaaggccagcgtggtctgattgtttcgcctcctaaggccggcaaaacgactgtacttaaaaaggtctgtgaatcgatcgccgcaaataaccccgaagtccatctgatctgcttgcttgtggatgagcgccctgaggaagttaccgatatgcagcgctccatcaagggcgaagttgtggcttccacctttgatatgcctgcctccaaccacaccgaggtctctgaactcgtaattgagcacgccaaacgcctggttgagatgggggaggacgttgtcgtagtcctggattcaatcacccgtctggcgcgtgcctacaacctggctatgccggcctcgggccgtatcctttccggcggcgttgactccgcggcattgtatccgcccaagaagttcttaggtgctgcccgtaacatcgagaacggtgggtcgctcaccatcctggcatcggccctcgttgatacaggctctaaaatggatgaagtgatctttgaggagttcaaaggtaccggtaatatggagctcaagctcgaccgtgacctggcggataagcgtatcttcccggcaatcgacccggttgcttccggtacccgtaacgaagaactgctgcttgatccggaggagcggccctttatctggggcatccgccgcgtgctcgcaaacatgaataacactgagcgcgccgaaactgccttggtgaagagccttaaagcgaccgattccaatgaagagttcctgatccgctcagctaaaaaagcggcgcagcaatcaaactacattgaagcgctctgataaattagttagaagactaatatattcacaatggtcccctccggggccattgtgcgtttacactttcaggtatgtagaaagggctcgctgctgcgttgtatagagatcagtggtggtaacgggaattcgtacctgtctcccctaagccacaagccccaggctgcacctgtattggagcgagctcatgcttgcgagtgacctcttctggcgcttctcgttgtgccagacgatatatccgtccatctttgcctccagcttatccagcgtagcattcgtacagtcccttccatagaacatctcgtttttcatcgtcccgaagatatcctctaatgtgccggatgcggttatgtgccgagcgggcgccgcacagcaggcagaggaacacgttcatgctccgatgagcgtataacgctgtagtgtcttccctgtcgggactgcatcctgcagagaggagacaaaatggacaggatacagcagcttgaaggcttccacaggcatctgctcggcaacggctactcaaagaccgcatcgaagagctacctcttttgggtcagcacgttcctgaaaaggaggccggaagcgctcggagctgaccgagggcgaggcaagggaaatcgtcgaggactacatctcgcagctgccgtgcaacacggcgtcgaccatccctgcagcagccgtgagcagatggtggacctacaggttcgaaaagccctaccgtgagcgcatcgtcccttcaaaactccagccagatgcggccatagaggcgaagcttgcagaatttgaggaatggctctgcgtgtatggcaacataaagcccgtgaccatccgcagcaggatcgcctcgataaagctgtttttgcacaccgtctttcccggtggaaccttcaagcgcagggccatttcaccccgcatgacttcgtcgactatcatacgggtgcagccacggacgaaggcgcgtgcgtgcgtgcccttaagggatacgacctgagatcctaacatccgcttcctgagatggaagggtacaagagtgcgtgccgctcgatgcggtgtccccgtacggctgtccgaaggggaacgggaggcgctgctagcatcctgcgattccaacacgctgcgcggggcaagggacgcagcgatggccctgtgcatgggtgtcttcaggctcagggcgtgcgatgtcgcgaacctttcgctggatgacatttcgtgggcgcacggcacacttgccgtgcacggatcgaagagccggacagggagggtgctgcccctggacggccgcacgaaagcggcgctgaagcgctataccacgatgcacaggaaggccgaaggcacccgctccctcttcctgagcacagccggaacacccatgcggccacaccaggtccacacggcgatgtcgctggctggcggacgcgcagggatcgaggcataccacaagacgcatgggctgcgcaggatggtggccacgaacatggccaatgcggggatcgacgcgaagaccatcgcggacgtgctggggcacgagcgcgtggatacgacgatgggatacgtgaaggtcagcacggagaacctgtgcagggtccaagcgcacaggcccaaagaggggctgctgtgagcgggagtgaggagatggccgacagatgcatagcatacaagcgagcgctcgggttcgactttgccggcgaggcccgagggctgtgctcctttgcagccttcctgcgtagctgcgacaccacgaaggaggcggcacttgcctgggcatgcagcagagcgggccacccaagagcgtatcaggcacaaagatacgagacggtcaggcgcttctcaagattcgcccatgcgctcgaccctgccttccccacaatgcaccctgggctcctcaaaagcacgtccgagcggatcgtcccatacatctacagcgaggaggatacctgcctgctcatgcgtaaagcgctctcggcaggctcgtctgacagccttaagggcgagggcctcgcgtttctgatagggctcatgggatcatgcgggctgcgcgcaggcggtcgctcggccttaaggatgccgatttcgatgcgcatgctaagacccttggcgacaagggattcgaagttcgacgcacccaggacgattccggtctcgccgatcaccgcagagtgcatcgcagggcggagcaggaagaaaggcagcagggcgccggatagcatgatcgtgtcgggcggtgaggcccctcagcagggactctgcggaaggcatgttctcaaagagacgctggacgcttctgggcagaggtgaggccttcgcaggaagcaggccgcacctgcacgacctgcgccactcgttctgcgtggtggcgctgctgcactggcatgcgaaaggcgaggacgtgagtgcgatgacgccctacctttcggcctatatcgggcacaggaagctcttcgatacctactggtagctgacaggcatcccgaatcttatggcagtggcggcggactcgttttgccgcgcgatgcggatggaggcacagcaggcatgatagacagcttcttccaactcctgaaaggattcttcctccagcggatggctgccggaaggaagctgtcgccgcagagcgtctcttcgtatcgcgatgtgttctcgcttatgctcagatggttgtgcgacgagaggggcaccgatgcatcggagatgggcatgggcgagctcacggcagagaacatcgaggaattcctgctgttcctggccgagaggcgcaacaattcggcgcagaccgtaaactgcaggctcgcggccataaaggcattctgctcctaggcggcatacagggtcccgaagcggcttagcgagatgaagcgaacatcggacattccctagtgcatagagaagagatgcgaggttaactatctgacacgcgaagagatcggctggctcctgtatgcatggcgacgcttcttccgcatgccagctcccgcctccacctgtacagtaaggcacgggcccgatccggccgcttcggctgcctcttcccgacactgaacgatcttgccgctgccgtcttgcgctccacaggcgcgagctcgtcgatccagccgacaaggacctgagagcatcctgggtagccaagctcacggtgggtgaaggattgtatctgtcatggagagagatagtgctttacagcggagcgcattctgccaggtcctttgacctgcccctcccattccattataccatgcccccccacaagtttggacacgcgactcggatatcccagctcgcgtggtgcgggcacccaccttcctgctgtacctgacatagaactctttagctccgtcctctcctggaggtgttacatctgtccgccagaccagtgctcggtcggatttccgttaccaccccgatccgtccgagtgtttgagattattgcagggttcaatggatttgaatggcatttgcttgcaatgcgtcgctcatcagttaaagtaagaaagagtttttctgtgagcgtgggttccagatccataaatgcagaagcattacaacaagaaaaacgaagtattcattgcaacgaacgggcttcagacgcaggacaccgctgctgagacagaacggtatccgaggggcacgttcgctgtttgcgtatatttcatattcttaaaggccatggaggtcgatacatgaaggcaaagagagtcaatccagcagtgtatgcaggcttattgactaccgcgatgggcgtacttcctttgcctgcacaggcgctcaccgagtctgatggctcgatcaattggggaccgtttgccatgggtgtgggcaccggtgtcgcaatcaccggcatcgtcagcgcgatcgcctggcacaacgccaaacgtaacctggtcaatgagctgaaggcctctgaagaaaatgaagagctcaatcagaccgacgcctatatgccgcagcacctttgcgaacccggagataggccgaagacctatgtctacgacgcggatgatccggagcttgaggtggacgacgggccccaaagcgagagcgtgcatggtgcacattataagacgcctgaaagcgatccagacggccaggatgcgaccgtcctggagacgactccagagcagaagagcgtttccgctgactatcacggcgcccacttcaatgtcgaggctgtcgctagctctgaggccgaatcatctagggaagaagaacctcagagccagcaggacagcactggaaacaattcacaggtggatgtgctcaatgacaggatcccgcaaatggagcaggtggatgactgggtgaaaagcgccagcacggatgaaaccaccgatttcctgcgtgccgcacagatgcgttcttcctatgtaaagcagcatccaaaaccgaaatcggctggtcatggtgctcactcctccgatgactacggcgatatcgccacgaactatgtcaaacggcgtacctggtcacagcgtatgcaggagcgcgcccacggcgtcgcggaagttctagcggatcgattaggccatgacccgatggaggatgtgccggttatcacccgtgcagatggcacggtcggcgatatcggaactggatggtggcataaggccatgggcaacgatatttcaggccccatggacatagatatcgacgacaactattccgtggtccagcagaaagtcgacgatatcccattccaggattctgtagcttctgcccaacagacatttgcgcaggcagatgcagaagcggcagagccttcaccacagcacttccagcatcaggagcctgaggaaggggttcccaacgaagagaccgttgtggagccgggaggcgcccatactgtcgctacgcctgaggtgactccaattgaaactgagaaggttgagacgacagaaacagctagcgttgaaacttctgagcctgagccgataacggagattggaacctctgaggttgaaacaaaaaccgaagcggagcctgctgaggctggggagaccctggagcaaacgccggaggtagccgctgaggcaaatgtcgaggaagaggagccaagcgaagcaacgccggagcaagaggcagaacccgctgctgaagagcacgtcaaagaagaaactgaagagacttctgagccggttgccgaagcagaggcagaacctgctggagaagaggttcagagcgaggtggaagccgctgaagagatgcctgaggtagctgctgaagaacaagcggagcctacagaagaagcgagcagcggcgagaagcagcccggagacgagcaggaagaggacgagaaagagttcgacgaggatatgtggcagtctgctctggattccatcgacaagcgcgatcgccaagagcagcaggatatcctggatagccaaatcttcccgtatgttgtcacctcatccaactccctggatgacaccgaaggtgatctgttcaacgccggagctttatcgcccgtaggcaataaccttgatcaggccaaaccgatcgatactgaggagcatgcagcaaaacacttcaagcagagtgccaaacatgcccagcatacggatcagaatgatggaacctctggaggcgaaaagcctgagaagaaggtctctcaggatacccgcgacctcctgacggtgattgatggtggaagccagcgtatccaaccggtcgatacccaccgtgtgcacaagaagacccaccgcccgacgcgcctcaagcatctgacttcacgctatgagcatgaacgcgagcagcatgaatcgcaggaggcttaagaggcttcggtgacggaacagcatcggcgatacatagattccttaatctgggtcatactgtggatctgtgtgatctggggccattcctttatgaacggttttgtctcgggcaatgaatccggcgcgatcgtcaggctcgtgacgccgctggcccagtcgttgcaggtctacgacaccgaccttgtgacctttgttgtgcgcaagtgcgcccactttaccgagtatctgattttgggcttgtttgtcagccatgctgcacggcttaggtggtaccaggtgaaagcagccgtgttcaagacggccctcacgatcgttgcggtgtcgctcgtggatgaatttgtgatacaggcaaatacagtcgggagatctccctcgtttcgcgatgtcctgattgactgtgcaggcgcctgtgccggtctgctcatactatatctgcgtgcacgccaccgtcgacgtacacgcagcaaagatacagcgtaaagatcatttattccaaatagtgggccccagttgcagaggcagcacagatgcgcacctgcagcccctcaaccatgcccttcacggcgctcaccacatcctgggcgacatcctcattgccgcagatcgcaagcatcgtggatccggagccggagataatgaaggaacaggcgccggcttccagcgagcgttcccgcagttgttcatagtcaggaatcagcttcgaacggtacggctcatggaggcgatcctggttgacttcttccagaagaccttcgtcgccggtctccaacgctctaatcgtggcgacgatgcgacccatctgccaaactgcaagctccgtcggaaccgacatgggtactacctgtcgggcatcagcggtcctcacctcatagtgcggcgacaaggccacaaaacgccaggaatctgcgatatcgaagcgcagtgaggttgtcgtggtgccgtttacaaagctggagaccaaaccgccgaggattgcgggggcgacattgtccggatgtccctccatagtggtggcgatatccaggcagagctgtttattgtgaggacgccctgccaggcgctctgcacccatgatgcccgcgacgacgcaggcggagctcgatcccaatcctccggagaggggaatcgaggagtcgatattgatgtgcacgggtaccggtttaacgtccatacgccgacaggcgcccctatagctggtgaggactaagttgtcctcaccccgaaaacgctcttcgcagcccgtgatctcagagtgatccgcgggtgtgaacgagaaaactgcttcccaatttagcgcaatgcccaacgtgtcgaagccgacacccacattggcgctcgtggctgggaccgctactgtgacggttttctccatgcttcccatttctatctgaagatacgcgtgcaggagttctccacgaacgctggcatctggtcgagatcttccacatccttgtgcagttgcggagcgcttctgagctctgagagctgcttgggtacggcaaggccggcaagctttgccagctcatccatgcattcaaagccgtctttgcctgcggtgtcttcgccgagcgcggagagcacgtcggcagagaacttgaaggggctcgccgttgagagacagacgcgctgcacgccgtcggactcgatactgtcaaggacggtcttcgcgacggcggtatgcggatcgaccaggcggccttcattttcaaaggtctctttgatcgttttcttggtgacagcatcgtccgcatagcctgccaggaaggtcttctggatccgctctttgacagatttggtgacctcgtagtagccctcgtcgttgagctgctgcatgagggaagcgacatagtctgcatccccgtcggattcgtagtagagcaggcgctccaggttggaggagaccaggatgtccatcgagggggagatcgtcttgataaacggacggcggcggtcatagcggccggtggtgataaagttagtcagaacgttgttcgcgttggaggcgacgatcaaatgacggatggggaggtcgagcttcttagccagatagcccgccaacacatcgccgaaattgcctgtcgggacacagaagtccaccttgtcgcctgccttgatcgcttcacgctccacgagcttggagtagacgaagaagtagtaggtgacctgcgggaccaggcggccgatattgattgagttagcgctggacagcttgatatggtgttgagccaaccgtgcgttgagctcagggtcggagaagatctccttgacgccggtttgggtgtcatcgaaggtaccacgcacaccgcagaccgcgacgttgctgcccttctggcacaccatctgtaggtgctggatatccgagaccttgccagcggggtagaagaccgtaacgccgcagcctggcacgtccgcaaagccttccaacgcagccttgccggtgtcgccggaagttgcggttacgatcatcacggagtcttcgctctcaccgcgtgccacactcatcagctgcggcagcatctgcagcgcgatgtctttgaaggcacaggtgggaccgtggaagagctcgagcagccagtcatcgccgatttttgtgaccggcgtgatgtcaggattgtcgaactggttggagtaggctttcttgacgcagcggtcgatttcctcgtcggtataatcaccgaggagcgtcgagagcacgacgcgtgcctgatcctgatagtttttggagagtagagatttatagtcaagctccatctgatcgacggcatcggtgacaaaaagccctccatctggagctaaaccttgcagtatagcttgcttacttgttacagttgtcgcagacgaacgcgtactgtggtagaacgttctcattatcgtgtttcctcacttggtaggcatcagtacctgtgaggtacatgatagcgggaatacacaagagctgtgagtcacgtcacacaaatgaaaaagattggatgggcatgatgaacatcgctttgctggggcacggcaccgtaggccgtggcgttgaagagatcatcgagaaacatgtgccgtcgttgacggttaagagaatcctcgagctaccgggccgtttgacggatgagcggatgacctccaacttcgacgatatcgtaagtgacagctccatcgaggttgtcgtcgaggcgatgggtggcctcgaaccggcgcacacctatattgaggcggcgcttgatgcaggcaaagccgtcgtcacgtccaacaaggctgtggtggccgcctattttgcagaatttgtggagcatgcgaaggcacaccaagcacagctctttattgaagcgacctccggcggcggcatgccttggatcgccgggatccagaaggcgaagcgtatcgacacgatcgactccttctccggcatcctgaacggcaccacaaactttattattgacaacatgcgcaaagacgccgttgatttcgacgtggccctcaaagaggcccagaagctgggatacgcagagcgcgatcccactgcggatatcgacggtatcgacgttaagaacaaagtcatcatctccgcctccgtggccttcgatgtggcctgcaccaaggatctcccggttatgggcatccgcaacgttcacatcgcggaccttaccttcctggagagccgtggtctcgtcgtgaagctcttgggccgcggcgtgcaaaaagacggacgctacgcggtctccgtcgagccaaccgtcgtgccactgcactcgcttgaggcggatgtaccctccaacttcaacttggcgacgttgcacggtgagacgatcgacaccctaaagttctatggccagggcgccggcagcctgccgactggcaatgcgatggtgcaagacctgttggactaccaggcaggcgtcaagccggagtacaaactttcagatgataagacctttgactcgagcctgctgacgcaggactatctggtcaggaccacgagcaagctcccaaaagaggctaagccctacctcgagggataccacgtcctcaagaacctgacgtccgtccaggcacgtgaggtgctcgaccagctgctcgtcggcgatcccaaagcgcttatggtggcggtatccaaggaggtttcggtcagtgattaaagtcgctaagttcggtggctcaagcgttgcagatgccgagcaattcaagaaagtcaagcagatcgtccagtccgacccggcacgcaagtttatcgtggtctctgcggccggcaggcgtaaccctgcagacaataagatcacggacctgctctatctggtctgtgcacacctgcagtaccacgtggacgagatcccgctgctcgaggatgtgaagcagcgcttcgtctcgatcgcccacgagctcaaccttaagtatcccatcgaggagaaattcaacgagttcgagaacaatatcaagaactattcccccgaatatatcgtctcgcgtggtgagtacttcacgggacagctcctcgcggagtatttgggcctgtcctttgtcgatgcagcggaggtcatccgctttcaccgctccggtaccgtgagcaagactaaaactttgcacaatattcacgagctagcaaagaagaccggccccttcctgcttccgggcttctacggtgcgacgccggacaaggagatccgcctctttgaccgcggcggcggtgacatcacaggatccctggtggctcgtgccatcggcgtcgacctctatgagaactggaccgacgtctccggcttcctctctgcggatccgcgtatcgtggacaatccacgtccgatcctgcgcatcaccttcgacgagatgcgtgagctctcctatatgggggcttccgtgttgcacgaagagtcgatcttcccggtgcgtgaagtgggcatcccgatcgtaatcaaaaacacaaacgatccctttgccccgggtaccatcatctccgacgatccgatgaatgcctcgatggaacacttgatcaccggcattgctggcaagaagaacttcctttccgtcaacgtgaagaagaaccacatgtccaccgcggtgggcaccgtgcgaaaagtcctctcgatctttgagcgctacggcgtctcggtcgagcatatcccgaccggcatcgactcctttggcatcgtggtccatgcctctgacgtgcatgactgcctctacgatatcgtgggcgacatccaggacgaggtacagccggacgaggtcaaagttgtcgacaagttcgcgcttgtctcgattgtgggccgtaacatctcccgccatgtcggtacctcaggcagaatctttaccgccctcggcagagcggggatcaacatccgtctgatcatgcagaactccgaggagatctccattatcgtcggtgtggacgatagcgacttcgagaatgcgatccgcacgatctacaacgcatttgcaaacgaactggtggaagatgaggcaagcgatgagcgataaaaaagtagcgattctaggggccaccggcgtggtcggcacccagatgatacagtgtctagaggagcgcaacttcccgatatccgagctgattccgctcgcctcggcgcgctctgcaggcaagaaactgacattcaagggtgagaccgtgacggtccaggaggccacccctgaggcgttcaagggcgtagatatcgtcctgggcgctgccagtgacggtatcgctaaggaattccttcccaaagcggctgagcaaggcgcgatctgtgtcgacaactcacatgcttttaggcttgatgaagatgtcccgcttgtgatccctgagatcaatccgcaggacatccaaaatcacccccgtaatattatcgccaaccctaactgcgctacgatcatcggcctggtgccgacctatccactgcatcaggtcgcaggattgacgcgcatgatcgtctccacctatcagtccgcctccggcgccggtatgcccggcttgtgtgagctggagcgtgaaacgaaggcgctcgcgaataatcagccggtcggggataccgctcccttccaatatcagctggctgagaacctgatcccacagattggaagcttcaaagaggaggactacacctccgaggagtggaaaatgcagaatgagggcagcaagatcatgcacctgccgaaggtccgcatcaactgcacctgcgtgcgtgtcccggtgatgcgctcccactctgagtccatcacctgtgagtttgagcgtccgaacacgcacacagtgagcaaaaacttagaccatgctcacgccgtgtcaaggtgtgggacaagccctcgccaagttgagtacccgatcgcccgcttgcactctcgacagtatctcgtttatgtgggcgtaatccggaaggatatcatactccccgccccggaggggttaaggttaacgctctcaactttccttcgctgcgcgatcgatccgacaggtgccgcaaccaacgcgggttacagatcgcagcagagccaactcgtttgtaagggcgaaaacttttttcaaattttatttcacaaacctgtttgcttcgttggcagttttttatggtgacggattaggcatttcgagtcaacaggatagcctttcgctcctagcagaacggtggttgcactctctcgaggcaacgatgttggtgtctacatcgacgtcggaagctggaaggaagaaatggccactacaaagatccaaagcacacagtgagagggatgcatagccgagctgtgtggcagaaggagtactccatcggatgcatcgcacacaagatcggcaaaacccccagaagacagatcccgcctgcacaagatcgctagggaccgcacggcacaaacctttggcatgttaatttgagccgaggcgcactgcctcgcgcggcgcaattaatcatttacgttaggctgggcgccaatgtgccgccatctgcgcacggagggaaggggaaagaagagggtcccgcagcaagacggccgctaaacccaaaggccaggctcggcacccccctatctcacacagctaagccaccccccccccccccaccccgtataggccaacagcaagcagggcagatgataggctcgcccttggcggctgggcagacgatacgctcgtggagcagggcctgtatgccttgcttggcttgccaacggagagcgtttccaggctccttctcgcgagaagaaatgccaaccacgccccgggggggccgtcgtatgtcttgagcctcggttgcttttgtgggcggctgccgccctcgaagagcatcactccccgaggcgggggcaagcagttcgcaaggcatggctagctcaacaaacccttatgaggcgtgagttcttcttctgcgagctgcaccaccctatggcagaaggctgaccgtggagagaacaccgacggcgcctcatccgcgagttccttccatctcgagggggacggactgtggccggcacagcgaggagcccagcggactaggcaaggatctgggtgctgcagatacgttcaacgcgcacgggggcaacgctgtcgcgtgatcatcgacctcaagatgtgggaccatgtgcttgtgcttgccattcgaagaggaaaggagaggtgtcccatagcctgttgcgaccacgtccatgcaaggagtggatgtgtgcagtgggggaggccattagcctgcgacaataacgcacgacttcgaggcgccagcgctttccgtaaaggatgtcccgcacatactctacagtaactttccactcgtgaagaacttcaacgagaaaggtgatctcgatgtcaaaaggacacgagcaggtaaggcttgctcagggacgagggcagaggcgaggctgcccacggggccctcaagcactccaagtacaccccatgtccttgcggacacgcgggacagaagcagatcgtgacgtcatcgagggcaggctgtcgtccagtgcgagcgccccttcgcagggaggagttgtgcagaagggcgactcccaggggcctcatatccaaaaactagcctccgctccgcctgcgacaatcgccgatagatgctcttctgaggcctttacttgtacacgcggagcaggacatgcgcgccagcgattggagcggacgtggaggtctgcctgacacgcaagacaggcacttcgcttagagttgcctgcctcgtcaaagggccacagggaggggtatcgttcgtccaggtctccgcctgcgccacatcagcaaggttcgtagagtcgaaagggcaccaacgcatgtcaagatagctccggaagggcagggtagggatatcccgacgaggaatacttcttcctcagatattccgattagccaggcgtattcggggctccggcaatgctaggtctatgagagatggaactgagaaaacagaggataagggatttggattcatttggatttagaatggaccgatctgaaggtacatcaaaaccgctgaatccctatctcaagctcacccgatcatctagctccgcaatgcgtgggagtcctgagagggcgtctgcatctgcgaatctgagggttgcgatcagggtagtcgctcgcagagggttttgtacagccctgtcgctgcgcttgtaaagagaagagccagcgccttgagggcattcaggacctgctggctgtgtggccaaaggatgtagatgttctggtgttgccagaaggtacctcagagcaggtatgtggctataagctctaccgtggggtgctgagcgcgatgagaagaccggaacctttgaacatcacacagctcctggataaagttacagacaaactggggaacatacgcctcgccgtgatggacaacctggtcgatgtctcaaacgtgggggctctcttccgcagtgcggcagctctggggatcgacgggatcattgtagcgccgacttgtgcagacccgctcaaccggcgatcaatccgtgtgtcagtaggtaccgtgtttcaggtgccttgggcacgggcaggcgataactacccccagggactgatcaaggagctcaaaacggatgacgtcacactggtgagcatggcgctgagtgactcagcggtctcactcagggatcctcagctgaaacagcacaagcgagaagcaattttcttcgggaacgagcgcttcgggctctcacaagagatcctgaaggcctctgactacctcgttgagatcccgatggagcacggggtcgattcactcaatgtcgcggcgagcagcgcggtcaccttctgggaactgtgccaatagatgcaaaacaagccccttcgtacgaaggggcttgtcaaacgttcgtaggttgtacctgactttatgactgtggattggccgctgccacgctcttcggagcgaagccatcgtcgcgggtgaacatagccatgaactccttgcctgtgatggtctccttcttctgtaggtagcgcgcaatctcatggagcttgaagcggttctcctgcagcgtcttgagggcgctctgatggccctgctcgacgatcttctgcacgagctcgtcgaccttctcctgtgttccctcagagcagaccaactcttcgccgccgccaaggtagcggttggtctgacggccaagttggaccatgccgagatcgttggtcataccgtactgggtgaccatggcgcgagcgatctgggtcgccttctcaatatcgttggaggcgccgttggtcatatcgtggaagatgagctcctccgccgcacggccaccgcagagcactgcgatctgctcctccatttccttacgggtcatcaggtagtgctcgccttggtcaacctgcatcgtgaagcccaaagcaccggaggtacgcggtacgatcgtgatcttctcgaccggagcgtccttacgctgcacagcgccgacgattgcgtggccgacctcatggtaggaaacgacctgtttctcgtgttcggagaggacggtgctcttccgcttttcgccggcgataaccacatcgacggactcttggatatcgtcctgagagacgcggctgcgacctatacgaacggcacgcagggctgcctcgttgatgatgttagcgaggtcagcgccggaggcgcctggggtggaacgagcgatgacgccgaggtcgatgcctggctccatcttcacgtcgtttgcatggagcttgaggattgccttacgtccagcgaggtccggcagctcgacgtggattctgcggtcgaaacggcctgggcgaagcagtgccgggtccaggatctccgggcggttggtggcggccaaaacgacgatgcccttttggttatcaaagccatccatctcggaaagcagctggttcaatgtctgctcgcgctcatcgttggagttgatggagctgtcacggcgtttgccgattgcatcgatctcatcgataaagacgatgcagggggccttctttttggcctctttgaagaggtcacgcacccttgcagcgccgcggccgacgaacatctcgacgaactcagagccggagatctggaagaaggtgacgcctgcctcgccagcgacagcgcgggcgagcaaggttttaccggttcccggagggcctacgagcagggcaccacgcgggcagcgtgctccgatcgcggcgtacttctgcgggtggcgcaggaagtcgacgatctcctgcagggattccttcgcctcatcctggccggcgacgtccttgaaggtggtgtggacctcttggcctttgacctcacgcgcagaggagcgcgaaaggtttccaccgccgaagccccccgagccgctaaggtccatcgtgtcgcccatagatttccgcagccgtcgattcaagagccagccgaagaagaagatgagggcgagtgggatgatgtagctcagcagcatgtacgtcatcagattcgaattctcattcggaatgctggcggacatatccacgttgtggtcctgcaggcgctgcaccaaggtagagtcgtctgggaatgctgtagcctgataggtgatgttgtttttgccgacaaacgtgatctcattgtttgaggtatcgatctgcgcctttgagacctggttgtcgtccaccatattcaggaactgtgaatagctgacgctttgggtctcctgatagcctgccgggtgaatgtaggaattcagggcaaacaggagcgcaattgcgatgatcagatataagatcaccgattgccgcggcctcttatcgttgtcttccatattgttctccctcgttaatatatgtggagatgtagttatactaaagcctatgccttaagcctaccccataggcatacactacagacaggctatttttcaaaacagcctgccaacactccatatagagtgtacagagaattgttcgcgtgatcaggtaccaccgctagtttgtgggatgctccacgatcacgccggtcctataggcgtccaaaagcgcccgtagatcagcaatctgttgtcgcagctctgttccggtatcggtgtccttgatcagcagcggcttttcctcgtattcgaacttgtcattgtctgagacgatgtcctcgttcaaatccaagacgtctttaatgctggtaaaaggacggtgtgccttgatgcgcatgccggtcgcctctgcgatcagggtgtagcctgcgatgccggtcttgctgtggtaagcgcggcagaagccaccgtcgataacgaggactttgccgccggcacggatcgggctttccccggagcttgcgtggaccggggtgtggccgttgataatgtgggagtggggatcggtgaggccgaattccctcagcactttgtcggcgatctcagggttgtcgatcaggctgaagtaggggtcgcgtggttctttccaggtggacttgtcaagcacgtaggtacgctcaaaggtcctgacctcacggccggagaggggcgagaaacgcccacaccacaggtaccacatccagtcgagtgagatctggtcgtgggtgtgccaggcggtgcgcgcaacacgctccgcgtagtcgaagtactctttgcccgccaggagcttgtcctggtggcgcaccgggttgaagcttccgtccttcttcatgggcagacaggcgtggaagagcacgtttctgttgtggaccagatacatcgagccatggtcgtagaggaagccgatgtcgcgctgtagacgctcggagttgcgggcagcctccacgaggttgtccatcacatgagactcctcttcggtgagctcatagggctgcatggggtccacggtgggaaagtcggtggttctgagctcgtactccttgccctggattgtcacggtgcccttcttcagatccatcttatccaacagcagacgaccgtccatctgccagttggggtgacgcaggatcgtctggccttccagcttgaacatgatgaccgagatggctttctcaaagggtgtaagcttctcaccctccttataggtgcgctccgcaaagagggccagctcacgcagggagattccataggagttctccacaatctccagtgagtcatagtggatgttattgcggatgatcgccgctaagcagaccggggagccgcaggctgcccccatccagagaatatcatggttgccccactggatatcgacacggtggtagtgcatgaggcgctcaatgatgcgatcggcgtgggggccgcggtcgtagatgtcgcctacgacgtggaggcggtccactgccagacgcttgatcagggcggagagggaactgataaagtcatcagcggagccggtatcgatgatggatttgatgatcgactggtgataggtctgccgagatttgcgctcctcaggggtgtaatgcagaagctcgtcgataatgtaggcgtaggcgacaggtatcgccttcctgacctttgagcgagtgtagttgccagagaggtagcgggctaagcgtaccaggcgggtcagggtgatcgcataccactctgaggtcgtcttgccagcatcatggaggcggcgcagcttttcggtcggatagtagatgagggtgcagaggtcctgctgctcctcacgggtgagctccatcgcgaaagtcttcctgacgcgttcgcggatgacgccggagcagttgttcaggatgtgctcgaaggcctcgtattcgccgtggatgtcgctgacgtagtgctcggtagccttcggcaggttgaggatcgcttcgaggttgatgatttcagtgaaggcggtctgtgcagtggggaacttctctgagagcagctccaggtagcgcttgtccgctttttgtatttcttgcatgaatggtcttttctttgctcatcagactctataaaagatgttgagtttattttcacactgcaactatagacccgtgcaggggcgttctgtgagtggaggaaatacacacagagtccttaaacggtggtgtgctgtggctgccggttttgagacacggatttgaccgtccatctaaatcccgcaaagatgtgtctgaaagacacggattgtaagagtgacaatgtcaagacgacaaggagcctacagcccacagttcagatgaaggtggacttgaggtcgcaaaggagcaggggagatgctctcctccggtagcagcgaacacgtgttgtagagcctgtcgctggcggcagctgaaaagactagctgctggcgggcgcgacacatattcggcaaggcaaagaacggcgtgcgcaagcaaaggagcaggcgaaggtatgacgatgctctcgagacgatcggacagctttagcgcaagcgcaacttcctctagcagtttgcgacgacaaacgcatacagctccaagggtagggcaatagcatagcgcgtacatcgccaggaggtcccgcagaggggtccatggatgatgggcagatctggttgggcgagacggaaggtcttccgcatacgatgcattacacatcgactgcccagccctttaatgtgggcaaggaagatatagaagatctgcaaaagcaggagaggcacattgttccacccgcctacaggggtcttaaggctgatggagcttgccggcatctgcccatgctgtacgctgtcgtctccctccggtagccctcctgggcatccagagtttgttcccctatctcttgaaggcaaggtggtcctgttccccaaccagtgtggtccgccgacatccaccctatgtcccagatcgaaggaatcaccttgttatttaagctcgctctcgaactgtttacgcttgtatcgcctgctggaaggctcttgacacatgccagagcacagcgagatcgcttaatacaagtgcgcaagcaggctttcagggagcatggggcaccctttaccatgaccttcgagcaggggagatcgcttttggctctaaggagtacggctttcctttctgctcgacatcaaagggatatcccagagacatggacaaaagtgcgcggatgtgtaaggacaacgcctttgaatagagagatgggttcagaccctcaagagcgaatgacctaaaggcagacaaaatacagcaaacactgcgcctgccagagtctccaaggacaccatgccaaagttcgttgagttctacaacagcagcggattcttcactcataccgcttacgctgcggacacggccggaagaatggttactacagcggtatagccgagcgaatagcctacaaggtggcactgtgtaaagccagggattcggaaggaatgggccttctgggtctcactgctttagccaattcactcaccaacaaggggagtgcaattggcctaaaactttttctttttggcagccctcacaatgaggacttctaaaaagaatactgagccccgggacgctgaccagtggatatataccccattataaaatgaaaggtactgatttaatagcagggccaactttccttccgtatgcatggtcttcagcccttttaataaaactttttcaatacagcaagggatgatcaatgctgaaacgtagaagattccactatatctttctggcaacataatgagatatgctgcacatgcaagatacggaataaccgataaacaaactcccaatatagtggtgttcaaaaagccaaacgtaataaagattatcccaataagaagatacattaaaagaatgattatccagcccataagcattttcttgagatgattctgttctgcggttgttccttccatacacactctcctctctggtagcattttttgatttctggaaaaagatacagtgagcagtgggaagcgcttgcaggagatagagattatcgataatcatatcggctcttttaacaagtcaaatataacattatggcatggaaaagcagtacagccacagaataaactgtactgcttaccattgaatcggaagtgtccttataaaagcctagcattcgtctcgtttgttgtttgttaagacctggttgtgagttgtcctgacctggtgcggcgtgctaggataagccacagcagcgatgaaggagacaagtacgtcgcgtaccggacacactgagcgagcagggacggtgagagcctgcggcggatccatgcggcggaagatcactctagagcttcgggctgaacaaacatacagatttaagtaagcctcgacgggatggccaccgtgataggccagccgagtaaggcggaattccgctcgctgggtggttgaacagggcttattgtgtgtgccttgtcccagcaagagggacggggcgcattttttatggtgcatcccggatcgaatgaataggcattgaatgtgaaagtgaggtcagggatggcaaacaagttcggaaaaaccatgaatttgccccataccaaatttccgatgcgcgcaaggctcgcacagagagagccaaagcgcctcaaagattgggaagccaatgacgtctttggtcagctcctcaagaaaaatgaagggcacgacaagttcgtgctgcacgacgggcctccgtacgcgaacggcccaatccatctgggtcacgcacagaacaagatctccaaggacatcatcaaccgttactggtcaatgaagggcaagcaaaccccgtacgtcccgggttgggactgccacggccagccgatcgagcacaaagtcgaggagcagctcggaaccgacaagttcaactccctctccactgagaagatccgtgagatctgccgtgagatggcagtcgagcaggtcgacacgcagcgtcagggcttcaagcgcctgggcgtgttggcgatgtgggacaaaccgtacctcacctatacgcacaactacgacgcaaccgatgtggagatcttcaagaggatttacgacaagggcgctatctaccgcggccgcaagccggtgcactggtgcacccactgccataccgcactcgctgaggcggagatcgaatacagcgacgaggtttcacccgcaatctttgtccgctttaagatgaccaccgtaccgaaggggctggaagcctataaggacaatctgtgggtcgacatctggaccacaacgccgtggaccctgccggcagacgactgcgtcatcctacacccgaaggcgaactacgtggcggtcgtcgtcgacggacgtaccgagatcatggcggaggcgctctatcagaagtgcaccgagaagttcggctacatcgactacacgctcgcgaagacccctgacggcgaggtttggagagccaccggcaaggagctcgtccacaacaagtacttacagccgatcttcgcggatcagggtgtcgagggcgagttcatctatgctgattacgttacgcttgaagacggcaccggtatcgtccactccgcgcctggtcacggtgtcgacgactacaatgctggcatgcgcttcaatatcccggtcgtgatgccggtcgacgacgacggtgtgttctacaagggcacggccttaggtaccggcggccctttctccggtatggaagtcaatgctgcaaacccgaagatcatcgagtggctcgacaagcgcggtacgttgatcctgcacgaagacatcacgcacagctatccacactgctggagatgcaagaagccggtcatcttccgcgcaaccgatcagtggtttgtctcgatggatgacaccggactgcgcaagcaggccttggaggcgctcaagaacgtcgagttctaccccacgcactccgtcaaacgcatcaccgcaatggtgcaggacagaccggattggtgcatctcccgtcagcgtaagtggggcgtgcccatcccggccttcacctgccaggactgcggtgagactgtaattaacgacgacactctcgacaaggtaatcgagctcttcaagaagaagggctccgacgcttggttcaccgacgatccgaaggaatatctcggcgacgtctgcgtctgcccgaagtgtggcggccacaacctgaaggccaactccgacattttcgacgtctggtgggactccggcgtctcgcataccgccgtgtgcaagcatcgcccatatttgaagttccccgcggatatgtacctcgaggggtcagatcagcaccgtggttggtttatgagctcccttatgacctctgtgggcgcctacggcgtggcaccgtataagtccgtggtaacccagggcttcacgatggacggcaaggggcgcaagatgtctaagtccttagggaacgtaattgacccgaacgaggtctgcaagagccgcggcgcggacatcatccgcctgtgggtcgcctcggtcgatacctcgaccgacgtcccctgcgacgatcagatcctggaccacgtgggcgacgcctaccgcaagatcagaaacaccttccgcttcctgttgggtgagctcgacggccagttcgatatggatatcgatggcctcccgctcgaccagctcacagcgtatgataagctgaccctggctcacatgtgcgaggtgcacgataaggtggacgaggcgtaccagaactaccgcttcaatgtggtatatcgctacctctacgagtttgtgacggagctctccaacggctatctgaatgccacgaaggaccgtatgtactgcggctcaaaggattctctggagcgcagaagcgcgcagaccacctgggcgtacctcttgagtatgctcgtgcatgacttccagccgatcctagtttatacgaccgacgagatgacggcgtacatgccagcatgctgtagggacaaccagaaatatgctgcgctattcgattggttcaagaatccgatggccaaagagcagtacgagagcttgctacccacctacgaggcactcagcgaggcccgcaacaccttcaccaaggcctacgagaaggctcaggaagcaggtacgattccggaaaagaccacccaggcttcccgtgcagagctgaccgctccgaaggagctctttgagctcttgaacggtgagcacggctgcgatctggcggagcccttcgtgtgctctgaggccaccttgaagcagggcgacgagctttcctgcgacgtcctgcctgcgcacggtgagcgctgcccgcgctgctggaactaccgtgatctcggcgaggacgggctgtgcccacgctgccatgaggcggttgagaaagtacagcagggtcaggcgtagatggattcacgtctgacacagcgtttaagatgatcaaagcggccgtgtctggtggcatggtcgcttattttgagaaaagggaggcagaagatggtggcaacgctcaagcgggggaagcgtgtagcgctgttctgtgtcatcgcggtcgcgattgtgatagctgaccagcttgcaaaggtatggatccgcgcccagctgccccgcgtaggtgacaccgctccgctgatcccggggatcatcaggctccagcgcgtcgagaataccggcgccgccttctctttcggagaggggagcggctgggtctttgtagcggtcgccctggcagtgtgtatcgtggcgctcgtgtggattgtacgcagcaacctcgaagtccccttggccatctcgcttgccgcggtcgcaggtggcggtttctccaacatgctcgaccggatctatcagggctccgttacggacttctttgcgatagtcttcatgaagttcccggtgtttaatgttgcggacatatttgttacggtgggagtgatcgcaacattgatctgtatatttgcaggcgagggcgacaatgcagactaaggtagtttcatatctggtgggacctcaaggcgatcggcagcgcctagatactttcttagccgcccgggaggagatgccttcccgcagtgcctgcgcctacctgattgagcatggaaatgtcacgatcaacgacaccttagctgacagtaagagcgaacgcgtcgccttgggagaccggattcaagctcgcctgattgtgaaggacgaaggagccggaccgttggcggccaatccgaacatcccactcgatatccgctttgaagaccagtatctgattgtgctctccaaacaggcggggctcgtctgccatcctgcgcccggccacaccaatgacaccctcgccaatgcgcttgtgaagcactgtggctatgaccacctggggaagctgcagggggaggaccggcccggcatcgtccaccggctcgataaagatacctccggcctcatggtcgctgccaaagatgatgcgacacagaaagcgcttcaagatttgatacggctgcgcgtgcttgaccgacgctatgtgacgttggtacagggctacgtggcacccaactccgggactatccagaccggcatcacccgttcaaaacgtgaccggctgaagatggcggtgagtgaggctccgagtgcacggcaggcgattacgaccttcacgacgctggaacgctttgaggcagggccacgcgatgaaggatattcgctgcttgagtgtcacctctacaccggcaggacccatcagatcagagtgcacatgtgctacatcgggcatccggtcgtgggagatccgctctacgggcacggatctgaggcggtcaacctggggctgacaaggcagtttcttcactcctggtacatcaagttcgaccaccctgtcacgggacaaactatagagttagctgatcggttgccccaagatctgttggatgtattagaatcattgaaatgcacctcaatgggaaggacccgacgcggcgaggagatcattccgcgattaagggtgcattgagcgtttcacgcagccgaaaggcagaatcgcgagaggggaaatatcagtgtatttcatgagagtaggcttaacgccaatcgtcatcttcaacgtgatcattttcctcttctacaccatttgctatttctatcagggagtctatctcttctatggactgcggcacgggaacgtgacactcccgaaagccaaaaaacagcacacctttgcctacgtgatcgcggcgcacaatgaggagcccgtcatcggaaatctcgtgcactcgattcttagtcaagactatccccaagataaaatggatgtctacgtggtggcggatgcctgtactgacaatacctacagagaagcgatcgatgccggggctatcacctgggagcgcaacgacctggtccgtaaaggcaagagctgggtcttggattacgcctttaaccgcatcctcaatgagaccggggacaagtacgacggctttttcgtattcgatgcggacaacatcgtctccccgaactatacctcgatcatgaacgatgggtttgaccagggctatctggtgctcacgagctaccgcaactcgaagaacttcgactcttcctgggtcagttccgcctatacgacctggtttctgcgtgaggcaaagtttttgaataatgtccgtatgatgctcggtacgagcgccgcaatctccggttccggctggttggtatcccgctcgatcgtcgaaggcatgcacggctgggatttccacctgctcaccgaggacattcagttctccaccttctgcgcgtcgaacaacatccagatcggctatgcgccggcggagttcttcgacgagcagccggtgaccttcaaggcttcctggattcagcgtatgcgctggacgaaaggcttctaccaggtcttcttcagctatgtgcgcgatctgatgcacggcatccacagaaagcagttcgccgcgtatgacatgatgatgacaatcgcgccgggcatgatcctgacgcttgtctccgccttcgtgaacctgacttatctcattgtcggaggactgtcacacggtttcttagcgacgcagggtgagcttttgatgtgcgccgggtcgctgatcatgacgttcggatcgatgtatgtggtcttctttatccttgcaatcatcacgacagtctccgaacgcaagcacatccactgccgtaaggaccgccggtggaggatcttcacgaacttcttcaccttcccgatctttatgataagctacatccccattaccgtggtagccctcttcaagaaggtcgagtgggtgccgacgaaacatgatatctccgtcagtttccaggatgttatgaatgaaggttagcttcgcgaatcgtttcctttgaggcgtcggttcgaggcgccacgatctattccaaccgatataggctcaaacaacaaagattggggaccaaaactacatggcgacgtttttcccgggcgaatcccatacgttttctgagtatctgctgataccaagctattcttcttcgaagtgcattcccgacaatgtctcgctgaagacaccgctggtgaaattcaagaggggcgaggaacctgcgctcacgctcaatatccccatggtatccgcaattatgcaatccgtctcgggtccccgtctggccattgcattggcccagcaaggcggcatgagctttatctacggctcccagagcgttgaggccgaggcggcgatggtcactcaggtcaagagctacaaggcaggcttcgttgagtctgactccacgcttaccccggacatgacgctgcagcaggtgatggacttgaaaaagaagaccggccactcctgcatgccggtgaccgaggatggtaccccgcacggcaagctcctgggtatcgtgacctcccgtgactaccgtccgtcccgtgacgaccgttccaagaaggtccatgagttcatgacaccgttcgatcagatgatcgtggcgtcgcaggacacaaccttgaagaccgccaacgatagcatctgggagcacaagctgaaccagctcccaatcgtcgatgagagccagcatctggtctccctggtcttccgtaaggactatgactcccacaaatctaaccctgacgagctccttgatcctcagaagcgctacatggtcggtgctggcatcaatacccgtgactacgcagagcgcgttccggtgctcgtgaatgccggggcagactgtctgtgcattgactcctctgagggcttcagtgagtggcaaaagctcacccttgagtggatccgcaagcactacggtgactctgtgaaggtcggtgccggcaacgtcgtcgacgcagatggctttaggttcctcgcagactgcggcgcggacttcgtaaaggtcggtatcggcggcggctccatctgcatcacccgtgagcaaaagggcatcggtcgtggccaggcatcagccttgatcgatgtatgcgaggcgcgtgaccagtactacaaggagaccggcgtctacgtgccggtgtgctccgacggcggcatcgtctacgactaccacatggcgttggcgcttgcgatgggtgctgacttcatgatgctcggtcgctactttgcccgcttcgacgagtccccgacccgccgtgtcaacgtgaatggttcctacatgaaggagtactggggcgagggttctgcgcgtgcccgcaactggcagcgctacgacctcggcggcgagaagaagctctcattcgttgagggcgtcgactcctatgtcccatatgcaggaccgttgaaggaaaacgttgaggcgtctttgttgaaagttcgcgccacgatgtgcaactgcggcgcgctcgatctcaaagagctacgcgataaggctaaactaaccttagtcagtgcaacctcgctcgtcgaaggtggcgctcacgacgttgtgctcaaagatcaagaccgcgatgtgaacttccgctcatagaagtatgtcgctgacaagtaaacgagatctttgaagcaagccccacggtttgtggggctgcttttatgtctataaaaggaggaacgagatggccgatacctctcacgatacacccgaggaaaacattcctgtctacgatgcccgcaagatcgaagaaaagtggcagaagatctgggacgacgaacagctctacaagacggacaccgatccgaacaaaccgaagaagtatgtcctcgagatgttcccatatccctccggcgacctgcacatgggccatgcccgcaactattcgatcggcgatgcaatggcacgccaggcccgtatgcgcggctacgatgtcctgcatccgatgggctttgatgccttcggcctgccggcggagaacgccgcaatcaagcaccacacccaggcggccaagtggacctatgagaacatccacaatgcggtaacaacgatgcatcgcatgggcttcagttatgactacaaccgcatgttcaacacctgcgaccctgagtactacaagtggggtcagtggatgttcatcgagatgtggaagcgcgggcttgcctaccgtaagacctccccggtgaactggtgcccccactgcaagaccgtccttgcaaacgagcaggtcgtcgacggccggtgctggcgctgcggctccatccccgagaagcacaatctgagccagtggtacctgaagatcactgactatgcacaggagctcttggacgatctggacaagctcaaaggttggcctgagaacgtcaaagcacagcagagaaactggatcggccgctctgaaggtgcagagatcgacttcaccctgattgacaaagatgggaagaccccaactgaccgtaagatcacggtctacacaacccgtgcggataccctgttcggtgtcagcttcatggtactgccgccggagagtgactttgcgctcgagcttgtcaaagggaccccgtacgaggaggactatcagaagttgagaaaggcgactgagcaggtttcctctgtcgaccgtcagggcaccaaccgtgagaagcacggggtctttaccggccgctacacgcagaacccggtcaccggcaccaatgtccccatctgggtggcggactacgtcctgctcgactacggcaccggcgcggttatgggcgtaccctgcggcgaccagcgtgacttcgactttgcccgcaagtaccatctgccgattcctccgatcatcctgcagaagaacgataagctctacgaccagctgaaggatcagaaggagatgaaggtcactgacgtcgattgggatcaggcaatggcggcagagggctatctcgtgcaatccggtgagttcaccggcatgaagggcggcaagcgctctgaggcggtcaaggccgtcaccaagtggctcgaagatcaccactgcggacgcgcaaaggtccaataccgcctgcgtgactggctgatcagtcgtcagcgctactggggcaacccgatcccgatgatccactgcgaccactgcggtgatgtgccggtcccggaggatcagcttccggtgaagctcccggagaacctgaacctgggtgcaggcgataccctagccgagtgcaaggaattctacgagacgacctgtcccaagtgcgggcatcccgcgaagcgcatcaccgatacgatggataccttcacggattccagctggtatttcctgcgctactgcgatccacacaacgacaaggagccattcgacaagaagaaagtccagcgctggatgccggtcgataactatatcggtggcattgaacacgcgattctgcacctgctctactcacgtttctggaccaaggttctgcgcgatatgggtcttgtcgatttcgatgagccgttcacaaatctgctgtgccagggcatggttaaggactccaatggcgagacgatgtccaagtccaagggcaatgtcgtaccgccttcgagtgtgatcgatccgtacggtgccgacacgatgcgcctcgcaatcctctttatcgccccacctgagaaggacttcagctgggatgaggatgccgtggcaggctgcaaccgcttccttaagcgtgcctggagaatcgtgtggctgctgtgtgaccagcgcgataccgcaaacccaggtactgtaaatccggataccttggacaaacaggagaaggtcctcaaccaggagctcaaccgcctcggcatcaagtgcaccaacgagtttgaccacacgcagttcaacaccgctatctcctctatcatggagctggtcaatgcggcttcgaggtacgtgaacgctaccaaggcagcagagcgtaacaatgcgctgtgcctgacagttgcccgcacgatagtgctgatgatggcaccgattgcgccgcactggtcagaggagctttggcatgaggcgctgcagcagaccggttctgtgtacaacgagccctggccaaccctcgacgagaaacaggcacagagcgacacgatcgagatcgcggttcaggttatgggtaagcttcgcggccatgctcaggttgccaaggacgcttccaaaggtgtggttgaggagactgccaagaaggcagttgcccactatatcgagggaaagacgatccgcaagatcatcgtcgttccggggcgtctggtcaacatcgt

SEQ ID NO: 410 - DNA, 15501 bp, Unknown
  Metagenome-assembled genome
cctgacgttcgatgcctacctgggtcaacactgtgccactctgtgtcagcaccggttttctcatcctggtatctgcgggttggaggcccaggtcgcgcagcagtgaggttagttgatccttgagccatgggcactgtcgttccccagaacaccgccaatcccatcgaagaggttatctgcaacgaggtgagatcgttatagccctccggtaactaccaagcaggctgtcccaaagcgacaaggttgtctgggtgaaggagccagttccccgaaggtctccgccacccatcggcaaagtgcgtcagcactgacccatgttcctcgtcgttatcctctgccaacactgcagcagataatcgcgatccccggcggcaattcgtgcacttcacccaccgtgaatgggagtttggttgcttggggtcgctgcgcaaacgccacacatccccaggctcccggcgggcagagacttgctttcgaagtcttgagtatctgcagcgcttgatcaaaccgatcggagccttcttctgccagattccgtacctcagaatcagcctgctcttcctcttcacatgcctgctgataggtcttggaagcctcctcaatgatgcgccagtagtgttcaaagccgctttgggtattcgtcgttgctgacgcaacattcccttgcgctgaagctgtcaggcgacaaacctcgcattcctgcacttcaccggcatcgagttgggaaagcgaagcggttcctgaaggcgctccggtggcaccgggacaatctttcacgctgtggatcaccctcgttcctccctcatcggtggtcggccacacactttgcgtatagagcgtggtctctttcatttggtcggtatcacgggggagtgccgggagatccatctcaagcgtgccatcgggaagctcccggtagtacccgtcctgcatcttctgttccgcataggcatagaaggttttgcgcacggccgagtccgtctccccttcaatgcccggatcggtctgtttctcgttggccaggcgctgtgcgtaatacgcgcgggctcggtcaagcgcaataccgaaattccagcttgcaactgagggacattcgggattctgcacggaattgagatgccccaacttgcctgcacgctcgcgcatacagtaggggtcagggacacagtccgccttccaggcttcctccttagagctctcttcctgttgctggtactgttccttcttctcagaggcccccgctagatccgcattggtctcttcaagcccttcctcgtcgatctcctgattgacactcgaaaaatcagattcgctctgcatcggaaagggcaaagcactcccacgataggtaagagagtccgtcgactgcgcctcgatagtctgagtagcggcgtgcatgcacaacagcggcagtattttctccaacttcgagagcccctgcgctgcactctgtgccaatgtccttcttgcctgaagcactttgataccggcatccgtggcagcagtacccactgcggcggatcccggcaccgctgcagcgaccattccaacaccgactaagagcatgccagcgataccgagggtttggacgcaggcgttcaaaacctgcacgatcaccgtgtaggagcccaccacctgagtcgcgctgatagcggcgctatccgcgaccgcctgagtatccgcactgcgtgctaacgcccatcccgcagtggccaaactcgcgatcagcgtgacgctcaagatcagtgccactgctgcagcaattgtggtgtaacccccttcctcgtcgataaagcagttaaggctcacgggagcaaagtcctgtctctgtgttttatgttcagacatcgtcccacgcttcaatccattccgcatagtcgccttcaagccactccggcctcaattgctccgtaacctgtgtcttcaactcaaagcgatcagtgtcacctgcgttctgcatcgccgccaccagtcccaggaatggcaatggtttagcatacccggtgatcgtaaccgtcacctgctgctcctgcgccccatcgatctcgatctcccactccccttcatgaaagagtggaagctcaggcagcgctgccagcctccgtttggcaaactccgtgcagtcctcactgctgtcattggtctccgcgagccgtgccgtctcggcggcggcattccacatcacggttttcgtgtatagaaggcacagcggctgcagaagcagcaacagcgccagagagaagattgggatcagaaaggccgcctcgacacttgcctgcccgacttcagtagagcaggagttcaaggacatcccctccttgaaccaggtgagagcaggcatcgagcacgtcttggatgagggagcctttcgccgcgtagtgccacaacgccgagagggcgagaatcacggctagggcgacgctgagcaggaccgcatactcaacggtcgactgccctgactgttcctgtaccactggcatcgaagccctcctctcaggtcagatgcacgatcctcacgtcggttgcgttatggggcgcggtctcaatgatgcagacatccgcccagccagccccgtggaccgcaaagccccaggtatgtcccagcagatcgagatagcctgcgcgcaggagaatgcagttgcgctgattctggtagtgacgcaggagctctgttccagtggccttcagggatttattgacggtgtagcgttcaacttcctgcccttctgcactatcggcctcagtggtttggtggtcgagtacctcatcgacacgctcttcgagtgcctcctcctgggcgtcctgttctgcagcctgctgcttacccacttcaggcaacggatgatttacgcgtacgaagaagacgagcgccaccaccgcggcgattcctatgaacaacagctttctcctgttggaagtttctttatgtccgctcatagtgagttgatcccgttagcgatatcgttccagagctgggtcagacgatccttgaatgcaaggatcgaaacgattgcaattacgacgatgacgccgacaaggatggcgtactcagtggtcccctgccccttcttctcgaggacaacctgtctcagggctaaggtaaccttcgcagcaagcttctccatagcaaactcctaacctagactcaacgaggatcccaagagcggacccaaaattgcgagcatcattgccgggacgacgagcgtccccagcggaatcaacatcttgatcgggaccttttcgatacgctcctccgcagccagacgctgctcttccctaagggcagaacgttgtgactgcagcgtctcccccaagggcgtcccgagcataagcgcctcactgactgcatcggcaaaccgcttgaatgtaggacttctgagctttaccgccagttcatgcagcgcctcatcgcgacttttcaatccgcatctccactggaaaagagcgctctgcagctcgcgcgacagtccgctgtggccgcgctggcagtagagttcaagcgatgcgtcaaaggagagcccaacagagagaccgagcgagagaatatccagaaaggtcggcatttccctcaggcactctgtctgaagctgtgcgtcatttcgtctgccctttctcgtagaaaactgaatgcgggacgtcttctgtacctgtaccgaacgatgcccgacggagagaacccagacagccacgaacgcaagtgcgctcatacccgacgtaaaatagagccccaacgcctccatctacatcacgctctgcgcgagccgcttgataatgaggatcgcaaccgcgtccatcagtgctgctagagcaatgcaggtgagcccctgagtagtgagcagtccggctttaaaatccggtgagatcagtgcaagcaatgcgacgatcaggatcgggagtgtacagactacccgcgccgagagcctaacctgtgcggtcttgaccgaaagctcccgtttgagctcactcgctttctcgacgtagcgtgccgaatccgaaaatagatctttgagcgggctgccggtccgctgcgcgatctccaaagcgcagaccatcaaattcatccccggaccatccacttcttgctcgatcccttccagggcatcctgcagtgaggctccggcttcaagcctgagtgctgcgtggctgaagccttcccccagtgttccctgcatcgtggttccaatgtattcgaccgcctgccgtaaagttttgcctgcgctcagtgccgtcgccagcgttctgaaggcatcggggatatcgcgtaccaattgcagacgctcaagacgtctgatgcgactggcaagcaagctgatacctccaaagtagagtccaatcaagatgaacacacctaagggtgagagcgtcagcacaaaccccaccagaccgatgagaatcagaactgccagcagcatccctgagggataggcaacagcgtgatacttctggagccatcgcatcgtcgtctgccaggcagaccactgagacagtgcctgcgcaagcttcgttccggccagcagcttgaacaggccttcccgcttcgtacgaagttgatagggggcttcgttcttggtgactacagacccaaaaagggtcgcaagcgccgcgatgcttacgcagtacaggaagcctgccatgcgctcacctcccctttgcttaacgctccatcctcaattgcttgtcccaaaaagtgtggaactgcgaccagcgaccacgtccgcttcgcccggtcaaaatggatgcattcatgtagtgagacaccaccattctctgcgcgcaatacctcatgcagcgatgtgataaacctcgatccatctggcatgcgctgcgacattacgatcagatcgagtgccgtagcgatctgctcttcgatgagctctgctggcagatccataccgaagcgtgccatcagcaccaaccgcagaatcgcttcatccgcggtccccgcatgcagggtcgtgagcgacccatcgtggccggtattcatcgcctgaagcatatcgatcgtctctgacccacggacttcaccgacgatgatgcgatccggacgcatccggagggcattcttcacaagttcacgaattgagactgcgcccgaaccttccagcgactcgttacggacttccagccgcaccagattcctcgaccgttcaaaccgaagttctgcagagtcctcaatagtgataatccgctcgtcttccccaatctcacgggagagggcgttgagcaaggtggtctttccagagccggtgcctcctgccactgcaatgtcgcagcggagcttcacggcccagcgcaacagccgcgcaaaccagggaggaattgatcccagagcaatgagctgcgcgagatccacaatacggtcagaaaacttccggatcgtcacggcggtcccgtcaatcgctaatgctgaggagactgcattgacgcggtagccattgggaagtcgggcattcacgatcgggttgctgtcatctaagcgacgccccaagggggccaaaatcctatcgattacggtcaggatctgctcatcgttttcaaagacccgttgggcccgtttgagttttccattctcctcaaagaagagtgaaccggcgccgttgaccataatctcgctcacctgttcgttgtccaacagtggctgcagtgggccgagcccacagatctcatcgaccacttgttcacttaaggactgtttctgctcatagctgagccgatcaaactcttcggtattgatcagcgactcgcaggctactctcagctctgtgcgtgcccgtttcacatcagatccgctggcaaggtccgccaccgttgtcagccccaactcctgcaccagcgcattctttaggtgctgacgcatctcggcggtgataccgtctagttcaaccgcggtatcccccgtatggtactgatgctgcacgcgctcaagaatactcatctagaccgcctctttcttgcggccaaagaagtgatgtttggtccccttctgcttgtactgcagcgctttgtgcgccgcttgtactgagggtagatgccccatctcctgtagcacagaggctaacagatgctctgcgctcctgatcatctcggggttctgtttgaccagttcaggtacgtgtcccgcttgtatcagctcatcggcttccaagcctccatcgatcacccggatcgtgcgggcagcctctaggccctgatcggctcggttcacgaaggtctcctgcaccttcttggggttgcagagattgataacccggatgatgcgggttcgcgcgacgccgagacgcaccgcaagacctcctacccgtgaaagcgaggctgccatcccgttgaattcaggacagatcaagagcagtcgatcgcacatctgcgcagcctgggcggcagcatcattccaggcagtccccacatctacaattacaagatcggaccgtgctgcaacgagcgacaggagtgtcccagcatacggcgccacgagctccgcattctcgggccgctcacacggaccccagagcgacaccccttccgttgccatcttgccgcactgcgcgactgcctgctccccaacggcttccacatcccccaagctatccagggccgctggccccgaaagtcctaagtatgcaaaatcattgccacaggctagatcaaaatcacacagtgagaccttcagcccccaccgtgccgccacgcacgccatcacacaggaaagcgcactttttcctacgcctcccctgcctgaggctgcgaccagaatggggcagggattgggtcgccgcgcatagacggtatcacagttcagcactgcactgtcactggggacagccctgtttcccaccggagccattgcctgttgctgcgcgaactgaccggtattattgactgattgagcggtattgttgatcgatccagtattgctcgatacaggacgctgaggcggttgcggctcgtacacccgaaaggctccggttggctgccggtcagcgcccgcctccagttggtttttgatcgaggtgatatcgatcaccgaggcgatgcctgcctgcttggcacgtgagcggaaggaaccggaaggctcaggctgagctacaaccaccgcattggcatgtccatcctcggcaagcgccgccgcaagattgatcgggacgccattcgtcgcgtcgggaccgaccagggcgttgcactctcccggcatcgcctgcaggaagatgcgccgtatctcttcaggcctttcaacccagaggaagctttcggccacggtgtaggtgttcagcaactcttccagcggtctgcgatagggctgtgcggcaattccgatccatctcatgaagcatcttctccttgggtttgagcattctgtgccgaagggacggcgagtcgaagattcccagcggcgttggcagagagcacgccagctacctgttccggccgggctgcgatcgtgacgctctgcgagcccagctggttatcgtctttgccgctctgcgaaagcagttgcagatcgttcgccagctctttggtcgaatcctttccgaccgagtaggcgatgagcttggtgttggagctcaggtttgcagggatccccagattgtcggtctgcagcaatgtcaccgctacatagccttccggaatatccagatccgcgctgtcccgatcgaaatgcacttcacacacggggttacctttgggtaccgtgctcgtcagccgcttgcccacgaccgcgtccttctcggtctgggcgcccgagggtgccagatcagagatccactctttggtcgtgacatcggaagcccgaacgacttcgccctgggacagatctctcgtagtgacgaccagatcgacaacttcaccgccgtagcgttcaagcgcctctgagcgttgcgctgaagcttgcgcctgcacctgctggacgtagaggtagctcagcagaaatgcaagcaccgcacaggcaacagaaaagatcaccctaaaccgtttggacacgccttccctccttcgtttgaaatccactgtagggagaaaggcatctgacaacctgggaatataaacagctccctaccggtatcgaacaagcatcttccacgcaagatagaacgcaccggtgagcgatctaacagaaaggacctcccactccgtgagcggaaggcctctccaagacatctacaacatctctataaagctcaagctacagcgttacgtccggatccagactctgtgcactgtcgcgcatctcctgggcgagtgccacataggcctcgtaacgggcacaggcgaattttccttcgtccaaggcctgctttaccgcacagcctggttcagtagtgtgcgtgcaatcccgaaaacggcactgtgccgcataggcagcgatatccggaaagacctttgccagcccccgctcatgtcccaccaggggaagtgtacgcagaccgggcatatcgataatgatggcaccggtaggaaggcgcaccatctgacgcgcaaccgtcgtgtgcctccctgcatcgtcggagcgtctgaccgaaccggtcttgaggacgtcgtggcccatcagactattgaggagggtggacttccccactccagactcaccgagaacgagcgctaccgtaccccttccgacaaggttctccaccgcctgtgagccaatccccaccttgaatttgtcttcgagatggtgaagtggctcttcaagcccggccgtcttcgtcgtggttacgcagataggagtatcccctccgaccgacgtgatgactttccgcacgatggctgcaagctcctgttcgcttttacagcggtccgcttttgtcaggatgattgccgtatcacagccacagtcacgggcaatgacgcaggagcggaccaggcggttgtagtcgattccgtgagggccaatcgcctgcgctaccaacacgagatcggcattggcagtcagcacctgtttctcaccgcgggagccaccccgccagcgctccagggcgctcttcctcgggaggatttcctcaatcaacatctcttcatactgaacgggtaccctcagacacacccaatcccccacggcgacctttgagtcaccccacttggtgagcgctgcagagaattctgcacgacagaggcgctgttctgtcaggatcgcaggaaagctccggtcaagcctcacgacgcagcccagctcgtattcggtagggtctgccccctcacgctctgataaggtgttcgctgccttctggaaagcctgctgctgttcctcggtaggtgtgaggtctgcccacgtaggcagtgcctgtaacgaagagagggccggcagagcccgagagctcttgccggcacctttgtgtgaacgtttgtggtttgttctactcgctctgctcactctttttttgccttgctcctgtcatatgccctcatgatgagtttataaagctctaccagaggaatgatagcaaatgcaagcaacattgcgataccgtattcaccggcgctgatctcagcgaagccgaaggccaccgagagcggggtctcgataacgataaaggtgaggaccagagagcctgcaaacgcgtaccagagccacttgttctgggtcggaagtttgaagatcgactgacggcggctgcgcatgttgaaggagtggaacatctcgaccatggagagtgtcaggaatgccatcgtcatgccatccaaccctgcgttatgaccggacaggaccgcgtccagcgggacattctcaagcgagaggcccacgaagtaggagatcagggtcagcgccgagaccatgaagccctggacgatgcagtcgaggcccataccgttggcgaagatgctatcctcggtgcctctcggctttctgtccatgatacctggctctgcctcttccatggccattgccagtgcggggaagcagtcggtgatcaggttcagccagagcaggtgcgtcggtcccaagatcgtaaagccaatgagggatgcaacgaagacggagatgacctcagccaggttggaggaaagtaggaaggcgattgccttacggatgttgtcgtagatgcggcggccctcttcgcaggcttcgatgatcgtcgcgaagttgtcgtcggccagaaccatgtcagccacgttcttggtgacgtcggtacccgtgatacccatgccgataccgatatcagcacgcttgatggaaggagcgtcgttgacgccgtcgccggtcattgcgacgaccttatccttctttctccaggtgttgacgatacggctcttgtgctcaggctggacacgcgcgtagacggagtatttctcgatgttgttgtagaatgcctcatcgctcatcttgtcgagctcagcaccggtgatggcctcagagcggtgcttgatgatgccgagttccttagcgattgcaactgcggtatcgatgtggtcgccggtgatcataacgacacgcataccggcgtggtgagcctcagccactgcgtctttgacctcaggtctgatcgggtcgatcatacccgcaaggcccagaaagaccatatcgcgctcgagggcttcaggggaaaagtcagtcggtttgttgtgatggtagttgacacgtgcacctgcgatgacacgcagcgcctggtcggccatacccttgttggcctccatgatgcgctttctccactcgtcggtaaggggcacatcccctgcctgcgtatggaccttcgtgcagtgtgccaggattacgtccggggcgcccttggtgtgctggatgtagttaccgtccggcgccgcattgacgacggacatcatctttcttgaagaatcaaatggggcctcaccgatacggggattcgccgcgttcaggtcgcccgtggtgaagccgagcttggcggcatccgcaaccagtgcggcctcagtcggctcaccgatcgctttgtgtccctcgacgtcccaggttgcatcagagcacattgccatgcagcgcatcaggcgatcctgatcctcagtgaagtgacggacaaccgtcatcttattctgggtcagggtaccggtcttatcagagcagatgatctgggtgcagcccaaggtctcgactgcggagagcttacggataattgcgttgtgctggctcatcttcgtgacaccaatggaaagcacgatcgtcacgacggctaccaagccttcaggaatggcggcgacggccaaagacacggcgatcataaaggtgttgaggacgagctgcaggttattgaagaagcccatgccgtgctttatccaggtgataacgaagacgagcgcgcagacgacgatgcacagaaccgacaggatctttgagagctccgccagcttcttctgaagtggggtcgtctcattctcagcctcattcagggcgtcagcgatcttgcccatctcggtattcatgccggtagcgacaaccacggccttgccacggccatagacgaccgtggagcccatatagcacatgttcttgcggtcagcaaggggcacgtcgtccacatctttagccagctgcatctcagccacggctttctccaccggcaccgattcgccggtcagcgctgactcgtcgatcttcatcgacacattctcaatgacgcggcaatctgccgggactgcatcgccggcttcgaggttgacgatatcgccgacgaccagctgcgaggaaggaacctccaacactgaaccgtcacgcacgacttttgattgagccgccgacatctcctgcagggctttcagggcctcttctgcacgggtctcctgcacgacgcccaaaatagagttcaccacgacgacgaagacgatgatgacaacgtcggcaaagtcgccgtctcccgaagcgacgctcgtgagcgccgagatgatggccgcgacgatcagcatgatgatcatcgggtctgccatctgttggaagaaccggatccagcctggagtcttcttcgcttcggcaagtttgtttagaccgttttggtcgagacgtctccgagcttctttttcgctcagaccgtttgtggtatcacttttgacagcttgcaccacatcttcggatttttgcagatactctttcaatttgtattcctcctggggttgtctcgtgcgccagtagattgatgcccgatcataattccccaggagttggggcaagggcccatcaaggttgccatacatggcgcaatctacctaactcgattcttatagtaacaaaaataaagaatatttcgatactgtgagctccgattacgccagtctctgctcaaggcgttcaaatgtgaaacactcgccaccccactcacgctgtttcaacccctgccgttacagtgcgcgatgccgtccccacgctcagaccgacaagcattttgagacagccatatgtgtatgagaggaactcagcgatatccaagcaagatgaaacccacaattagataagccaaattgtttgcaaccctagcaatttgtttgaattccaaccgttaagacggtttttcttgcagatcacagaggaattgcacaacaggcaagaaaaatcgttcagagggactaataattttaagatgacggtgacaaatgccaagttttcaagctactatttggataaaccgtttcggttaggttacaggtaggaatatcaccggatttcggtgacgaccaatgtgttggaggaacactatgaaattcctgttttacgaaaccaagagctatgacagagattcctttacgaaagtgttaccggactatcctgatgtccaatgcgacttcatcagagcaaacctcgatcctatgaccgccggtttggctaaagggtatgacggtgtctgcgccttcgtaaacgctgatgtgtccgctctaacgctcgaggcgctcgctggcctgaacgtaaagctcgtccttatgcgctgtgccggcttcgatgcggtcaacgtacctatggcaaagaagctcggcatgactgtcgtccgcgttccagcctattcaccgcaggcgatcgcagagcacgcaatgggcttggctctgtgcgctaaccgtcacatccacaagggttacatccgtgttcgcgaaaacaacttctcccttgagggcctcgtcggtgagaacttctatcacaagactgccggcatcatcggcaccggccgtatcggtgccgcattggcccatatctgcaagggcttcagcatgcacgtcctgggcgctgacctctacccgaaccagaagctcattgacgagggcattgtcgatgagtacgtcgactacgacgagctctatcaacgcgctgacttcatctccctgcatgccttcctcaacaaggattcctaccacctgatcaacgacaactccatcgcagagatgaaggacggtgtcgtcttcgttaacaccgctcgtggtgcacttgttgatacgaacgctctgattcgtggcatccgttctggaaaactcggcgctgtgggcctcgatgtctacgaggaagagaacgcaaacgtctacaaggaccgtgagtccgacattctgcgtcactctgtaaccgcacgtctctgctccttcccgaacgttgttatgacctcacatcaggccttcttcaccaaggaagcactcgagcagattgcaaagtgcacgattgagaacgctgagcactacacgaagcacgaggactacatcccgaagagcgtcgttaccgctcctggcgtcgattagtcttacagattcgaaggcttgtacatctccgcccacagcgtcaccgctgtgggcggtttttatttaacgtttacgacacaattgcgctcgtttgcataatctgcatacatatatccacgtaaaagacccattgtgtggtagcgtggtcgtaagcgacacacatatgaccccagactttttgttgcctttcgtttcttctgaacctcttttttcttaccttcacgaatcaaattagtataatgctcatcggttatggacgcggaactgccaacaatgcaaacaaagggatatcaaagggatatcccgtgtttttatagcctggcccatgccaagacaaggagagtaagacatgcagaagcggacgaagatcgtttgcaccatgggacctgcaacggacgacgacaaggtactggagcagctcatcctcaacggtatgaatgtcgcacggtttaacttcagccatggcacacatgagtatcaccgtaagaatattgagcgcgttcgcgcaatgtcaaagaagcttggcatccctgttgccattatgctcgacaccaaaggccctgagatccgtaccggcctgctgaaggatcacaagcccatccaattcaacgtcggtgagcacaccacggtcacaaccgacaacacgatcgtgggcacccacgacctcatctcgctggactacaagaatctggcccacgaggtcaagccaggcactaagcttctgatcgacgacggactcatcggcctcaaggtcgagtccgtcgagggcgaagaggtccactgcgtcgtcgagtctggcggcgagttgggtgagcgcaagggtgtcaacgtcccaaacctcttcctcaacctcccctccgtcaccgagcaggaccgctctgatatcaccttcggctgcaagctcggtatcgacgcaatcgctgcctccttcatccgcgatgcgaacgccgtcaaggagatccgccagatctgctatgagaacggccagcgccacatcgacatcttcccaaagatcgagagtgccctgggtgtcaaaaacttcgacgagatcctcgcagcttccaacggatgcatggtcgcccgtggtgacctgggcgtcgaggttccgaccgaaaaagtcccacacatccagaagaccattatcagaaagtgcaacctagtctataagccggtcatcaccgcaacccagatgcttgactccatgatcagaaacccacgcccgacccgcgctgaagccaacgatgtcgcaaacgccgtctatgacggcaccgactgcgtcatgctctccggtgagaccgcagcaggccactatccagttgaggctgtgaagacaatggcatcaatctgcatggagaccgagaagtacctgcagcagcgtgagacctaccacgagcgtgaaggcctacgcaacgtaaacagctccatcggattcgccgctgtcacgaccgcgcagcgcgtcaacgccaagtgcatcatcgctccgacacactctggcagaaccgcacgcctgatctcaaacttccgtccgcatcttccgatcatcgcgctgtccccctctgaccacacaatccgcaagtgctgcttctattggggtgttgaggcaattaagtccgtcgagcagggttcgctctccgcgacgctctatgaatccctcgatgtcactaaggagcacaagttcatcgactcgggcgacattgtcgtgctgaccgcaggcgatcctcagacctcaccgtcacagggcgactatatcacgtctactaacatgttgatggtggcacaggtccaatagattcctgagcatcacagctcgtaaggcatacaaggctccagctctca

SEQ ID NO: 411 - DNA, 2811 bp, Unknown
  Metagenome-assembled genome
actcatccttgaacgtgatcttcgtggtatcgatcagtgtgaccttctcatccaggatcaggtacgcattgtacgtgatgcccttctcagtcttgaaaccgtggaagctccgagcattccaatcaagggcccctacccagtacacatcgggtttaatttgtactgcactcagcatttccatcatcctagttctctttggttacgcttatggttcaccatccccaggagttgtcgcgcatgtgccttagggatacatcacattctattgtacccaattgatcccttgtctcatagatagtaacaattctcaaagagcccacaactttctgtgttgtaggctctgatacgtgcttttcagttgctatctgacgccagcggctctgcgcgcttcgtactcctcgtgcagcttctcctgtacgtcgtgaggtacctgctcatagccttcgatctccatcgtgaactcgcgggactttgacacttagccgacaatcatcgaactaattcaagccacaaatttctggatctacctgggatttgtggcttttcttatacgtcggtttatggtagacgtatctgtggtatttggtggcagttacatgtggattgggtaaagatatgaaggttcagctaacaaggaccaagaccaatgagaccttctatatagccaagacctatcgggacaggaggaccggcagatccacctcaaagatcgtaaggagacttgggaccagatccgagattgaggggatgctccccccgggcacggacgtgatgggctgggccagggaagaggcaaggcggatgacagagcaggagcgcgggctcacccgcaaggtcacggtgtcctatgaccctgcgaggcagatagctccggacgagaggcgcgcctccaacgtgggctacctcttcctgcaggacatctactccgcactcggactggacgggatctgccgggacatcgcctcccggagcagggcgggatacgacctggactcgatactctccaggctcgtgtatggacggatccttaagccctcatccaaaagggccacctccgaattcgccaaggagctcctcgagcagcctgccttcgatgcccatcaggtctagcgggccctctcgggtgttgcaaagcattccggggagatccaaaggagggtcttcgagaacagcaggaagatgctcagccgccgcctgaagacgatgtattgcgactgcacgaactactacttcgagatcagcgaggaggacgacttcagaaggtatggcccctccaaggagcaccggcccaaccaatcgttggcatggggctcatgatggacaaagacggccttcccgtggcctttgacctctacccaggcaacgagtccgagcagcccaccctcatcccttaggaggagaggctcgaaggcgagttcggcctctcgaagttcatcgtctgtacggacgccggtctctcgagcgtggccaaccgcgcccacaacagcaaaggcagcctccagttcgtcaccacggtctgcctcaggggccagaggaaggaggtcaaggactgggtgcgcggccctaagggctggtcgtgcacaggcgaggcgggcacgttcgacctcgaccaggtccggaaggcggcagtggaccccctcacgcccgagaagacgcgccgggccctcttcgctaggaccttctacaagacaatgtggacgtccctgaaggaccctgcgaccggagaggagctggggcagaacctgatcgtcaccttctccctcaggtaccgcgcctaccagagctccatcaggaaggcgcaggtggagcgggcgcgcagggcctgcgaggacgggacggccaagaggcagcgcaaggggcccaaggaccccatgcgcttcgtctcctccacctccgtgaccgaggagggcgaagtcgccgagaggtgcatcctctccatcgacgataggaaggtcgaggaggaggcctcctgggacggcttctacggcctggctacctcgctcgacgacgaggatgtcctgggcatcgtgaagctcgccgccggacgctggcaggtcgaggagtgcttccgcatcatgaagggcgagtttgaggcccgtcccgtctccctctcgcgcagggaccgcatcgaggcccacttcctcacctgctttttggcgcttctcatctaccggattctcgagaagaggctgggcggcaggttcagctgccttgtgatcgtcgacaccttaagaggcatgcagatggaggaggttacaggcgagggctggcgcccccctctacatgaggaccgaggtaaccgatgcgctccatgatgccttcggcttcaggaccgacttcgaaatcgttcctgtgcggcagatgaacaagatcgtcaggaagacccaccggaagggcccgattaccacaaagaaggaggctggcaaggatatcaaatagctatctctaccagaccttatgtgcaagctatgtagggttaagtgtcaaagaccggattgtacccaattgatcccttgtctcatagatagtaacaattctcaaagagcctacaactttctgtgttgtaggctctgatacgtgcttttcagttgctatctgacgccagcggctctgcgcgcttcgtactcctcgtgcagcttctcctgtacgtcgtgaggtacctgctcatagccttcgatctccatcgtgaactcgccggtaccacgggagagagaacgcaggcgcgtcgcgtaatccacaacttccgcatacggcacggtcgccgcgatggtcgtcatcccctgctgcttgctgtcggcggcttccatgcct

SEQ ID NO: 412 - DNA, 21852 bp, Unknown
  Metagenome-assembled genome
cccgcccgcgcgggcgctaggcgcgatccgatgaaacgcgaaccaggcgttcgggagaccgatgcgagacctggagctgtccctggcaacggggacatgcaagctagaacaaactagcttgctacggtgagagacatcaggaggaacgaaatgaagagcgaatatactccggacaatacgattgtcgtggcaaccggaaacccccataaggtcgctgagatcgaggcgattctgggcccgatcctggccgacaaacactttgtcgcgctgggggagctgggtgacttcccggaccctgaagagaatgggacgagcttcgacgagaatgccttgatcaaggcacacgccgccctcgatgagactgaatttacccaggcgattgcggatgattcgggtctgtgcgtcgacgccttagatggtgcgccaggaatcttctctgcccgctgggccggagagcacggtgacgacaaagcgaacaacgagaagctcaagcgtgcgatgcaggaggtacctgacggtaagcgccaggctcactttcactcctcagtggtcttggtgacccgcggtgaggatggggaagaggatctcttcggcgagggcgactgtgttggcacgatcggatacgagtgccgcggtatgcacggctttggctacgatccactctttctaccgacggatgcgccggggaaaactatggcggaactgacaccggaggagaagaacacagtctcccaccgattccacgccctggcggatttggcccagaagctcaaggaataggctaaagagacgggttctcctctcgaactcgacgaaattggtattaaaaagtggaaacttggtttatcgtgttgcttcggatgtgagctctctataatcaaaattgatatgagagacgcccactaatttcgtgagaggggcaatcatgcgcgtcattcgttgcaaggattatcacgatatgagccgcaaggccgccaacattatttccgctcaggtcatcctgaagccggacgcaatcctcggcctggcaaccggttcttccccaattggaacctatcagcagttgatcgattggtacaagaagggggacattgacttctcccaggtccacacctataacctggatgagtaccgtggccttacatatgaggaccctcagtcctatcactactttatgcgcaagaacttctttgactccgtgaaccttgatcttgccaatacccatgtgcctgacggcgcggatcctgacatcgagcatgcctgcacaagctatgacgcaatggtcaaagcggcagggtacgttgacctgcagcttctgggcatcggacgcaacggtcacatcggcttcaatgagccggatgaggtcttcagcaagggcacgcactgcgtcgatttgaccccgagcacgattgaggctaactcccgtctctttgattcccctgatcaggtgccaagacaggcttatacgatgggcatccagacgattatgcatgcccgtcgcatcatcctggttgcctccggcactgagaaggctcaggcggtcaaggatatgatttacggtccggtgacgccgaaggtaccggcctcaatcctgcagcttcacactaactgcaccgtcgtcgcagatgctgcggcactgtccctgtgccccaatagctaagtttcttctgcgtataaggatttgatctcacacagtggattcaactcccaggttccgaatgcaagcctgggaattttctactgcagaagccaggtagcctctctcttgacgcaatgagttaaaaaagccaatctcacgttcaacgtgggattggccctgagatccgaggacagtctgaagacctattcgtagggttagtcaacagagacgatcgtgaggtccttcggataggaattgagtacctcgcaaccatggtcagtgacgaggactagatcctcgattctgacaccgaaacggccggggatgtagatgcccggctcaatcgaaaagatctggcccgactcaaccggatcagtgtgagtggaggacacatcccctggctcatggtcggaaaggccgatctggtgccctaaacgatgcgtaaagtactgtccatacccggcatcggaaataatagagcgggcacaatcgtctagttcagcgaaggtgacgcccggcgccactaaactctctgcagcctcatttgctctgcgtacggtctcataggccttctcttgctcatccatcggttcggcggtaaagaaggtgcgggtcatatcggagcagtacatatccttcttgcagccgacatcgaagagtaccatatcgccgggcttgagcttgatatcatctggcatatgatgggggtcagcgctattggctccaaagctcacaatcggactgaaggagtggttctgtgcgccgagtgagcgataggtccctaagagcccctcagcgatctcctgctcggccacgccgatgcgaatctggccctgcagccagcccatcgcttgatcgttgatgcgggaggcttcacgcatcaagtcccgctcttccttatccttgtgggatcgtgtgtcatctacggcgaaggaagcgaggatgaactgctttgcgacgtggttgttgatcaacggcagcgtccagcgggctggaaacattttatccaaacccaaggtctcatccctgtgtatgtgctttaccacggcgggcagcgggttgtccgtatcatcgtgaacctcgatgcggtcgcagtactgctcagctgaagggaacagcttgttgacaaagagagtgcagtcatcggggctgatatagagggccaaaaagcgctcataaggctcagcgtagtagcccgtaaggtaaaagatcgacagtgggtcggcgatgatggcctgccggcaaccctttgttgcaaggttgtcgagtacgcgttgaacacgattctgatacatagtgttccttcctctgcagagccaggtagtttctctgccgccgtaactatatacccgttgcagcggggtcctactttgtgcataagaacctttaaaatctcctataaatatggagaaatagtgggtaggtgtaaactaacaatttgtgaaaaaatcaaacttttagatagagctcactcgcactcaaggaggtcgctatggatatcgacatgccgccaatcaatcgtgtcgatcagattcgtgaaaagctagctaccttagaaggcaaacgcatcaaggtacgcgcaaatatgggacgctcacgcatcaacgagggcactggtgtattggtacaggtccatccctcgctgttcgtcgtggaggtcgaagagcgccgcggccgcaagagccgtcagtcctaccagtacgttgacattctgaccggcagcgtagaggtctttgatgcagataccggtgagaaactgttcaactactctgccgaagaataaaccgctgtgaagggtaccccggaagctgtgtagcgacttcaggggtatttttcttctgcctgcacttcgaagggccctctgatgagaaacctgtttgcccctgcaaaaatcaacctctatctcggcgtccacaccgagcgcgatgagcgtggctatcaccgtgtcgattcagtaatgacaacactggatttcggtgatgagataactatcgagccgtcagattcgctgacgcttaagttcaacccggcgatccaggccgccactgagaaaacgacaacctatcggacggttgaggcgttggggaaggccttccagcgtccgaccaatttcgagattcacgtgaagcgcgggatccccgagcgcagcggtttgggcggctcttccaccgatgctggggcagtattgaaggcaatctgtatgggctggggtattggcccgcttgatccccgtgtagttaaagttgcgcagcgtgtaggcgcggatatccccttcttcctaagcccacacacgagctatctggcagggacaggggataccttagtagagcagtttgaggcgccgaaactttcggtcgtggtagtgaggccaccgatccatggatcccctgcgcaggaagcctatcaggagtttgatcggcgccctgagaaagccggggatctcgaagtgatgctcgaagcgctgcgcgcgcatgacacggcacggattatggagaacatctcaaataatctgcagacggcgtgtgagcggctggaaccggaccttgcagcggtcgtggtgtggctcaatcaacaggaaggtgcagtcagtgccgcagtcagcggatcaggtgcctgttgctttgctctttgtgagaaagatgaaatggcaaaagagattgctgataaagcgcacaaagttcagcattggtggtcaaaatctgctaaagtagtcgacgcagacagttttggaataggatgtctgtcataacgggttgtggctcagcttggtagagcgctcggttcgggaccgagaggtcgctggttcaaatccagtcaacccgaccagaaatgtttgaagccagaggcgttgagcctctggcttttgttttatacataagcactacccaaaatatgaggggaaatacgcgtatatcaggtgctcaaagatctaaggctcaatgctgtatagtccgctacggcctcgcagatagatacgtaatgctctcgtgggtgaaataaaacatagggcgaccattgactgctgtaaggctcactgtcaacgcttaaacctctatgtgcctatacgctctgatggagcatgtagacggccttttattagactctgttagaccactgtgggtatagggaagcgaaaagatgtcacggggtcaccctacaatcgggttcgaccaagaaaccgacctaaagaaggccccgcatgctcgacacgatacgacaactagcaaagtagctgacccgcaaggagaaggtcgcacttatcgccgacctcaagcgcatgatagccgagaagctaacatcgcagaccgacaagtccgccacatgtctgcgctgcggatgctcgcagttcaccaggcgcgagtgcgacggcgtctaccacaccacccagagaggctacgtaggtatgccgattgcgtttcctaagtaactgggagcaggcaacatgacctcatatccacagtggtctaacagagtcttttattatgacaaggccttacccgaagccatacttgcggcattacaatcatgggagagtgtacacgatagatggggatgggtagtgacatgcaagagggcaaaaccgtaagcagtttgatgctggcaaattatgatacgttgactgcttccgaaaagcgtattgcggattatatgttgcaccatacggccgaggccaccacgctcaatgcctcagagatcgccgagcgctgctccacgtcgaatacgacggtcacgcgcttcgtcaaagagctgggctttgaaagcttctcacagctccgtttgaatctcgcccgtgagacggcccgtgaaaccgtaccgcagagcgatgatgtgtcgtttagcagctttgaaagttcggtcagactggtgctgcgcaacaaaattgccgagctgaacgaaactgtcgtaaacctcgacgtcgatgccttaaaagatgctgtccaggttatcgtgcattccgataacgtgttggttgcaggcgtcggcacttcgctttcctttgctcagatgtttgccctcaaactctcacacgtgggggttaaggcggtttctagtgctagcatcgacgcggagatggttttggcgcagctctactccacagaagactgcatcatcttcgtctccaattccggaagttctcgtcggctcagtaccctgatgggtattgctcaggatgcttcgatcaagaccatcgctattaccggaaacggggagtccccgatcgcacaagcagcggatatctccatctctgtcgtgagacgtgaccgtatgcttacccctgattttgattcttcccacaatgcgcttaacttcatcgccgacgtaatcgtgaccttgctcttccatatgaaccaggacgcaagcgaatatatccggctgttccacaagaccttcggcgaggagaagaacgaaatgggtgaggaacagggccagtctgaacagggcgtatccccactccgagtgcaacagggaaatacgagctagccgtccaggcgtgacctatgatggtgcttgcaaagacatgcatccattggaggcaccatggacggctacagccatcttagcatcgcgaagcgcgaggacatcatggtttgctggaagggccatgagggggttagccagatacgagggagctcggacgggacaagtcgaccatatcccacaagatcaggcgcaacggatggcagggactttccggacggccctgccgggcatcgagcgtgcagaggcgtgcagacgtaaagcggctgtgctgcaggccccagactcatggacagcccgcagaggcgctttctggtcgtgcggctcatgcgggcgagcactggtcttcgaaggagatatcagggtgcatctcggaggagcgcccgggccccgggcctcgccgtgagcgacgctagcatctagcgtgctgtatgatcgggatccctcgactgtgagctttcagggcgcaggaaggccacaaggctgctcattcgtcacggcaagcgcagacacagcaagagtggccaaaagcgcacaggcaagctgcgcatcacccacgacatctcgaagcacccggaggaggcatcctccaggagccaaatcggcgactgggagggcgatactgtggcaggaaggcgcctgccttatcacccaggtggatcgcctgagcggatatcttgccagcggcaaggcggccaggaagaccaggaccgcggtcaacgaagccacggagaaggcgtttgccggcgaggtcgtgctgaccgtcacgctcgacaggggcaaggagttcttagatgcagaagggctccaggaggcactgggggctcccgtatacttctgccatacccaccatctttgggagagggggaccaacgggtcgtgtcggaattgacgctcctatgctgtgtcaagccattttcaggttcgctaacttgctcttcatgaatgcggagtacctatcgcgaatctcgtaatgcttgctggccgcgcgctcgatcttacttatgcggatgtggtcggtgccgagtgcggcggcgacctcttcctgcgtcatcgcggcttcggcccttttcgccctgagcgacctttcgtcctcgtgggttttagccgtcgggttcatcagcgcgcagcagacttcccgggcgatgtatctcttgaggcatctgattgcctcgcgcttcgatgtgccctcggccatccgcttcgcgacatactcctgcgtgcacccatcgtacttcatccggttgagggcgatggtgtgcagggccctgttggcctgcctgttacctccccggttgagcctgtgcctgacgatcttgtcgctcgacgcctctatcggcaaggcgccgcaaagcgaggcgagtgccgcttttaagcgaagcctttcggggttgtcgcccgcggcgttgccgagcgccgcagccgtcgatctccagcagggccggcgcgttgtcgcgcaccaggtcggatatgagcgcctcgagctcgtcggcctgttgcttggagtcgatccacatcttcgcgagaacatggagcgaagtgtgcagcgcatccgtgacggcactgccggttgcggaccttttcctggcgagcgacttcatcatcgctaaaacgctcatcttttcgtacttcgaccttatgggctccggcgcggtgttgtccagggacttcgcggcgctggatgctgccgtcgaggtccttacgcatagctctcttaagtccagcagcgccctgacggcttcggaccacccatccctcgactttaggacacaggtgccgtgccccgccgccgcgttccgcgtctatggcgtcgtttttgctggagcccctgcgcctcttgtcgtacttgggccacagaacctccatgacagtgtagccgcgctcacgcaggtaagagcagatcccagcgccgtataaggctgtaccctcgataccgacaagcgcgcagcggccggcgtcgctgatggtgtgggcaagcgatcggtagccggcggcgaacccgccctcgtagacgagcctgccgagcgcgtccagcacacacagcacgtatgcctccttgtgcgtgtcgatgccggcgtaaacgacagacgtgccttccatgcagcctccctgtcttcaccgggcaccccgccagtgggccagacataacactgaaaggggcgctagaatcaggctgttcggcctgctggcagcgcccatgctcctataaggtcatggcgggccttcggaatgcccgtggcagggcgcggcaagtcatttcaaggtcagtcctcgcgacgacgattggtgtatgggccagcgccctgttgcaagctactacgatgggagcatgcgctcccacggtcgactttgcgcgagtgtcggcgcagttgcaactgcgatatcattatcagtgttggtgtaagcgcctgactgcctgaagggcttcccgaaggaaaagaggaggcctgcgtcctagggaaacgatgattaatgcctatgcaggccgcgaaaggccacgtgactggtcctttctggcacatcattgggaattaatcatcgtttccctagaatttggaatcgcaacataacaggtttatggaaaggacgaaggccaaaggacagcatagcaaagcaggccgtgtgcgcggtcgcggcggcagagatgccgaagttcgcagacggatcaatcaacctccaggagctcttctgccagctcgccgagatggtggtaaacgccgtgatggacgctggaggcgaaggagatatgctccgcctgtggcaacagtaggaacgcatagcgtccgaggacgctcaacacctgcgtggaaacactgaacctcaaaatccccaggttcaggggcgcaagcttcttccccgacgacatcctcgagtactaccagaggacggacagggcgctcatagccgccgtgaccgagatgtacgcgatgggcacgagcaccaggaaggtctaaagacaggctctcgaaggaccaggtgagcagcataagccaaaagcctcgatgccgatgtcgaggagctgctgggacgtcccctgaaagaccttgacatgccctacatctggctcgatgccacctacgtgaagtgtagacgggaaggtcatgtctctccacggctatcgtcactaccataggctgcgatgctaacggctggaggcacatcttggggccttgccgtcgtggatagcgagtcgtacggctcctggaaggggttcttggagaagatgcgcgacaggggcgcgggaaggcgtgcagctcgtgacatccgatgcccatgaaggcctcaggcaggcgatatcgaaggtgttcctgggagctgcatggcaaagatgcgccgtccatctcatgaggaactgcatagccgccgcaggctccaggagcctgaagaagagggtggcaaggatcatggagcccgtctttcgtgccaaggacgtcaacctggtgcgcgcccttttccacctcgcggctaagatgcttgagaagtgctgccccaaggcggcagagatctgggaggatgccgaggcggatgccctcgcctacctggacttccctgtatcccactggaagcgcctgcgcaccaacaacctacaggagcgcaccaaccacaagatcaagcgtcgcacgaaggtcgtgcaggtgttcccctcacagaagtcgctcatgaggctcgtgggatcggtcctcgcagagcaggacgagatatgggcaggcgagcgctacttctctgagaaggtcattgcagagctcttcgagaagcgcagaccttctctgcctcccacgccgtagaggctggcagagctcagggagctctccaggaagtattacgagattcgcgataggtactccgcattcatgaagagcaagttagcgaacctgaaaatggcttgacacagtataggagcgtcaattccgacacgaccgaccaacgagaacgccaacggccttctcagggactggttttcgaagggcaagagccacgacgatgtcgacgaagacgaagcgcagaggacatacgattcactcaaccaaagatcgcgcaagcgtccgaaatggaagtatccctgggaggtctatcatcaccagtcgttgcacttgctctgaggattcgccgctgtttacccggtgttcatcagaatttatgtaaatattagtgaataaaaataaataccgcaaaacgaatatttatagaaaatcattaacgttcacactactctgtacttagacagcgattctcggactaaggggtgtgtgatggatacaatacctgaaaattgctatgctgcaattgatctcggagcttcaagtggacgtgtgctcctaggctggcttgatcaagacatgctgaagctccaagaggttcatcgctttgataacctgcagcagcaattgcatgggcaccactgttggaatatcgatgggctcttttctgagatcgtgaaagggcttgccctctgcaaatccaagtacggagtagtgccaaagagtatcggtatcgacacctggggcgttgactttgtccttttggataaggacgaccacatgctcggtgatgcggtggcctatcgcgactccagaaccgatggtatctatccggtagccgatgcgatcatgtccgcctccgaagtctatgcgcgcaccggtatccagcgccagaccttcaacacgctctatcaactgttagcgctgtcaaaggagcatccagaacagctcgagcaagcctcgacgttcctgatgatcccggattacctgaacttccttctgaccggcgtcaagctcaatgagtataccgacgcttctaccacgggcatgctcgacgcccgcaccggtgattgggataaggaccttatctcccagttcggtatccccaccgacatctttcagattccgtctatgccaagcaccgtcgttggagcgcttaccgacgatgttgcaagcgacgtcggctaccaaactactgttgttctgcctgctacacatgacactggatctgcgttcttggcggtacctgcccgtgatgagaaagccgtgttcctgtcttctgggacctggtcgctgatgggcgttgagaataaagagcctatcacgaccgagcaggcgcgcggcctgaacttcaccaatgagggtgggtatgagcgcagataccgcttcctgaagaacatcatgggcctctggatgatccagagcatccgccgtgaactcaacggtgtgatctatgtccaagccggagacgaaaaggctcccaagatagcgccgcagcatacctatggcttcggagagctctccgagatggcacgtcagtctgagagcttcacctctgaggtgaatgtgaacgacgagcgttttctatcaccagactcgatgatcgatgcggtcaagagctggtgcaaggagtacgacgaagccattccttcaacaaccggggagcttctgcaggtggtctaccgttcgcttgcgcatacgtacgcaatgacggtggatgagctgaagcggactaccggtaaggaattcacttcaatcaacatcgtgggcggtggctgccaggatacctatctcgatgagttggcctctaaggcctgcggcatgcccgtctttgcgggaccggtggagggcacgagcctcggcaaccttgaagtgcagatgatccgggctggtgagttcaaagatcttcaagaggcgcgcgattgcgtcgcgcgttcgttcagtgtgagacagattggctagagcagctccgtacaaacagagcttgaaaataggctgcatgcgtgaaaggagaaagtcatggcagatgcagagaaacaagcgtatgagctcgcaaaaggcaagtacgccgagcacggtatcgatgtagaggcagcgatggacaagctttcaaagaaggcaatctccatgcactgctggcagggcgatgacgttatgggctttgaccagccggaaaacgcagcctcaggtggcatcctgacgaccggcaactatccgtaccgcgcccgcaacttcaaggagcttacggaggacttcgagaaggctgcaagcctcatcccaggcaagaaacgcatcaacctgcacgcaagctatgcggtcttcaccgatgagaacccctgggttgaccgtgaccagatcgagtacaagcactttgagccctgggtcagatgggcaaagaagaacggctacggtatcgacttcaatccaaccctcttctcccatccgatggtcaaagaggggctgacggtctcctcaccagagaaagaggtgcgtgacttctggattcgtcactgcatcgcctgcagaaagatcgctgagcgcatcggcgaagagatggacgatatggtcctcaacaacttctggattcccgatggcctgaaggattatccggctgaccgctatggcctccgcaagcgccttaaggattccctggatgagatctactccttcgagactccgcacgtaatcgactccgtcgagcagaaggtcttcggtattggccttgagggcttcacggtcggcgatcaagagttctacgtctcctacgcggcaaagaagggcggcaacattgtgccgctgatcgacctcggccacttcaacccgatggagaatgtccctgagaagctttcctcactggcactgttctttccgtatctggcgctgcacgtcacgcgctcaatgcactgggattccgaccatgtgacgctcttcgacgacacgatgcgtgagctctcctacgagattgctacaattccaggcgcctggggcaagtcccgtatcggtatggacttcttcgacgcctccatcaaccgtgtcggcgcttgggcggtcggtatgagaaccatggagaagagcctgctgtatgcgctgctccagcctgcaaaggaaatgaagcacctgcaggatacctaccagttctctgagaagatgatggtgtatgaggccgccaagacgatgccgttcggtgcggtgtgggacgagtactgccgtcgccagaatgtcccggcagactcggatgtctgggctgaggtcaagaagtacgaggatgaagtgatgtctcagcgctaatgctgattcgagtgtgagaggattttacgatgtcgattgaggagcttgattttgtcaagggcttctgcagaatgtgcgatgacggattcaaacagggctggcatgagcgcaacggtggaaacctcacgtatctgatggattcagacgaggttacagccgcaaagcctgacttcctggagccgcatgggtgggttgatctgggaatgcaggagacgagccttgcgggccgctatttcctgacgaccggttctggcaagtacatgcgcaatgtgcttgaggatcctgcgcacaatatcggcatcgtagagatcaacgattccggcaccgcataccggattgtctggggcctgctcaacggcgcaaagccgaccagtgagttcccgactcactgtatgaaccatgcggccagactggaagtcgatccgtcgaaccgtgtgatctatcactcccataccccgggcatcatcgagatgagcaacttggtcgagcttgacgaccggaccttctcccgtatcctgtggaagatgatgacggagtgcgtcgtggtcttcccgcagggcgtcggcgtggtgccctggatggtaccaggtggcgtcgatatcgcgaaagccacgagcaagctgatgaagaaatatcccgctgccgtgtgggcacagcatggcctcttcgcctccggccctgactttgatactgccttcggcctggcgcatacgatcgaaaaggcggcagagctctacatcgcttcccgtgctgcaaacggtggatcggataagttcctgaacacgatcaccgatcagaacttgaaggacacttgccgtgacttccacgtccagatcaatcaggactttgtcgactgcagataacgacatagatgagccagacgtaagaatctgatcgcagggcctatatgcatcaaagcacataggccctgtaccttaatagctaatctagccgtcaagtatatgagggctgatgcaagccggccggctagcccaggtgatacaactttccatgccaaagggagctgtgccctggaacctaccccggcgctttgtctggtgacagcctcttaggctagccttcaaggagaagtggaaccgtcaggatccatggtacgcaaaagtcccttccacaccctcagtgccaaaggctgaagataccaagatctgccgacctaagaaggccacagctgagtgttgctgctgtaagcacataggctttgctaccttcgctaagctaagtgccaagatgggagtgtcttgactgcaggcgcaggtacagctcgcttacagggacagtctttaagcacaccaggcacacaccctgccgaagtaggtatcacccatcaggctcatgcgctacagtgtgccccttaactgcaataggcgaagcgctcagatatcgcatcaaaagcgcctggagatggcggcattgggtctttcgtcctcaaagcagtgcgtctggatcgacaaggcctacatcgctgatgcgcacctctcctgcgccttcgggcaggcaagtaagtgtgccctgtcagcaggttggcacagacgtccacacgagcccctatgccgtagtctgtggccacaaagagccgtccacggaaaggatcagaggactttgcggccactgagcagaaggcacaagcgtcgtgcacgagcgggagtgcgcccacagcggggtcatacgcgatgccggagccatctttgaatcatacaaggccgacgtgcgcgatccaaacatggagctcgctaacaacctctgctcctggctcaagagatacctctggcgcttcacgggcatgtctcatggccaacatacaaaaagctacctcaactggtacgtctatctgttcggtgtcaaccaggtaagcgacaggtgacccgagactgcaagggtggtgcgccatatgatgatgtccgatgcaagtctccgcagctcgacataggtctggcggcccttatttacttgattgttagatcttgatacatctgatactccaatcttcgagtcagatgtacggattttttaggctcttcgctacttatggtgggtagcatatctgcatccccttgaacacgtggcgcccggacggaagggttttgccggcggaagacttcggtccaaaggtgcgatatggatgttcaggcagggatgctggcaaggctctttaagaagtcccatgggactcagcaacgaatgagagctcttcggtgtctggtttaaggagcgcgagggagcgtaagataagctccatgtgagggtggcgcatgccaggggccaggcggtggagtgccccgtatgccacaggatgtgcggcacctgtgacacgtgcgagaggaccttgtggcatcttagcatctggcaatacgatacgatcgtgcactgcgcgctgcccagggccgactgtcccaaggacggcgtgcatgccacaaggataccctgaaagatgcggccgaagacgcacttcacagcgctctttaaggcgcaggtgataagtgatagcgctctttggcatgagcgtgacggcaatagcgcagcagctgcacgagacagcccacgcgcatatggtgcctactaggcaaggtggtatcgcaggcaagggatgccgccgactattccggtgtcgtgtgcgtagggatagacgacactgccaaaaggcgcaaccaaagctacatcggcatcatggcagacctcgacggccagcgcgccgtggccgtcacgcagggcagggacaagggcgccttaggcaggctctgcgacgagcttaaggagcacgcaggggaccgcacgaaggtcttagaggtcacgcgcgacatggcttaaggcatactcgcttggcgtagctgcagagatgccccaggccgctcagagcgtggacaggttccatgtggtgcagcttttgatgagggcgacagaccctgtgaggtgccaggagaggcgcgagtccgcgaagaagcacaaggcagcttgcccagacgaagtacctgtggctgaagaagaaggagtcgctcacaaagcgccagctcgcgaagagggaggagctcgaccccgccagggcccatctcagaactgcaagggcttgccagatgggagaggcgctgcaggacgtgtactcataccccgacagggaatcggcggcagcagccccagagcgcctctgctcgtggatgatgcactctgccgtggccgagatgaagagcgtggcgaggaccctcaggaaggagcgggaggggatcctcaactggtggaagaggggatccaccaactcctttctggaaggtctcaactcggtcgtgcagtcggtccgcagcgctgccaggggcttcaggagcattgcctacttcaggacgatgatcttcctcaggctaggccgtctggacttcacagcccagaagaagctcgcatgcgctacccactagaaacagcgaagagcctcaatttagcacggagattaatgccaaactacagagcaacattaccactatgttggcatttgtatgggtacactattgcatatgtaaagcattatgctctatttgggggtgagaatatggcgtctacagtaatggtaaatatccgtatggacccagagaccaaaaagggtatggaagagacttgccgtgatctgggcatgagcatgaccacagcgttcgtgatctatgcgagaaaggtggcacgtgagcaccgcatcccttttgaggtatcggtagatcccttctactcggatgagaaccaggcacaccttcgccaggcaaaggcagacctcgatgcaggtcacagcatcgtccatgaactggcagcagacgatggcgctgaataaagtctgggccccagaagcctgggatgactacatatggtggcagacgcaggacaagaagacgctcaagcggataaacgctctcgtgaaggatatcgaacgcaatggcgtgtcctcgggcacaggaaagcctgaacagctacgaggcgatctttcttggttctggtcaagacgcatcgactcacaaaaccgcctggtctatcgcgtcgtcggcgctaatcttgagattgcccagtgccgttcgcactacggagatcactaagcaaatcatttttgcgatggtctcgtatccagataaaaccttattgagctaatccgtatcgggcgccttcttgagctgttagtcagaagccggaaatttgcgaaagcgtggcatcgatggcaccaagcgcctcgtcaaccaggagcgacacgtagacgtggtagactagtatcaattgtggcgtgtgacttcggcccacacctggaagagcccgatgtgtcgggctcttcttatatcaaggcagcttacatgaatgcatgacatgacaaggcccagcccggacatatgccggactgagcctcttgatgcttctatgagctgctctgtgctatccctctgcggcacggccgcgacggaaggcttcgatgttcgcctcaatcgttttgggggcacgcagcgcctgatggcagactcccatgcttccccgtcgaagggaaacgttgtggaaagggcaccgacaagcacgacattggtcgatttcggccccccctgctgcacgtgcgatgacgccagcattggtcttcttggctcccagagcatcgagccttgcttccacatcgtccggcatcttgaacgtgccgatgaccacagagaccagcacgattgtctcgtcattcacgatcacggtgccgccctccttcaagtactgccaggcacgaagtacctctattgcctcgacagcatcgattgcatcagcgcagcctggatctgcgaccatcgagtccacatggcttcccacgcggatgaccgtggagacggagccgcctctctggctcatgccgtgaatctcggagatcttcacgtcgagatcagcctctgctgctgtcatggccaggatattgcctgccaggatcgtgccctggccgccgacaccgacgagcaggacggtacgggtgccttcaagctctacctgcttgccggtaagctcgacagaggagctcttggtagatgctgttgcgtgcggcatagctactctcctcatatattctttctgccacttctcgcgcagtggccgcgctcttttcctgtagatgtgaatatgggataaagggcgtgcatggatcgcagggtgcttggcgtgttctgctggagtttggctcgagcagaagctggcgcctttggcccgcagctggacgcgaattaggcaggatgtcgttaggcgatggatgtccctatgaggttgcgcctgcaaagaccagaggaaaaccttagcccctcagtcaagtaagaggtaggaggtagctgcatggtatatatcggcatagacatcgctaagcgcttctatgtgctgtcagccgtgagtgaggatggagggaccctcatcgagtcgctcagatttgccaacaccgccggcaggcttcaaaaagctgctcgatcggctgaagaaggccggtatcggtccagagggcagcctgtctagtatgcaggccacggggcactactgggttgccctgtttaacttcatggccgcttatggctatgacgctgcacacgctcaagaccgatgcgatcgacgcagccatgatcgcagaccttatgcgctacaatcgctatgagccctgcgcgctgggcgagcggggagctgcgaagcttgggcgcgctaccgcgcgtcgcttgccgaagcgctcgatcatgctcaaaaaccgcgccacagccatcctcgacggcctgttcagcggctcgtttaggcccacctagggaaacgatgattaattcgcctcgatgaggtcgctggggctgcacgctgtatgccgccggtttaaaatgtctcgaaccacgcagtacccatacccacataaatgcctatctgcctgcggatatgttataattacagcaacgtattccagcatatccaaaaggaagatatgggcagccagatgagcttttaggaccttaaatcctaaggtctaaggagaaagactgggcgagaggcactcctggagcggatggatgcgatcgttgtgtgggatagctggattgttctggtagataccagctaccactgacaggctcttgtcaggcatgcgcgcgctgcaaagacgatgcttaggatgtatctgctgcaggtcatgtttgggctctcagacgagggaacttaaagatgctatcctggattgtcggtcctggcagcgcttcatgcacttagacctcatgtctgagcaggtaccagatgctacgacacttgcgaagatgcgccatagcctcgagcggcagggactcggcaaagctatgcttcacgacctgaattcagaactcgagaaggcagggatcacggcgcggggcggctctattgtggacgcgaccttcacctgggcccttaagcttcacgaagaacaaggaccatgcgcgcgacccttaaggcgcaccagtccaagaagggggggggagcctggcgtatcggatacaaggcgcatatcggcgtggatgccgcaggtggccttgtgcatggtgtggagacgatcgcttagaatgtatctgacatatcctatggcacacacactcgtaagggaagatgacaggttctgctgcgcagactttaggctatataggtatagcgaagcgcccttaaggacgcataaagacccacacctctcatctatgcgctaaagcgttgctaaggaagccttcgactagagagggtcttgcctgtgtgctctttaccgaaaagggcatcgagtccaggaaggcatccggccgctcaaaggtagagcatcccttccttatcgtgaagcggcgcttcgatccccttaaggaagcgctacagaaggatagagaagatgcctgtacactcgagtctttctcgcccttgcaaaccttacccatgtgcatcttttgccggcaggctgcacctcccggctcccagcgtcgcttgatctgtcttggagccttcttgcggtgcatggggcaggacagatgtaaggatggcggcttctgcacgtgctggatgagtatccttccctgcctttcccgcataccggcctagaaaagtcgtgtggtcggtcccctctaacacgctatgggcattaatcatcgttttcctagctgatgcatagatgttggttccctatacctctagcggtaccgcttaggttctgagggagagaggatcgaaagctcatggggaagcacatcgaccgtgaaccgtgagccgaccaagggttccccatccacttggcaaggaggcttgatccccagaaaatccgcctcaagatgctcaagccgttgcaagtgcacggtgtgggaacgtgcatggcccccgaagcgcgcgaagcagaagagctgcaggaagtgaggaatgttagcatacttcacgttgaagcaggtatcgagcttcccgtcgtcgatgtgtgccttcgggcagatgcggaatcctcctccgtaagtcggaccgttctgcacagcaaagatcaggatggggtagcgatggggaggctgatggtcaatcgatacattgcagacgataccgtttctgccggtggcgatgagacgcagacctgaggtcgcaaacaggtgggcccctctagctgaggtgtgctcttctcgacgcttaatcgtgtccaggccaatcgctgcatcggtgccaaaggagagcgtttcgataaagcaagcgtgctcaccgaagtcggttttcacttcccctaagtcaatcagttttaccgtacttgcatagagttgctgtaaggcgttgatcggcttattgatgtacatgccgatagagcgcgcaaaatcattgccggaacccatagggattaagcctagggcagggcggtgatcacgtggaagttgcatcaaacctgcgacgatctcgtgcacgattccatctccgcccagtgcgatcacactgtcataccttgcggccttcgcgacaagtctttcagcctcatgtgggccttgcgtaagtacgatgtgcggaggcgtgcgctccgtgtgctgatcgaagtactgtcttatagtggtaagcgcttcagcgcccttgccactgtgggcggcggggttagcgatgagaaggctatgttcaaaagtgaatgaaagcataacgctaatggagagtgtgcttcagatctgtggactgtctgaggtgcaaggtcgtaggggtatagatctgctgtttttggccattggggtccgcgatacgtttgacgacgagctttgcagcctctttacccatctcttctgggtcggtctcgtaggttgagatgcccttgccaaaggtggcggaccagtcccaccccatacggcgggcccagccccagtcatcggggccgcacaggcctatagggttggggattgtaaggttcatctcgcggattgcattgtaagtggcgatcatcgttacagtgtttgtggcgaggatgcagcaggtctccagcttcccgctgtctcctttgagcttctctacgagcttcttgagggcgatgcccgcactgttggcatcccaggggtccacgatgtagacatcctccatcggcttcttcacgccgaaagcctcgctgtcgcactgcacaaaagcgttgagtctggtctctcgtggtgagttctcttcgtagggctgggtgaacatcgcgatgtgtcggtagccctcgtcgtgtgcgtgcatcagaaggtc

SEQ ID NO: 413 - DNA, 1033031 bp, Unknown
  Metagenome-assembled genome
cgagctcggagtcgtgaggcccgagcaggcggccttcggacgcgcagcaagggcgctcttgtcatatccggcgacaccatcgccgccttcccggtccgcgacgcacggccaggtcgcggcgtgcacggcgatggtgcctcgagttcggatgatcgccaccgcgtacagggcgcgaaggtcgggcagcgcgtgcttcggcaggcgatggttccccgtgcgaagtcgatcgagggggttcgaactggtcggaatgttggcgttccccgcaaatggggtgcgaggaatgtgctcgctcggcgttcgtggcgacgcggaggacctcgtgttctacggccagaaggggcgcgggaagacccacatggccacgcgcgtcgggatcgccgcgacgtccgcgggctaccccgtgaggtttggcagaggcccagctggtgctgcagctgggcaaggccaagcgcgaggggacgctcgacggctgctcgccgacgtggccaaggcgaggctcctggtcctggacgaattcggctacgtgcccttcggtggaggggcgaggctgtctaccaggtgatatcgagagctacgagaggaggagcgtcatattcaccaccaacgtcgagtcagcaggtggggcaccgtcttcgcgggacacaagctcgcggcggcgatcgtcgaccgcgtcgtgcaccacggcaggccgtggagttcgggggcccgagccacaggctggagagagctgatgatgctcgggaagtcgggaaggtagggaggcgccggcgggcccgtgacgaaacccgaaaaactttcgtgcacggacccgaaagaaatccatgctcaaagtcgaaagtcaggcttgactaaacacaggtttgggagctgggtggccgtgccccggatctgcacgccttggttgcccgtgcctagttgccccggccgtgaccgtcccgctcgcgctgtcggtagcctgtggaaagggaagtgcgatgggctgagaaggaccatagggccaggttttccgggttccagcgccgcctgcccctcctctctcttcgggtgtctagcccgcgcactcgggcatcgtcgcatcccacatggcttagaaagtacggtgcccgcacggatggggagccacgcggcttagaaagtcaggtgcccgaacggatggagagggcgaacgcttagaaagcacggtgcctgcgcgagtggtggggctccgccgcttaaagtttccggtgcccgaatgggttttgcggtcaaatgcttaatcctgccggtgcccggtcggtttggaagggaagaaatccgtacgggtttcggaatctttaagcacggcccccccggcgcctgcgcgggccccgggagtattaagcacccgcacctatcggccgcgtggggccacgcgcttaaagaacctagcccccgtgtctattggccgtccgaatgcttagcaagcctagccctcatgtgagttttaagcgctttactcgcacgaggcctagcatctctaagctttcgggacggaaatccacacgaggcctagtggcgctaagcatcgtggttcggaatttgcatgggggctaggattgctaagcatccggcacggggattcgcatgagggctgggtttgccaagcatggcgccccccaattcgtgcgagcccgggaatctgccggcacatggcttccgccactcacgcgggcagtggcgcggccaagcgtttcgcctgctgatgggcctggacaatggcgcggcttggggccagctcccgtcgcgggacggcagacctgccccgcccctctttgacctatgaaacggcaacctgtgccgtgagatgtcgggggagaaggaccagtgaccagaatgcggccggcgactggctttgcgaacccctatgcctcgcccgtctcgcctgccttggcctttgagccgtgtcgggccgtgccgcgggacggcaccagcaccgtgctgtcgccaaactgcgagatgaggtcttcgagctgcgagatgtagtcctgagccagctcggagagcttgcgctgggagtggaccacgtaccccacgttcatgacctcgtcggtctcgagggggatggagacgattcccgcgaacatctcgtcggacctaacgcccgtggacaccaggaagccgtcgtagtcgcgcagcaggccggtcatggtcgcgcggtcgctcacgatgatctggcggctgttgggcagcgagctcaggggctcctccgagaagtagagcgagctgtccggcccctgctcaaaggtgtaccgcggccagttggcgaggtcctgcgtcctcacgctcttcttggacgcaagcggatggccctcgtgaacgaacacgtgggggcgcgccttgaacagggggacaaagcgcaggctgcactcctccaggcgtcggcgcagggggcgttcgttgcttgtccccaggtagaggatgccgaggtcgctcttgaagctgcgcacgtcctcgatcacgtcggcagtgcgcgtctccctcagggtgaactcctccgagttgccgttgtcgtgctgcgcgacgaagcggatgaacgcgttcacggcaaaggcgtagtgctgcgacgacaccgagagcctctggtgggccctgacctttccgcgctggtacctgtcggcgaggaggtccgcttgctccaccacctggcgcgcatacgagaggaactcgacgccgtcgctcgtgagcgagatgccccggctcgaccggttgaagatggtgatgcccatctcctgctcgagctccttcaccgacacggagagcgatgactgcgacacgaacatgctgtgcgcgacggcgttgatcgagccgctctcggcgatggcgatgacgtagcgcagctgctgaaggcgcatgggggtctcctctgacgggtgtcgaacttccatcgatttaagcgataggagagggacgcgtcaaagggtggcgcgcggggatgaatgggtgcgacaactcagcaaactgctggtagacataccaaaaaacggcatatcgacaccatggataaccaagtatggaaagcgcatatacgcgggcgtgccgccaggatgtggcacccgcggccgtgcgtgcccctaccgtgccagtatgaggttgacccccaggccagcgatggcccctgccgtccggtcgtccaccgagtcgtccagcaccacgttgtccatctgctcgaggccggcaaagcgctccaaggcgacgacccccagcttggaggcgtccgcaaggagcgtgtgctccccggccatggagaggagcctgcggtccagctgggcggctcggacgtccggggcggtgagccccgcctccaggctcacgcccatcgtggacatgaagcacttctgcgcgtggaacgcgtccgccatgagttcggtctggtcgccataggagtactgctgcctgtggctcagctcgccgcccaggacgatcaccgtgaagtcgtcccgcgcgtcgagcgcgagggcgacgttgaggtcgggggtgatgacccgcaggtcgtgcacattggagcgcgcgagcgcacgggcgaaggcgaggacggtcgtccccgtggccagcacgatggtctcctcggagccaaccaggggcagcgcggcgtgggctatgcggcgcttctcggctgcgtacccgcggagctcgggggaggcctcccgcggcatgccgcttgccgggacggctccgccgtaggtgcgcacgaccttgccctccgcctccagcgcggcgaggtccgtgcggatggtcgccgtggtgacgtcgaactgccgcgcaaggtcgttgaccgtgcagcgcgaccgctccctcaccagcgaggcgatcttgcgcctgcgcgtcagggcgctgtccgcatcgcgtaccatcgtgcacctccctcgccatgccgtgcagccagaaggggccgccgggacgtctggtcaccgtacttctccccctcgcgcgtggggtgtatcagacaactcctgatgggacaaaaacagggaccgaacgaccgggggaggggagacgtgcgggtggcttgacggtatctcgccggatggcgcaaaggtccaccgcgggcatgccacggcaggcaacctccatcatcgtgaaagccggctgcatgattgatgggttggggctacgccagcctctgcacgtagcgcacgaaggcgtcgcgcgcccgcgccgtcgggaaggtcgcggtgtacgagtagtcgcacatctcgtccgcgatggcgctggggacgggcccgctcatgcggatggcgtcgccaaacctcgcgcgtatctccccgtcggagtgggcgtagcgatggcccctccgcctcccggcgtacacgcagtagcttgcgtggccggagcggggcaagaggcgcctgtcgtggcacaccatgtcagcccagatctggtacacgtcggtggagtgggcaaagtccatcatgtccggggtgtggcctcccggcggcctgatgttgacctcgagccccacgtagtcgccctcctcgcccagcccgggccgcgactgcgacagcctgaagaactccatgtgcacgaacctgctcctgaggccaaagctcaccgcggcggcacgcccgagcgagcgcagccgcgggtcgaccctcgggcggcaccagtaggccaggtccaggttcctctcggccacgtcggccatcgagggagggaactcctccatgttctcgaacagcgggttagagtgcgagtccaggatcgcgtcgtacgacacgatgtccccgggcacaaactcctcgatcacgtaggggcgccgcggggcgggggagaggaacgcggcaagctccgcctcgtcgcagatcttgcgggcgccgtcggcgcccatgccaaactctggcttggcgaacaggggaaagcccacctcgagcgagaagcgccgtgccgccgcgagggtcgtcacccgctcctgccgggcggacgggatgccggcggcggcgtagaggggcttcatgcacgccttggacctcaggcgcgccacctcctcgacgcccggcccggtcgtcacgttgaagtccgtgcgcaggcgcgcgtcgagctcgagccagtactcgttgttcgactcgatccagtcgaccttgccgtacttgtagctgaagaaggcgaccgccctgaacacggcgtcgtagtcctcgagcgacggggtgtagtagtactcggcgagggagttgcgcaaccgctggtcaagctggtcgtagggggtgtcaccgatccccagcacccgcacaccctgccgccccagccggtcgcagaactgccagtagccgctgggaaactgcggggagacgaagacgaagttcaccctgcctccaaccctcgtggacgtttcagggagaaatcgtagcagtgggaggtagtggcgtggtgggacgttttccccttggacgcgaacgcctgcgagttgggcgccagccttgcgtcttaactgtactaagtgtattaactgtactagtatcactgagtcaataacggaggggagacggatcgccgcctccccggggaagaggggcgtctgggttggagttgctctcgctgcagttcgccatcttcctggtggcgctcctagccgcctactacgcggccggccgcctggtggggcggggccagtgggtcgtgctcctgctggggagcctcgccttctacggcatggccgggacctggaagaccctggcgttcgtcctggtcgccggcatctccacgtgggcggcggcgctcgcgttctcacgcctcgacgccgggctcaaggcgaggctgggggagacgcgcgaccgctccgcccgcaaggaggccaaggcggtggtccgccggcgcaagaggcttgcccttctcgcctgcctcgcgctctgcctggggaccctcgcgtacctcaagtactggaacgtggtgctgttcgagctcggcctggcctcgtcaccccacgggatggggcttctcctgccgctcggcatctcgttctacacgttccaggcgatctcgtacctgatcgacgcctatcgcggcagcctccaggcggagcgcagcctccccaggcacctcatcttcctcctctactttccgcagctgatccaggggcccatcaaccgctacggcgacctggcgccgcagctcttctccccgcatgcgccgcgcgaggtcgacctctcccgcacgctccagctcctgctctttggcatgctcaagaagtacgcgatggcggacctgcttgccggcctgatcacccgcctgctcgccggtgccggtgacggcgccccgggctcgctcgcgatcatggcgatcctcctctactccgcccagcagtacggggacttctccggaggcatagacatggtcgaggccgtctcggagctcctgggcatccatatggcccccaatttccggcgcccgtacctctccacctcgctcgcggacttctggcggcggtggcacatcaccctgggcacctggatgcgcgactacgtgttctacccgctcgccctcacgcgtcccatgcgcgcactcgggaaggtggcgggaaggaggctcggcggccacgttggcaggacgctccccgcgtgcgtggccaacgtcgtggtgttcctcctcgtgggcctgtggcacggcgccgaggtgcactacctggtctggggcctgtacaacggtctggtcatcgcgtcggcagacctgctgcggcccgccttcgaccgcgcgagctccctgctgcggatagaccggtccaccaggggctggcacgcgttcaaggtggtgcgcaccttcgcggtggtcaacgtgggctggtacttcgaccgcatctacgactttggtgccagcctcgcctgtctgcgccagtcggtgctgcatcccgacttcgccgggctcccgcaggcgctcctcgccctgggcatgggcaagtcggagctgctccaggtgctcgtggcgggtgccgtggcgctgctggtcgcctgtgtcagcctgtacgaggagcgtgggggcgacgcgcgcgggtggctctcgcgccgccccgtcgcggtcagggctgccgcctgcgcggccatgtgcctgatggtcgcgctctcgctctcgttcgacgtgggaggggggttcatgtatgccaactactgatccagctacggatgggtcccgccccgaccggcggcagtcgcgcgcgcatcgcatcgccgccgcgctcgtctcgctcgccaccttcgcgggtgcctacctgctcgcactgtggggcctgggagcctacggttcgacgacggcggtcgcctggcacgacttccacgcggcggagaggctcgacaccctggtggtggggtcgtcctttgggcagcagggcatcgaccccgtcaccctcgacgcgcgcctgggtaccaggacggtcaacctcgcgacgcccggccagaccccggacgactccctcgacgccatcaagtgcggcgtgggcgagaagggcgtgcgccacgtgatccttgcggtggggctcgactcgcttggcacgcgccttgacaccaactcgcacgtcgccttcgtgctcggccgctacgagggcgacccgctgggttccgcatcgtcgctcgccgccttcgccctgcgtcccgacgtggtcggcacgcgagactccgtgcgcgccctcttcccctggacctgcctccccacctactcgccccgctcggtcgcgctcaaccttcgcagccgcatcctgggcggggacgtggcacgtgccaccgaggggctcgtgcgcgggtggcactacgtgggcgggggctacggcaactacgaccgaacgatcgcgccgggtgacggccgcacctcgctccaggtgttcggcagcccccacgtggaccgctgcgtgtgggacgagtacgcggcgatctgcgactggtgccgtgagcacgacgtctcgctcacggtcgtcgccacgccccaccccgcctacgacatcgccgcgtttggggacgactacccgcgaatcatgggtgactttcagcggatggtccaggccaggggtgcgacgtacctcgacctcaacctcgcccaccgcgactgctacgacccgcccctctcggacttcgacgacttcgagcacctcaacgcaacgggcgcggagcggctcacgaacgtcctcgcccggctgattggcccgggcggggcgggggagagggacgttgtgctcgggagctacgacgactgggacgtctggcggcgggagcacctgccccaggccggcgatgatgggaggcagtcatgaccaacgtgctcgagtggctcgaggcgaccgcgggcagggtgccggacaaggtcgccgtcgccgaccccgactcgtcgatgaccttcgctgggctgctccacgcgagcagggcggcgggtagctggctcgccagcgaggcgggggtgaagccgcgcacggcggtcgccctctacctggagaagagcgtgccggcgcttgcctgcatgctgggcgcggtgtatgcgggcgggttctactcggtgctcgacccccggcagcccgcggcccgcatccgctccatctgcgcgtcgctccgccccgcggtcgtcctgtgcgacgacgcgacggaggcgggagcccgcgaggccttcgcgggcacgggcgctcgggtggccaggctcgacgagctcctctcgcatcccgtggacgagggggccctccgtcgcgtgcggtcgcaggcgaccgacgtggaccccctctacgtcaacttcaccagtggcagcacgggggtgcccaagggcgtcgtggtcgcgcatcgctcggtgattgacttcatccccaccttcgcgtccacgtttggcatgggggagggcgacgtcttcgccaaccaggcccccttcgacttcgacgtgtcggtcaaggacatctacacctgcctgctcacgggtgcgcgcctgcagcttgtcccccgcgagtacttcagcgtccccacccgcctgatggactaccttgccaactgccacgccacgaccctggtgtgggcggtgagcgccctgtgcttcgtcacgatcatgaacgccctggagtaccgcgtgccgcccgaggtggacaaggtcctgttctcgggcgaggtcatgcctcccaagcagcttgccaaatggcgccgccacctcccggatgcgctctacgccaacctctacgggcccacggaggtcacctgcaactgcacctacttcgtggttggtcgcgactacgggccaggcgagacgatacccatgggaaggcccttccccaacgagcgggtgtttctcctcggtgatgggggcaaggaggtcacgacgccgggcgagacgggcgaggtctgcgtggccggcacggcgctcgcccttggctacctgggcgaccgcgagcgcacggtcgcagcgttcgtgcagaaccccctcaacggccgctgggacgaccgcacctacctcacgggcgacctcgctcgctacgacgaggacggcaacctggtgtacgtctcgcgcagggacaaccaggtcaagctgctgggccacaggatcgagctgggtgaggtcgaggcggaggcgactcgtatcgatggggtcgagcaggcggtctgcctcctcgaccgcaggaggaagcgcctgcgcctcctctatgtgggaaaggcggagcatcgggacgtgacggaggggctccgctcggtgctcccaccgtacatggtccccggaaccacgaggcggctcgaggccatgccgctcaccaagaatgggaaggtcgaccgcgtggcgctgtgcgagggggaggggctgtgatgaccgaggacgagcttctgggcgtggcggagaggttcgggacgcccaccttcgcgttcgacgcggtcgccttcgggcggcgggtcgcactggtgggccaggcgtttgggtcggaagtgagcctgtgctactccatcaaggcaaaccccttcctcgtcccagccgcccgcgatgctgggatgcggctcgaggtctgcagcccgggcgagctcgccatctgcgaggcgctcggcgttccgggggagacgatcgtgtactcgggcgtctgcaagcgcgaggatgacgtccatgaggccctctcgtatggcgtcgggaccttcaccgccgagtcgctggggcagctcgcgctggtggaccgcgtggcgaggtcgtgcggggcccgcgtccccgtgctcctcaggctcaacgccgggagccagtttgggatgtcgcgggcggacctcgtccgtgccgtggacgggagcgactcgcttcccggcgtcgagctggtgggcatccaccacttcgcgggcacgcagcgaaggaggctcgaccaccagcggcgcgacctcgccatgctccaggaccttgcagacgagctggtgcgcgagcacgggtggcgtccctctcgcctggagtacggccccgggctcgccgtgccgtactttgagggggacgacttctccaacacgctcgcgcccgcccgggagctcgcggacgccctgcggcacgccgcctctcgccttgacctcacggttgagatgggccgcttcctcgccagcgagtgcggtagctacgtcacgcaggtcgtcgacctcaaggatgcggacgaccagacgagctacgccctcgtggacggcggcatcaaccacgtggtctacctgggccagctgatggggctcaaggtcccggtggtgaggaacctctcgcttggagatggaagggcgcgacgggagcgggagtggaccgtctgcgggagcctgtgcaccaccggcgacgtcctggtgcgcaagctccgcatcccgcttgcggagggggacctgctcgcgttcgacaacctgggtgcctactcggtcaccgagggcatcgccctgttcctcagccgcgagctcccgctcgtagcgctccgtggggagggcggctggcgggtcgctcgcaaaagggtcgagacgagtgcgctcaacctgccgttagccacgccaggtatggggatgtagcaagccgtggggcccgcgccccgtgttgcgtccccggcatgggggcgagaagggaacacagacatggacgacatcacgctcgagcaggtcatcgacatgctggaccagatcaaggacgacgtggacttctccacggcggtgaacctggtggacgaccgcatcctggactcgttcgacatcctctcgatcatcggggccatcgacgacgagttcgacgtgtcggtgcccgccaaggacatcgtgccgcagaacttcaacaccgcccagggcatctaccagatggtgctggacctggctcagggagagtagcgagtcggcgcgcccggcgtgcctttcgttggcgtcgcggggagtcattcgcctggtgttgcctcggtcggggggtgcttaactccacgagctcccgtgtggatttcggggaacgatgcttagccgccctagcccccatgcggatttcggaggcagatgcttaatgtcgctagccctcgtgttggtggcgcgacggaaatccgcaagaggccggggagggctaagcagcgcgaggacaaatccgcatgaggccggggggagctaagcatgctcggcagggagagaccccgggctacggccgtacgcccgctgtctaggtctggagaaccgtccgggggcagggaccccgggggagaggactccccgagcgggagactcagcaagccgaggctcagctcgaacgaacccggggcgcggtgtgcgcgcaacgggctcaatgtgtccatgactctccgtgacgtgcgtgcgagaaaaaacggggacggtcccatgcgcggaaccgtccccgtgtcacgagcgccctcaggccccctacttcttcttcctgctggacctcacggtcttcgcgcgggtggtgccgcccttcgcggacgacctgcccgcggcgctcttcgcggcggtcgacttggtcgcagccggctttgccgcgacggtcttggacgcggtcggcttggtcgcgctggtctcggttgccttgggctccggcttggcggccgtcgcggccttcgcggcgggcttgggcgagacgggcttcgtcgcggcagccgccgtcgccttggcgggcgcggcctttgcgctcgcggtcgtcttcgcggcagcctttggctccggcttggcggctgccttggcagcaaccttgggtgcggccttcgcggcgggctcagccttgacctcagcctttgccacgggctttgcctccgccttcgctgccgtggccttgggagcggccttggtggcagcgggcttctctgccgtcttggcagaagccttggttgcggcagcggccttcgcgggggccttcgctgcagcggtggtcttggcagcggccttcgccgccggcttggccttgggctctgcctttgccgcgggcttctcgcttgcctttgtggcagccttcgcctgggacttgggggcagccttcttggcggtggcaggcttcacggcaggcttgtcatccagtttcgcggcgaccttcgcagcgggctttgcctccaccttggcagccggcttggccttggccgcaaggtccacgccctcggacgcaagctccttctcgatgtcctccagcatcaggggcatgaagtagcgaagctgcttcttccaccagtaggggtcgtggttcacgtcgtagccccagaagtcgcaccagtggggcacgcccaggcggtcgagctcgtggtcgatggcgcggacgtcgtcctggccgtcctcaaacgcgccctgcccaacgcagaacagcaggctgcgatggcggtacagctccacgtaggggtggttgaggggcatgttggggaggaacgagacgatgtcgttgtcgtagagcgtggggttggaccagtcgccaaagaagtagctcgcgcgatagacgcccgagagggagaggcaaccctggaacaggtccgggcggcggagcgccgcgagcgcggcatgcgtggcgcccatggagcagcccatcgccagcgggcgcagctcggagccgttgagctcgtgcacctggggcagaagctcgtcggttacaaagcggaagtagtcctcctggcgctgtgccctcttggccttgtccccggcgaggtcgctccagctcccctggtcggcgttgtccacggagaacagctggatcctcccaccgtcgatgtactcggcgaggggctcgaggaggccgtcctgctcaaacgactcgcaggtgtggtcctgggtctggaaggtgacgatggggtagcccttctcgccgtagacgatcatggacatgtcctggcccagggcgtcgctgtggatggtgtggagttcgcgcttcatggtcatcgcccgcctttgttgcagattcggttatacatttacgcgaagaaccgcttgtcaagcattcggacaaaaacttacggtcaacggttcattttagcaggtggacgctattgtgtgcaaaactgggcacctcaggggaacctggcggagaccgagcgtgtcctgatggccccaaattgggtcagaatcgtagggatgcctgccggcacgcgttgtgcgatcaaatcgagggggtgtgacgtgggggagaggaacgatgcaccgcgggacgcggcgtggtcctaccgggtgtacgtgcttcgctgcgaggacgggtccctctactccgggatcaccaccgacgtggcgcgtcgcatggcggagcacctgtcgcggagggcgcccggggcgcgctacacccagcgccatcccgccgtggcgctcgtgggcctgtggcgcgcctcggaccgctcgtccgcctgcaggctcgagtggcgccttcaccacatgaagcgctcccaaaagctgcggctcatcgagtcgccggagctcgccggcgaggagtgggagccggtcccctcccgcgagcgggagcgcctgtgggaggaggggctgcggcgcaatgggggcgagtagggccgcgtgcgtcatcgcctctcgtccggggtcacgggtatgctctgtgagacggccggctaggagcagggaggacgcatgatcgagatcgagtgccccaagtgccacacggtgttcgaggaggacgagtccaagttcgcggacatcgtccgccaggtgcgcgacgccgagttcaaccgcgagctctcggcgcagaccaaggcgctcgagcgcgagagggagtccgcggtcgccgaggcggcggcgagggccagggaggcctcgcagggggaggtcgccaagagggaccagcagatcgcccagctcaaggcacagatcgaggctgccaagtcgcagcaggagctcgcgctcgagggcgcccgcgcgcagtcgcgggaggaggtcgcgtccctcaaggcgcagcttgagtcgcaggaggccgccgccaggctccgcgaggagcggcagaggggcgaggcggaccgcgcgctcgccgagagggaccggcagatcggcgagctgcggcagcagatcaaggcgcagggggacgcgttcgaggaccgcaaggcgctcgccgtgagccaggcgaccgctgcggtggagcgggagcgcgacgacttccgccatagggcggagctcgcgcagagcgagaccaagcgcctctcccagcagcttgaggacgagcgcgcctcgtcgctccgccggcaggaggagatcatccgccagaaggaccaggagctggaggactacaagtccatgcagtcccgcctcacggtcaagatggtgggggagagcctggagcagcactgcgagaccgagttcaacaagtggaggagcgccttccccctcgccacctttggcaaggacaacgaggttgtggcggggagcaagggggacttcgtctttagggactacgacgaggcgggcaccgagtacctgtcggtcatgttcgagatgaagaacgaggagggcgagtccaccaaccggcacaagaacgccgacttcctggacaagctcgaccgcgaccgccgtaacaagaactgcgagtacgccgtcctcgtcaccacgctcgagaaggacaacgagttctacaaccagggcatcgtcgacgtgagcggcatgtgctcccaccccaagacgtacgtaatacgcccccagttcttcatcccgctgctcaccttcctccagtcggtggcccagggcacgctcggctaccgccgccagatcgagcgcctcaagggcgagagcatcgacatcgagtacttcaaccaggcgctgggcgacttcaaggtcggctttgggcgcgactgcgagcatgcctccaagaagctctccgacgccatcgacggcatcgatcgcgccatctcgcagctcgagcgaatccgtgagtcgttccgcctgaccgagacccacctgagcagggccaaccgcaaggcggaggacctcaccatcaagcggctgaccaagaacagcccgctgctggccgagcgcttctcccagctggatgaggcgcccgcgcagggggaggggatcgagccggaccaggtggagacgcccgacgcggggaggcaggggagctagggcaccccaaccctcgcgattgccgcgtccgtggcggggggagaggggcgtggcccctccctcggggctcgaccccatggctacgagttcgtgggctccgcgacctggaccacgacggtggagccgaccttcacggtctggtcggtccccggcgtggtgttggcgatcgtgccggcggtgacgtcgtcggtcatcacgtcggtcccacgctccacgatcaggcccatcccgctcaggagctgggacgctcccgtgtacgacatgccggagaggtcgggaatagagacgctctcgtgcgtgtctccctcggacacgaggtcaccggccttggagtcggggctcggcccgtcggagatcacgaggtcgatcttggtgcccttcttctcctgtgcgccgggggtggggccctggctgatgaccttgcccgcggcgacggtgctcgagtatgcgtgcatcacgtcgtccttcacgaagaagccggtctgggcgatcttgtccagggccccctcctcggtgagccccacgaggttggggacgtccttggtcggggaggcggacttgcccaccttcacggtgacggttgacccgaccgcaacggaggtcccctcgcacggcgaggtcgcgatgaccttgccgtagtccgccgcgttgtcggtgccctgctcctccacggtcacctgcagcccgtcctgctccaggtactgggaggcgtccgagctggtctgaccaaccacgtcgggcacgtccacgtgcgccaccaggccaaagcagttggtgaggatcagggacgagcccaggaagcccgtcgccaccacaaaggcgagggcgcgcgcccagcgggggacggcgcgcaggcgatgccgccgcgcggccccacggctccctttggggaggatgcccgtgacgtcaaccgacgcggcggtcacggctcccgtggacgacaggttggcctcctcgtcctgggcagtcgtgatgtcgggcagcacactcccatgggatgcgggaacacattggcctgcgctgggcttcggggaatcgtcgcgtggggccggggcgggggcgcttgactccttgccgccgtcctggggagagacctgcgcctccggtgtcgcgaagtgccttcccctacgcggggcctcgtcgcccgcctccaggggcatgggcctctcatcgccctgctggtctcgcacgcgctgcctccccccgatgaaagttgcgtcgcttctcgcatcagtcatcttagggcatgcatgcgtaaaaggtaactatgagggatgcgtgcatggcgagccccacgcgcacaagggggagagacgccctgctcagggggttgatgagtgttctaccttgggatacgtctgttgagggtcgttattctcgcctagaaaaacctgccgtccgccgaatattccgatgtcccagaatcactcttacagtgcgtcggaggcctgcagcatgagggagaggaccagggcgagcccgtcctccaggctcgcgaggtcgacccactcgtcgcgcgtgtggaggagcgagcccctcacggcgcccacgcagatggaggggatgccaagggagagggggatgttggcgtcggtggaggcgggggaggcatccacgtcgcgccccgtgacggagcggatggtgtcagcgctccgctttgcgagtgcggtgagcctgcgagcgtcgaccgggccgttgccagggcggacgccgatggtctcgacctcgatgtcgacgccgtcgcgccggcacgagtcgagggcggccctgaacaggccctccatgcgcttgaggtttgccgcggactcgctcctgaactcgaagagggcgcccgcctgggaggcgatggagttgacggtgccaccgccctccatgtggcccacgttgatggtggtcttggcacccgtgtcggggtccacggggagctcgatggcatagagcgcctcgatgacctggcacaggacctcgaccgcgttggggcggccgaagttctggtacgagtggcctccctgggtcttgacgcggatcctgaagcgctcggaccccacggcatggctgatgcactgcgagaggtagaggtcaaacgagcagaacgagcgcacgtgcctgcccttgtcgcgcagtccctcgaagagggcgcgcgtgccagcgaggttgcccagcccctcctcgcaggtgtcggcgaccaccaggatgtccacgtcgcgcgtggcgcggtcgtaggcaccgtcgtcgtgaagcaggtgccgggtcgccgccatgagggccacgaggtttgcggtgtcgtcgcccacgcccggcgccatcatgcggccgtgctcgatgcgaacggggagcgggtcggtgtcgggaaacacgatgtcggtgtgggcggagaacacagcgacgtcacggggcttcccgtccttgcggggatgcctgccgcgaaggaggcagagcacgttgccctgctcgtcgatgcgcacgtccttggcgccctggcgacggagccagtcggctacgaacgcctcgcgcctgccctcgtgatgcgtgggggagggaatcgccgccagtttggagaggaggcggacctcctcctcgtggtagttccttgcgtagcttcgggcgtgcctcagcagcgtggcgtccatccgtgctcccctgtctcgcgtggatggcttaatcatagccactggtggacgggctcaaagcgtcggcggacggcaagttaaccgagtttaaaaagtttccaaaagtcacatggcgcgctgcacggcccgcgcccatccctcaaggagccgctccgcgtccccctcgggcatggtgggcacgaacacgtccccgcccttccgcagcgagcgcacctcgtcggtgccgtcccagaaccccgtggtgaggccagcgagataggcggcgcccatcgaggtggtctcgatgttgctcgggcggtggatgcgcgccctcaggacgtctgcctggaactgcatcaggaagccgtttcgcgacgccccgccgtccacgtcgagcgtgacgatcttgcgctgcgcatcggcctccatggcgcggacgaggtcacaggtctggtaggcaagcgcctcgagcgccgccctcgcgatgtgtgcgggcgtggtgccgcgggtgagcccgcagatgaggccgcgggcatcggggttccagtacggggcgccgagtcccgtgaacgcggggacgatgtagacgccgcccgtgtccggtacgctgcgggcgaggtactcggtgtcctcggcggagcgaacgatgcccagctcgtcgcgcagccactggatgagcgcgccggcgacgaagacgctcccctcaagtgcgtactgggtcctcgttgcctcaggcggcgcggcggcgatggtcgtcaccaggctgttcttcgacgccacgggctggtcgcccgtgttcatcaggaggaagcagccggtgccgtaggtgttcttcgcctctcccggctcaaagcagcactggccaaagagggcgctctgctggtctcccgcgatgcccgcgatggggatgcccgagggaatgcccgggtaggaggtctcgccaaacacgtgggcggagggcaggacctcgggcatcatgcaggaggggatgtcaaagaggtcgaggaggtcctggtcccagcggcactcgtggatgttgtagagcatggtgcggctggcgttcgtcatgtccgtcgcgtgcaccaggccgcccgagagcacccacagaagccaggtgtcgaccgtcccaaacagcagctctcccgcctccgcgcgctcgcgcgctccggggacgttgtccagaagccacctgatcttgctcgcggagaagtacgcgtcggggagaaggccggtcttgtccctgatggaccgtgccaccctggggtcgccgcagagttcctcaaccatggcggccgtcctgcggcactgccacacaatggcgttggcgatgggctcgccggtcgacgggtcccacacgatcgtggtctcgcgctggttgtcgatgccgatcgcggccacgttggactcgctgaggtggtggcgactcacgagctcggtgagcgagcccagctgggagtagaggatctcctgcgggttgtgctccacccagcctggcttgggatagatctgctggtaggttcgctggacgctgtccacgaccgtgccgtcgtggtccacgagcaccgcccgggacgacgtggtcccctggtcgagtgcgatcacgtagcgcttcatgcccgtgcctccccgcatcgctgcgacatccagtcgacgacgtccgccatgaccctctcggcgtccgcctcctgcagtatctcgtgccgcatgccctcgtagaccgtgcaggtgacgtccctcaccccgctgctgcgagcgaggtcggcggcggcgcgcacccccttgccaaagtctcccaccgggtcgcccgcgccacctatgtacaggagcgggaggccggatgggatgctgcgcgcgcacgccgggtcgcaggcgtgctcggtcagctcggtgagcgtcgcatacccgccggcggagaacgggaagccgcaggcggggtcggcgatgtagtcgtccacgttcccctggtcaaacgacagccagtcaaagtcggtgcgtgccccggggattgccttggagtaggcgccgtctgccatggagtggagcagggagctcttgtggtcgtctcccctcgtggcgcagatcaggcgcgcgaccctgttgcccatgccggccttcgagacggccaccgtccccgttccgcagatcaccgcaccggcaaggccgtcgccgtggcgctggacgtagttgagcgtgacgaagctgcccatggagtggccgaacacgaagggcgggacccccgcaccccagcggtcctcggccagccggcgcatgcggccgacgtcctccaccaggaagcccgcgcctccatgggaggggatgtctccccagcggctctcgtccgcgctcgccccgtggccaatctggtcgtacccgcagactgcgaaccctgcccgcgccagcgcccgcgcaaggccctcgtacctctcgatgtgctcgcacatgccgtggaccagcacgacgatgcctcgcggctcggacccgccagccacgggctcccagagataccccctcagggtcgtggtgccgtcggacgaggcgaggctcacgcgctcccccgaggccacctgccaagcaccctccgaagacatgcgccccccgttcctctccacccaacgtttacgcaggtcattgtggcaggaagcgccacccccgcatgagaggggagtataggggtgcccccgtggtcgcttgaggtttcctccgcgagaagtgataaaacgtcggtggagactcgcctccccatcgccgcgtcccgtccacggggcacggtggcccgcttggcggaaccccccgactcccgcctcccggattggggaagaaccattcgccggggaccacactcgaccgccgactcagatggagggtgcacatgagcggataccactgcagcgactgcatcttcgcgagtttcacccagaacgagcacacggggctgtaccagggcgcctgcacgcgcggctacacccttgcggacccgcacgtgtccaagcggcccgacatgttcttctgcgaccgcaaggacggcctggttcccgtcatcgacccctatggcaaggagtacctgaggaccaagaacgtgtgcgagcgcttccagcccgacgagcaggacatcccgcagcgcaggggtcgccgtgacccgctctttgggcagggcaggtagccatggtcctcatggtgcacggctccgtcctggaccagcgggtcgacgcgatcgtgaacgcggcaaactccaccctgctgggagggggtggcgtcgacggcgccatccaccgcgcggcgggtccgcggctcctcgaggagtgcagggggcttggcggctgcccgacgggggaggcccgcgtgaccggcgcgtacgacatcgcgggcgtcaggcacgtggtccacaccgtcggccccgtgtatgacgcgcgcgattccggaaggtgcgcgtcccttctcgcctcctgctaccgccagagctgcgaggcggcattgggcgcgggcgaccggtccatcgcgtttcccgcaatctcgtgcggggtctatgggtatccgctggaggatgccgttgaggtgtcgatcggcgctctccgcccctatgcggagaggttcgaccgcatcgtgcttgccatgttcggcctgggggagtaccagcgggccacgcgggtggcgagggagctcgttccctgtcgagagctgcccaacgggttggagatggagctgagctgacccaggcggtttgggaccgccgtacgctgcgcggggaggatggcaggtgggcgcaccgtcatgccagtggcacgtgggggaaggcgcctgcatgggagaggagtcatgcatcgcgtggcacgcccatctgccctgttcccgcaataacctagcaagtaactaggaattgagggaattatgcacctcatggcgaggcgtgtcaacgcgcttctcggggaaatgacgggagcgcgattgtctcggtggggtgttggctgccagctccctctgcctgggtatgacgcttacacgcattcatgtcgtggctttcgaatgaacttttcggtgtcatcaaacgctagcttcatgcttgcacttatatatcatgaaaagctgtaaaaatacgataaaagatttctagacttatctatggggctcagatagcattggtcatgcgccagcggtgtccgtgtgcgggcggcgccttcggagacggaggcaatgcctatggatacaatcctcgaagtcctgcaagccctcgcgctcgtcgcgagcatcacccagtccgccctcggcatcgccagggaggtgagggagatggcaagggagcataagcacgataacggatagcgcaaggagatgaagaaagcccggcggcaaccgggctttcgaatcgaaacaccctgcgccgcccgcatcatcctctaacccaggacgggcaccgctggtgcacttacatcatacccaagaggaaggtcctcagtccagcccactcttcccagctctctgaaagcctgcgagctgctcacgcgaatggtaggaaatggggcggcaccgcgcagacggtgccgccccatcggggccttgcgaagctctacgcgacgtgtgcgccgccgggaatctcgcccccgcagtgcgggcagcgggttgccccctccttgacctcctccaggcagtgagggcaggtggggctggccttctcctcctcgaccttctccttcttgaggaggcgctcctccgcctcctggaacttgttcatggcctttacgatgcagaacacgatgagggcgacgatgaggaagttgatcaccgagctgatgaacttgccaaagtcgattgcagtccccggcaccacgaggccggagatgtcggtcccgccgccggtgaggaaggtgatgagggggttgatgatgttgtcggtgagcgaggtgacgatggccgtgaaggcgccaccgatgatgacgcccactgccatgtccatcacgttgcccctggcgatgaactccctgaactcactcatgaacttgcgcatgggactcctcccctcgccgcgggcggacgggcctctcccttcgtcccgcgtgccactcgtcacgccttgcggcgtgacagctcgtccgtatcaatcataagggtcacggggccgtcgttcaccagcgagactgccatctcggcgccaaacacgccccttcccacgtgtgccgcgtcccgctccgcgagggagcagaagtactcgtacagcggttccgcaacgtccggcgccgcagcgccggtgaagctgggcctcctgccgtggcggacgtcggcgtacagcgtgaactggctcaccacaagcacctcgccccgcacgtcggcaagcgagaggttcatcctcccctcgtcgtcgtcaaacgccctgaggtcgcggaccttctcccataggcgccgtgcggtctcctgggtgtcccctggcccgacgccgagaaggacgagccagcccctcccgcagcgcccgaccaccttgccatccacggcgacctccgcgtgggtcacccgctgaaccagcgccctcatcgcaggccgtagatgtcggagaacttctcgtccaggtactcaacgtagtaccgcgcggagaagggctcgccgcaggcgtcctggatgatctgcccgctgtccttggcgcgtccccactgccacacgcggtcgcggagccactcgcggatgggggccaggtcaccgctgcccaggacggcatcccagtccatgccctccacgatcatctggtgcctgagctgggcgccaaaggcacctcccagggcataggtggggaagtagcccagcaggccgtccgaccagtggctgtcctggagcgcgccgtgggtgtcgtccttgacctccacgcccaggtagtcgtggtacttcttcctccacagggtgggaacgtcggccgccttggcctcgccggagaagagcgcctgctcgatctcgtagcgaacgaggatgtggagcgggtaggtgagctcgtccgcctcggtgcggatgggctggccctcggcccggttggtcgccaggtagaactggttgggcgtgaccctccccagctggcccctgaagtgccgggccatgacctcgagcagccggggcgcgaaggcgcggtcgcgcccgacgtagttctcgaagaagcgggactggccctcgtgcatgcccatggaggtgccgcccttgagggaggtgtagttgaacgcggggttcacgcccgtctcgtacagggcatggccgccctcgtggagcatggtgtagacgttgctcaccacgtcgtcggggtacacgtgcgcggcgatgatcgcgtagttggtggtgagggcgtcggagtaggggtgctcggtgctggtgaggaacatgacgtcggggtccaggccctcaagggccatgaggtcgtgcgcgagctcccactggcgcctctcgtcgaagtgcccctcgatgaccgagcggtccggctgccatccacgcttgcggatctcggcgtagagggggaccaccgcgcccttgacctcggcgaagaagttgtcgtagaaggtccggtcggtgcccggctcaaactcgtcgagccacacgtcgtaggggtcgcgcgaggggtcgcgcagggaggcgatctccctcatggcggcaacgacccggtcgaggtagggctcgaacgaggcccagtcgttctcggccttggccttgtgccacacctggtcggactcggcgaggagcctggtgagggcggactgcttctgggccgggacgccgacgagccggtcgcggtcgcggcggagcaccctcacctgcgccctctgcgtggggctcaggagcgaggactccgacgccagccggtcgaggagcgcgcccgtccccgcggagcacaggagcgcctggtcctcctccttcaggatcgcctgcgcctcgccgcggtcagcggtcgcgcgggcggggtcgatcgagggtccgtagcagtcgatcccgatctcggcatagcggtgggcgtagaggtgccgctcgagcccgtccaggctggccaggtcctccttggggttgcctatcgccgcgggattggggacggagggcgcgcccgggacgcgtgccggtgcgggctccctcctcgtctcggcgccttccacctcgtcgatgtcctcgaagtcatgcatgctgctggggtctgacatgcccgtcctcctccgtctctcgcggccgtcccgtccggggatggcgtcgcgtttcgattccatggcttgagtctagcgtgaggaggggtcccgccgcgtcgcgttcgggcttctccccaggctcagcggcattcacctcccaccgaggctcctctcagcgataccctgttcctgatgggccccagcggccgctacgggcaggcgatgccccctcgggggcgggcgagaggatggagagcacatggcagacaccacccagaacgaatgcgtcctcgggatcgacgtgggagggacctcgatcaaggcggggctcttcaccacagagggcaagctcgtggacgtcaccaagatcccgaccggggcgctggtgggcgaggaggcgttcgcgagggtcgccgagggtctccacggcctggtcgccaactgcagccgcggggacggcgacgtggtggcggtgggcctcgacgtccccggccccgtggacgaccaggggcgcgttggcatgctccccaacatccagctcgaccccgagggcctcatggcggccctggcggcgaagttccccgacagcgccctggccttcgtgaacgacgcgaacgcagccgcgctgggcgagctctggcaggggtctggcaagggctttggctcgttcgtgatggtcacgctgggcacgggcgtgggcggtggcgtcatcgtcaacggcaggctcgtctcgggcgccttcggtgccggcggcgagatcggccacatcaccgtcgagcccaacgagacgctctcgtgcggatgcggccgcaagggctgcctcgagcagtacgcgtccgcaaagggcctcgtccgcatgtaccgcgagcagtgcgcgcacctgggcctcgaggccgcaaagatcgagcacgcgaccgacaccatctcggtgttcgaggcatacaaggcgcaggatcccgcggccatcagggcggtgggggacatgtgcgacaagctcggcctcgccctcgcgcagatcagctgcgtcatagaccccgccgcctacctgataggcgggggcgtcgcgggcgccttcgacctctttggcgagtcgctctccacggccttccgctcgcactgcctcgccacgtcggcgggcgccaagatcctcccgtgctccctggggaacaaggcgggcatgtacggcgtggcgtacgcggcgctccagcagcggcgcgcgagggcctagcccggcggctgcgcggtgacggcgccgcccgtggtcgacgggccgcggccgttgccgtccgccgtcgcggtcggcatgttcatcggtggtatcctgtccttggcgttcaaggcctgccggcacagcaggaggaacggcagcaaggtcgtcgcgtgggcatggtccaccaacgagaaggagaactcagatgagtgactttgtgcaggcttcccatgtctttctgaacaaccccgcgaagaacgtggaggaggccctcgagttcctgtccgcccaggccgtcaagcttggcatcgcggacgacgagaaggccgtcctggacgcgttcaaggcgcgcgaggcagagggcaccacgggaatgatggagggcttcgccatcccgcacgccaaggcggatgccgtcaagaaggccgcggtcctggtcgtcaagttcgcgggcgacgtcgagtgggagtccatggacaacaagcccatcaaggtcgctatcgcgctctgcgtccccggcggcgaggcgggcaccacgcacctcaagctcctctccaaggtcgctgtcatgctgatggacgagtccttccgccaggacgtcctcgcggcggacgaccccgaggtcatcgccaagcgcatcaacgacgggctcgacgcctagcgctgcggctccacggcatcagaagagggggtcccgaccaggtcgggaccccctcgctcgtaccgcacggaatcgtcggcgccggagactactccacgacctcgacctcgatctgcctctcgagctccgcgacctgcgcgaagtcgcccagcccggcgctcatcgcgacgtttgcgcccgtcgccatcgccctcgtgagcgctgcggggacgttgtcgcggtcgaagaaccacagcgagaggaagctcgccagggtggcgtcgccggcgcaggcggtggagtacatcctgaccttcgcggcgttggcgcgccacacgtgccccccgtcgtagaagtacgcgcccgccgcgccaagggtgaggaggatgttcttgcagccgcgctcgtggatgaggtgcaacgcgcgcacgatgtccgcctcgtcgtggatgtcgacgccgaagatggcggcgacctcctcgtcgttgggcttgatgaggagaggggcgccctcgaccagctgggcgaggtgccggtggctcatgtccagcacgacctcgccgccgcgtgcgtgcacgtgctccaggagctcgtcgtagtaggtgggctcgatctgcggggacagggaaccggagacgaccaggcactcgaggtcggggagcgtgtcgaccaggcgcagcatctcctcctggtgttcgcgggagaccgggcagcccgcgttggggaacttgtactcgtcgtcaccgcacgagacgaaggtgttgatgcgcgtgatcccgtcgacctcgacgggatggacctcgcagcccatctcccttgcgccgtccacgatgaacctgcccgagaagccgccgaagaagcccaggatgggggcgtcgacgccaaagtgccgcagcgtgaagctcacgttgagccccttgccgttgggggtgtagacggcgtcgcgggtgcgcgagacgcggttgggcgcgacggagtccgccgtgacgttcatgtcgatggcggggttgggcgtgagggtgtagatcatctctttggtcccctttctgcggtggaacgaagagagggcccgcgccagtgacggcgtgggccctcgcgacaggggtcagtttaggccttgttggtggagccgaggttgtccatgtggctggtgacgaccttgtagatctcctccatgccgggcttggacggcttcttggggtcgaagttggcggggttctcgcccatgtagcccatgaagccgcgggtgaaggcctggcgaagctcggtggcgtagttcaccttgcagatgccgttgcggatggcctcggcgacctggtcgtcgggcacgccggacgtcccgtggagaaccaggggcacgtcgaccttgcggcggatctccttcaggatctcctgctcgatgtgcggggtgcccttgtacacgccgtgcgcggtgcccacgccaacggcgagcgagctgcactgggtgcgcgccacgaactcctgggcctcgtcggggtcggtgaaggggttctcgcccttgaccgccgggccgtcgtcctccttgccgcccaccttgccaagctccgcctcgacgggcacgcccatggcgttggcgaccttggtcacgctctcggtgaggtccatgttgtcctcgaaggggacgtgggagccgtcgatcatgaccgacgtgtagccggcgcgcagggcctgcatgcagcggtcaaagccgtcgccgtggtccaggtgaagcgccacgggcacgcttgcctgctcggcggcgaccctgaccatggcggcgaagtagtccaggttggcgtactttacggtgcccggggtggtctgcatgatgacaggggagtgcctgtcctccgcggccctcacgaccgccatcacgaactccaggttctcgacgttgaacgcgcccacggcgtagtggccctcctgggccttgagcagcatgtccttggtggtgaccagcatctgtgactcccttcggacggcgtccggcttctccggaccccttgccttcgccctgcattctagggggttcgacgtgcgcgggcctgtggcgacgggtgccgttaagccgtgtcggaagaaagtagacgcaggacatgagccagagaaacctatcggaaggcgctttggaaggtcatatacctgcaaaacgcaaccaacaaaaaggcaaagcatttctccacaggcaagcaaaggaaacacaaatgctgcacaatggggcgataggacggggctggcgtccgtccgcgacggcagggaggtagcgcgcatgggtggtccggcgggggagaggggcctgtacgccgaggagcggagggcagccatcctgcagatgctcgaccagcgctcctcgctgcaggtggcggaggtcgccgacgcccttggcgtgtcgagggtgaccgcgcgcgccgacctcgacgccctcgagcgcgacggaaagctccgccgcacccacggcggggcggtgtccctctcgcgcacgctcacggtctcgatccaggacagcagggtcaacgtccacgcggatgcaaagcgggcgataggcgcgcgtgccgccgggctggtgggggacggagactccatcctggtggactccggcaccacggcgctcgagctggtgcgcgccctgggctcgcgagtgggcgtcaccgtggtcaccgacgacttcacgatcgccgacttcgtggaccgttcgatgcccgccctggacgtggtgatgctcggcgggagcctgcgcaaggggcaccgctacacctgcgggcctctcgccctcgccgcgctgggcgccctccaccccgacatcgcgttcgtcagccccaccgcgctcgtgcccggcagggggctcatgaccaactaccaggcgatggccgagctcaagcgcgcgttcctgtcgtgcgcggacaggaccgtggtgctgctcgactcctccaaggtgggcggtaggggcctgatgcgctttgggtcgctgcgcgacgccgacgccgtggtgtgcgaggcggacccggagggggtcttggggcgggaggcggacgagtccggctgcaggctcctcctcgccccggccccgcctcctgcgggcgagggtaccggtgtcgccccggcgcggtcacgcgtgcgctaggctggagcaaggcggcggatgccaggaggcgacgatgggaaccaagctcattctcacggacatagacaggaccatcctcccccacggggccgagcgggtctcgcccgggacggtcgcggccttccatgccgcactcgacgcgggtatacacgtggggccggcgagcgggaggggctacggctggatcccgccgttcttcgggggagacgaggagtgctgcgagacctgcgtggcgaccaacggcaaccaggtgttcctggatggccggaggctgcgcgaggcacgctttgacggtgacgtcctggcacccgtcgtcagtcacctgagggacatcccgggctccggcctcatcgccttcgacggtgacgtccccacgctcgtcgcgggcaggctcgaggacctcgccgtcgtgttcccggcgtatgcgagggcctgcaggacggcccccgacggagggccgctcggcctccccgacttccccgcgaccaaggcgaacgcgtttctcgcccgggacggcaggcgccccggcgacgacgagacgagggcgttcgtggatggcctcaaccaggcggtggaggggctcgacttcgacttccccgagccgggcttcaccaacgtcatgcgcgcgggctggaacaaggcgagcgggatcgactgccttgcggacgcgctgggcatctcgctcgacgaggtcgtggtgttcggcgacgccggcaacgacctgagcatgttcgcgcgggtccccaactcggtcgcggtcgcaaacgccacggaggaggcggcgcgggcggcgcgctggcacatcggagcctgcgaggacgacgccgtggcccaggccatcgaggcgctcgcggcgggggagtggccgttccgcgagtgagtcagggtacggggccctgggcccgtccgcccgacgatatggcgtccgagtggtgccccggcttctctccgccaaaaaggggtcctgtgctatcctgtgccactaggcaatgacggagaggtccgttcgtcgcgtggtcagtggagaagagagggagctcgcgggctgagaggctcccacgctggccgacggtcggagttcactccaccagccgcgagctcaaagcgcgcgtgcgcgagtaggcaagccgtccgtcgcacgacacgcgacgcaagagtgggcacgcgcgagagaaaacgcgcgcgccaatcaaggtggtaccgcggaagtctccgtccttgggcattgggctcaggggcggttttctttttggaaggggtttcgcagcatggcgatgtcagacgacctgaatgccattcaggagcaggttgaccagatgctcaagggcgcccagtcgctcgaggacctggagcgggttcgcgtacaggcgctgggcaagaaggggtccatcaccaccatcatgcacatgatgggcaaggtcccgcccgaggagcgccccaccatgggcaagctcgccaacacggtgcgcgccaacgtccaggcggcgatcgagcagcgcaaggtccagctcgcccgcgaggccatggagcgcaggttctctgccgaggaggcggacgtcacgctgccgggcaggaggctctccccgggcacccagcacctcgtgaaccagatccgcgaggagatcgaggacatcttctgcgggctgggctacaccgtcgaggacggcccgttcgtcgagaccacctactacaacttcaccgcgctcaacgcgccggaggaccaccccagccgctcggcaaaggacaccttctacgttgaggacaacgccccggaggggaaggaggcgcacgtcctcggcgagtccgacgtgctgctgcgcacccagacctcgggcgtccaggtccacgtgatggaggagaagaagccccccatctacatgatctgccccgggaccgtcttccgccccgacacgcccgacgccaaccacctgccccagttcacgcaggtcgagggcctggtggtggacgagggcatcacctttggcgacctcaagggcacgctcgactacttcacgcgcgagatctttggcaaggaccgcgcaacccgctaccgcccgcacttcttcccgttcaccgagcccagctgcgaggtggacgtctcgtgcggcgtgtgccacggagagggctgccgcttctgcaaggggaccggctggctcgagatcctgggctgcggcatggtcgaccccaacgtgtttgggtacgtgggcatcgaccccgagaagtactccggctttgcgtttggcatcggcgtggagcgcgtcgccgcccttcgctacgacctgcccgacctccgcatgctcatgaccggcgacatgcgattcctgaggcagttctagcccgcgtccgcaagcaaccgtctgcgggcacgccccgcacagaaaggcaagtatcatgcgcgtctcctacgagtggctcaagagcatggttgacctcccccaggatccccaggacctggtgagggagttcgtacgcaccggcacggaggtcgagtccgtggagagggtcggcgccgagatcgcgggcgtcgtcacctcccaggtgctggagaaggtcccgcaccccaactccgaccacatgtacgtgtgcaagatggacgtggggtcccacaacgtcgacgaggacggcaaccccgtcccactgcaggtggtctgcggcgcccagaactttgagcagggcgacaagaccgtgaccgcgctcgtcggcgccaccctccccggcggggtgaagatcaagaagggcaagctccgcggcatcgagtcccttggcatgaactgctccagtcgcgagctcggcctggacgacgaccacagcggcatcatgatcctccccaaggacgcgcccgtgggcgtcgacttcctggagtggaggggcctcaccgacaccgtcatcgactgcgagatcacgcccaaccgccccgactgcctgagcatgctcggcatggccaccgaggtctccgccatgctcgacgaggacgtccacgccgagctcccctccatcgcggaggagtcggcagacgccgggcgcacggcggacctcgtcgacgtcacgatcgacgacccctcgctctgcccgcgctacaccgcccgcgtggtgcgcaacgtgaagatcggccccagccccgagtggctggcaaggcgcgtgatggcggcgggctccaggcccatcaacaacgtggtcgacgtcaccaactacgtcatgtacctcacggggcagccgctccatgccttcgacctgggcaagctctccgagcgcgacggcaagcgccacatcgtcgtccgcgcggcgcacgagggcgagaagatcgtgaccctcgacggccaggagagggacctcacgcccgacatggcggtcatcaccgacgacgggaggaccccggtcgccctcgccggcgtgatgggcggccagaactccgagatcgacgaggggaccgtcgacgtcctgctcgagagcgcgagcttcgagaagggccacatctcccgcacgagccgcaacctcgacctcatgagcgaggcctccatccgctacgagcgccaggtcgacaccgcccgctgcgccgatgtctccaacatagccgccgccctcttcgaggcgtgctgtggcgcccaggtctgcgagggcatggtcgacgagtaccccgtccccgcgctgcccgcgaccatcgagctcagacccgaccgcgtgcgagcgctctgcggggctcccatccagacgtcgttcatggcgcagaggctgcgccgccttggctgccaggtgagcgagggggagggcgagcacgaccccatgaccgtggtcgcgcccaccaaccgtcccgacctcactcgcgaggtcgacctcgtggaggaggtcctgcgcctctggggcgagggcgacgtggagccgacgctccccgccgcgcgcaaccacgccgggggcctctccgtggagcagcgccgcacccgcaagatctgcgccacgctgcgcgccgcaggcctcagcgagaccagcacctataacttcgccgacccgcgcgacctggagcgcctgggcatgcccgagcgaggcaagggcatcccggtgaagatcctgcaccccctcgtcgccgaccagggcgagatgcgccgcgacatgatccccgggcttctccgctccgtcgcctacaacaaggaccacggcgtccagaacgtgcacctgtacgagctgggacgcgtcttcttcggccacgagggcaagagccagcccgacgagcccacctacgtcgccggcgtcatgagcgggcgctgggccgatgacgcgtggaacaagaagtacgccgacctggacttctacgacgccaagggcgtggtcgagacgctgctggaggcgctcaggatcaccaaggtgcgcttccgcgtcgccgaaccggacgagtacccctggctccagccaggccgtgccgcggaggtcctcgcgcagggcgagctgctggggtgggtgggcaacatccacccgcgcgcgctcggcaactttggcatcgacgacccggtcgtcgccttcgagctcagcgaggcggtgcttctcaggcttgccaaggacgagctgccctaccaggaggtgcccacgctccccggcgtcaagatcgacctcgcgctggtcgtggacgagtccatgtcctacgagcaggtgtcccagcgcatcaggagcgcgggcggcaagctgctggcgagcgtcgagctctttgacgtctaccgcgacgagaagcgcgtgggcaagggcaagaagtccatggcgttctcgctcgagtaccgcgccgcggaccacacgctctcgtccgaggaggtcgagagggcgcacaacaagctggtgaccaaggtgatcaagtccaccggcggagaggtgcgcggctaggcgggaccccatggccccttcccccggtctgaaaagcctcgcggggaaggggccgtcttctctccccgaaactgaaacgcatggtaggataggccgtatgccaagctggaacatccacatcgcacatgtcgaggcgaccctccgctccgtgggggacccgtctgcccttggcattggcgaccagaacgccttcctctttgggaacttcgtccccgacatcaacgtgggttacatggtcaagaaccccgaccgcaggatcgagtaccgggtcacgcattttgcggatcccggcttcatgcccgagccgcactactgggagttctgggagcgctacgcccttccctccgcggacgcgaacggcagggtctcggacgtcacgctgggcgcgtggtgccacctggtggcggacaaccgctacaaccacgccgtcaacgcgcttctccttcgccgcggcctcaagccgggggaggacacccgcattcgcaagcagggcgacttcgacctgtttggcaggacgcttcgcattggcatgacctgcgagcccacgccggccctggtgcggcaggcggcggagttcccccagtacgcaatagacgtgcgcgacgcccgggcggccgtggaggtcgccaaccagatcgtgaggaacaactgggtcaaccactttgatggcgaccccgtgtacaggctcctctcgtccgacttcttccgcaccgtcttcgacgaggtgcagaacgcgataggggagggactcctggcctacgcccgccagggggccgtggcacccgagctccgaagggagagggcgcatgcataggaccaaggcctccacgccaatcgacaagtcagccgagggggacctgctgtacgtgcaggtctcggactacgtgagggagaagatctactccaaggactggggcgtcgacgagcccatcccgtcggagcacgagctcatgaacatgctccacctctcgcgcggcacggtccagaaggggatcaggcagctggtggacgaggggctcctcgtgcagcagcgcggccgtggcaccttcgtggttcagcccgtcatggcgcggccctcctccaaccggctcctctcgtttggcgagtccatgagcagccagggcatcgagtaccaaacccgggtcatcgagtgccaggtcaggccagccggtccgctctgcgccgagaacctgcagattggcgtgggggacgacttcctctacctcagcagggtccgctacgtcagccgccgcgcggtcatgttcatagagagccacctcaacctcgccgcctgccccgggctggagcagagcgactttggcaccgagaagctgttcgccgccgtcgagcgtacgagcggccaccagatcggccgctccgagatggtctacacggcccgtaccgccggcaaggtgcgcggcggctacctggagtgcgacgagcacgcccccgtcctcgagctggaccagctcgtgcgcctggacgacggcacgccgtttgagtgggggagcgtttggcttcccgcaaaccgctgcgtcatctcaagcgagacccagcgagcctagcgcctccggtatcgggccagcacgtccccaaactcctccctgccagcaacgtagtcggcaaaggccagaagcggctctctcccgtgaaacgtcgcgcagttgccgcacaggtcgcagtctgacaggcaggggaaccgcttgcttacgtaggcggagcgctcctccctcgtcgactcgccggtcttcggtgcgtccatggcactacccccaatccgtcccattatggctctcccacatgtcggatgggggagaggggcgtggcgccttctccccaacacgccccgtcggccgtgatggtggcgtggcggtctcgtttcgtcctccgtggcgtgccacccacggggcgaaagggggtacgaatagagaggtatcaaaccacggagaaaggacgtcccatggcacttgacggcaaggttgcggacctactcaacacccagatcaacaaggagctctactcggcgtacctgtacctcacgttcgccgactactatgacgagcgcgggctcaagggcttcgccaactggtacatgatccaggtacaggaggaggttgcccacgccaagatcctgcgccgctacctgcttgacaacgacgtcaacgtgaagatgctcgccatcgccgagcccgacaagaccttctcgagcgacctcgagcccctccaggccggcctggagcacgagcgctacatcaccagctgcatcaacgagtgctatgcggccgcctacgacgtgcacgacttcaagaccatgcagctgctcgactggttcgtgaaggagcagggcgaggaggagaccaacgcctccgacatggtcaagaacatggagctgtttggcagcgaccccaaggggctctacgacctggaccgcgagtaccaggctcgcaccttcgtcgcgcccacgatgcccatgtagggaacaggcactcgctcggggcccggctcgtccgggccccttccatgagggtcgacctggtcgccgccatgccgacgaaccgtcctgagggggacacatgagctggtacgaggaatccgtcttctatcaaatctatccgctcggcctcacgggggcgccgtaccagaacgacgggacgtccgagcccgtccaccggcttgcgcagctcacggctaacggctgggtggagcagatggtcaggctcggagccaacgcgctcatcctcaaccccgtgttccagagccagagccacgggtacgacaccgtggactacaccaaggtcgaccgcaggctgggcacgggagaggacctccgcgccttcgtcgatgcctgccacaaggctggcgtgagggtgcttctcgacggcgtcttcaaccatgtgggaagggagttctgggcctttcgggacgtgctggagaagcgggaggcaagcccctacgctgggtggttctgcatcgactggggcggcaacgaccgctgggacgaccatctctcctacgagtgctggcagggggtggacgagctcgtgaagctcaaccactccaacttcgacctcaacgcgtaccttgcggaggtcatccgcggctgggagcgggactacgacatcgacggcctgcgcctggacgtggcgtactgcctcgaccgcggcttcctggggtacctgcgccggatcgctaacgagctgtccgagcgccgcggccagaagttcctcctcctgggcgagaccatgtttggcgactaccgccagtggatgggcgacgacctctgcgacaccgtcaccaactacgaggtgtacaaggggctctggagctccttcaattcggccaacatgcacgaggttgcctactccctcgaccgccagagcggcgacgccccctgggacctgtacacggggctccacctgctcgacttcgcggacaaccacgacgtcccacgcatcgccaccaagctggacgacaagaggcagctggagccgctctacggccttctgtttggcatgcccggcgtcccctgcgtgtactacggcagcgagtgggggatagagggcgagcagaactacggggaccacgagatccgtcccgccctcgacgccccggagtggaactcgctcagcgactggatcgcctccctcgcctgcgcgaggaggggctccaccgcccttatggtgggtgactaccggcagctccaggtgggtcccaccgcgctcgtgttccagcgctcatcggcagaccagcgcgtcatcgtcgcggtcaacgcctccgacgcgccgcagacgctgcacttcgacgccgggtgcggcagggcgcgcgacctcatcacgggcgaggaccacgactttggcggcggctccgaggttcccgccttcggatgcaggtactggctctgcgagaggtagcgagacaggcacagccacgacgaggaggggacttccacccaacggcgggagtcccctctcgccctgtcgcccttgcggagtgacagtcataacaaacggggcttccgcggaaaatgcgggagccccgtctactgtctatcgggcggtcgcgctactggatctgggcaaccatggccatgttggtcgaggtgatgtagtcaccctgcgacggggaggtctgagggtcgcccgcggtgacgacgacgaggtcgcccttgttcgcgatgcccttctccttggcaacggtgagggcgttgtagcaggttgcggagagggaaccctgctcggtggtcttgaacgccttcacgccccactggaagcacgtcttgcggatggcgtggttggagggggacattgcgtagatcgggagcttgggacggaagttcgagatcaggcgcgcggtgcggccggagtgcgtggggcagatgatgcacttggcgcccacgcggtcggcgacctcgacggcagccgcgccgatggcgctgttgacgttgcgcatgccgccgcggtcgtggtactcggtgtgctcgaggaggtacttctcggtctcgaggcagatggacgccatggtctgcaccgcctggacggggtacttgcccgcggccgtctcgccggagagcatgacgcagtcggtgccgtcgtagatggcgttggcaacgtcgctgacctcggcgcgcgtggggcgcgggttgcggatcatggagtcgagcatctgcgttgcggtgatgaccggcttgtaggcgttgttgcacttgcggatgatggtcttctggatgtgggggacctcagccgcggggacctcgacgcccaggtcgccacgggcgaccatgatgccgtcggagacgtcaaggatctcgtcgaagttcttcacgcccatggcgctctcgatcttcgggaagatgtagacgttgcgcatgccgttctcggcgcagagggtgcggatctcgtcgaccgccttggcgttgcggatgaacgacgcggagattgcgtcgatgcccagctcgcagccaaacatgatgtcggcgcggtcctgctcggtgacggaggggaggccgatctcgacgttggggacgttcacgcccttcttctcgccgatctcgccgccgttggtgacggtgcagtgcatgtcctggccctcgacgcccgtgacctcaaggccgaccaggccgtcgtcgatgaggatgacggagcccttggtgacctccttgggcaggtcgaggtagtcgagcgagatgtgcttggcgttgccgtggaagtcctcggtggtgggctgggcggtgaccacgatctcgtcaccggtgttgacggtgaccttctgaccgccctcgaggagaccggtgcggacctcggggcccttggtgtcgagcatgatggcgacggggatgccaagctcctcggagatgcggcgcacgcgctcgatgttcttgcggtggtagtcatggctgccgtggctgaagttgaacctcgccacgttcatgccgctcttgatgagctccctcagcacgtcatcgctctcggtcgcagggcccattgtgcagacgatcttggtcctcttagctaccatttcgttccttcctcatcgtatggattggcggcacgtctcactttcgcggggcggtccgccatgatgcgcgtatggcagatgcctttcgaagtatagcctgcctctcttttggctttgttgttcaaacgtcatgtgaacgcaagccgaaacgaaaggcaggcagggcgtctccccctagcagaccacgctgcggtccacaaactccccgcccgtggcgtaggccttggcgttctcgagcgtgaccgtagcgatctggccaagtgcctcgcgcgtgaagaatgcctggtgagaggtcatgacaacgttggggaacgagcagaggcgcgcggggatggactcaaacacctcgccggcgcggtcctggtacacgttctcgttctcctcctcgtacacgtcgaggccggcggcgccgatcttgccggagaggatgccgcggatgagcgcctgggtgtcaaccaggccgccgcgaccggtgttgacgaagatgacgccgtccttcatcttggcgatcgcctcgtcgttgatcatgtggtggctctcctcgttgaggaaggcgtggaggctgatgaggtccgccctctcgtacagggtgtcgtagtcaacgtactcgtcgatcacgtgctcctcgtcgaccagcctctggttggggtacaggtcggcgcccaggaccgtcatgccaaagcccttgcagatgcggcagagcgcggcgccaatgcggcccgtgccgatgatgcccgcggtcttgccgtgcagggtctcgccaacgaggccggtgagcgagaagttgttctcgcgcacgcggttgtagcccttgcagatgcggcggttggcggccagcgcgagcgccatggcgtgttcggcgatcgcctcgggggagtaggccgggacgcgggtgaccttcatgcccaggctcttggcaaactccacgttcacggcgtcaaagcccgcgcagcgcatgaggacgaggcccacgcctaggccgcgcagcacctcgagcgtcatggccgagacgtcggcgttgacaaaggcgcagacggcgtcgtagccctgggccagggtcgcggtcagcggggtcaggttggtctcggtgaagtcgaccttcagctcggggtacttgggaagctccctctcaaacgagtccctgtcgtagctcttggtgccgtacacgaggattttcatgagattcccttcgactgctccggttcctacaactgcctgcctgattcgattacgtggatattttagctcagggcagatacgtctaccacgccttttgtcgatagcggacaagtcaggaggacatgtatatcgatgaacggtcaaccgtgtgcgcacgcgggggagaggaccgtctcccctcgcccgactctcggatatctggcgcatggggggtctgtggagtccgtttgggtggtataaatacgcgtacgcaaggcgtctggcatggcagccttggtgagcccttgcccctcctggggaattattagcgggcatcaatctgccgggcgcgagaggactctgacccaggaggaacaattgaaggaatacctgtctcccgtcgatgacgtcgtcaagggggtcgcgaccgacgcagactccggcctgtcccaggcagaggcggcgcgccgcctcgagaaggacgggcccaacaagctcaaggaggccgagaagacccccgtcatcgtgaggttcttccagcagatggccgaccccatgatcatcatgctgatcgtggccgcggtcatctcggccatcacgggcatggtgcagggcgaggcggacttcgccgacgtcatcatcatctgcttcgtcgtcatcgtcaacgccgtcctcggcgtcgtgcaggagagcaaggcggaggaggctctcgctgcgctccaggagatgtctgccgcccagtccaaggtggtgagggacggaaggatcgtctcggtccactcctccgagctcgttgcgggcgatgtcgtcatcctcgaggcgggcgacgccgttccggccgactgccgcatcatcgagagcgcctccatgaagatcgaggaggccgcgctcaccggcgagtccgtgcccgtcgagaagcacgccgactccctctccctggcggaggggcaggacgacatcccgctcggcgaccgcaagaacatgtgctacatgggctccacggtcgtgtacggccgtggccgcgccgtcgtggtcgcctgcggcatggacaccgagatgggcaagatcgccgacgccctctcgcaggccaaggacgaggagaccccgctgcagaagaagctcgacgagctgtcgaggatcctctccgtcgcgtgcatcatcatctgcgccctcgtcttcgtcgtgacctggctcaagcacggcatgggcttcttctccaacatcaacctcgtgctcaataccttcatggtggccgtctcgcttgccgtcgcggcaatccccgagggccttgccgccgtcgtgaccatcgtcctctccatcggcgttaccaagatgagccagcacaacgccatcatccgcaagctcaccgccgtcgagacccttggctgcacccagcttatctgctcggacaagactggcacgctgacccagaacaagatgaccgtcgtgcgccacgagacccagaacatcgactccctggtaacctgcatggccctgtgctccgacgccaagtgggacgacgccgagggcaaggccgtgggcgagcccaccgaggcggccctggtcgcggatgccgccaagcgcggcttcacctccgccgacctcgactccgccaacccgcgcctgggggaggcccccttcgactcgggccgcaagatgatgtccgtcgtcaaccaggacgccaacggcaggatcgtccagcacaccaagggcgctcccgacgagatcatcaagcgctgcaccagcatcctcacgtccgacggcgtggtgccccttacggacgagacccgcgagctcatgctacgcaagaacaaggccatggcagacgacgcgctgcgcgtcatggccgccgcccgccgcgtatgggaccacgagcccgagagctatgacgcctcctacctggagcaggacatgacgctcatcggtctctccggcatgatcgaccccgtccggcccgaggtcaagggcgccatcggcgaggctcacaacgccggcatcagggtcgtcatgatcacgggcgaccacatcgacaccgccgtcgccatcgcccgcgagctcggcatcatcaaggaccgctcccaggcgatcaccggcgcggagctagacaagatctccgacgaggagttcatggacaggatcgaggactttggcgtgtacgctcgcgtgcagccggagcacaaggtccgcatcgtcgacacctggaagaagaagggcaagatcgtcgccatgaccggcgacggcgtcaacgacgcgccctccatcaagcgcgcagacatcggcgtgggcatgggcatcaccggcaccgacgtcacaaagaacgtcgccgacatggtccttgcggacgacaacttcgccaccatcgtcgaggccgtggaggagggccgcaggatctacgacaacatccgaaaggcgatcgcgttcctgctctcgtccaacctcgccgaggtcatctcggtcttcgttgcctcgctgatcggcttcaccatcctcgagcccacgcacctgctgtggattaacctcatcaccgattgcttccccgcgctcgccatggccatggaggtcgccgagcccggcctgatgaagcgcagcccgcgtaacgccgacgacggcgtgttcgccggaggcatgtggctcgactgcctggtccagggcatcgtcatcgcagccctcacgctcatctcctactttgtgggcctctccatcgagaacgtgcccctgtccgacgtgatctccggcgccaacctgggcagggacggcatgaccatggcgttcctcaccctctcgatggtcgagatgttccactccttcaacatgaggagccgtcgccagtccgtcttcaagctccccacccagaacgtgtggctctggctcgcgttcgccgggtccctcgtcctcaccttcgtggtgatcgagaccccgctctccgtcgccttcggctttgccgagatcaacgtaggggagtacgcgatcgcgatgctgctcgcggcctgcatcatccccatcgtcgaggcctacaaggcaatcatgagggcggtcgagaagaggcgcgcctagcgcgctcgcgggaggtcccatggcgaggagggcaaacaggaagggcaggggctcgcgtcccgcccgtctgcgcggggagggcgtcggctcccttcctgcgctctcctcgctccaggaccttcccaccctaggggagctgcacgccactccccctcagcttcgagcgttcgacgaggcgtcatgcgacgcggtgcgcgagctgggggagggcgcctctcccgcaatcggctgcgtcgtgaggctcgaccgcgggtatcccgccgtcgcgaccgaggacggcctcgtccgagcggagtttgccgcgtctctcaccaagggcgagttctcgcgcgtcgccgtgggcgactgggtgtgcgtcctcgtcccccaggggcacgacatggccatcatccggcagatcctgccgcgcgagagtgacatcgcgcgctggcgcggcgggtccaggggagagaggcagaccctcgccgcaaacgtggacaccgtcctcgtggcgcaggcgctcggcgcatcgggcgtggacgtcgatcgcatcgcgcggtccgccgtcatcgccctggactgcggggcgtcggtcgccgtcgtgctcaccaaggcggacagggcgggtgccgacggcctagcccgttccatctcgtcggtccgtgcggtgctgggtgaccaggttcccgtggtcgcgtgctgcgcgggcgcggatgaggagatcggcgaccttcccaacgtcgcgctcggctccggtgccggatgggggacggagggcgttcgcgccctcgtgccacccggcagcatcgccatcgtcctcggggagtccggtgccggcaagtccacgcttctcaacgcgctcctggggcacgaggtgctccagacggggtcggtcagggcgtctgacgatgcgggcaggcataccacggtggcacgtcggatggtctcgcttcccaacgccggcgtcatcgtcgacgagccgggcctgcgcagcctcccgctgatcggacacgagcgcggcctggcaaagctgttcccccgcgtggcgcaggcggccggagagtgtcgcttccgcgactgcacccacacgcacgagcccgggtgcgccgtgcgagacctcgccgactcgggggaggtccctccggagcgcgtcgagacgtacgtctcccttgcctccgagatgcgtgcctccgccgccgagctggatcccgacgtgaccctctagcgacgcttgcgggtcgctggccgcgcgttggcatatccgaacaggcgcgttcggtcgcccgcagctgcgggcaacgtatgcacaacttagctgcggggctatttcagaaggtgtcccgatgccgcctccccagacgggagaatcgcccatgtgggcaattcgaacgcttctggggaggtcacttatgtctctgcgcttcaggttggcgctgtcgacggcgtgcgccgtccttgccgccctgttgttcgtcgtgtacgcggggcacgtccgtgccgaggcggactctgttcgcgaggaggctgcggcgcgctttggcggtgacgtcgtgagcctcgtcgtggcaaccaagaacctcaaggcgggggacgaggtcagcaaggcaaacgtccgcgagaggggctgggtctcgtccctcgcccctgagggggcgatcaccagcctcgacgtggtcatggggagcaaggtcgccattcccgtggcaaagaacgccccgctcaccaagaccagcttcgaggacccctctcccatggtccaggttccctccgggtacgttgccgtgagcatccccacgtccgagagggttggcgtcacgagcggcgttcccgccggggcatcgctcaccgcctaccagctcggcgactccggggccaaggtcatcgcccgtagcctcagggtcctctcgtccacgcaggaggggtcgctggggatggactcccgcgagctgaccctcgcggtgaggccggaggacgtggagcgagtcctctccgccagcaccaggggagacctacggctcgtgctgccctccgaggacatcgcggcaggcaaggcggaccaggccgcctctgcccccgagcaacgggagcagggcgaggacgtcgcctccgcggactcaaaggcgtccgccgggggatctggcgaccaggggggcgagggacgatgacggagctgtggatcggatgctgctcccggggctcgcggcgcgacctcgcacgtgcgctcgattccgtgtcgccgctcgcgactctggtgttcgcggcggacgcagcggatcttaggaggaggttcgaggacgaggagcccaacacggtgggtgccgtggttgggcttaccgaggacggcatctccgacgttaacgtcgccgctgccgtcgcgcacgacggcagggcgtccgaggtcctgctcgtcacgcgcgaggcgagtgggtcgctccgatcaagggcaaggcaggcaggcatcacccgcgtggtcgagatcccgcggcgcgtcgagcccgtccgggaggagggggctcccatcagccaggcgcgggggcgcgtcgagtcggacgtcccctccgcccggacggggttgggagggggagaggcgcggaccgccgaggtcgcatccccctccgctggcatagcgcgtcccgacgtcacgagcgagcgcctgacgcctctctcctcaagcgaggaggcagtgtttcccggcggtgggtccatcctatgcctctcctccgggaggggcggggtgggaaagaccaccatcgccgcatgctgtgccgttgcggcggcgtcctggggaatgcaggtcgccctggtcgacctggacctgtcgtgcggtgacctctgctctcgctttggcatcgggtcgccgtccgacctcgcgcgacttggcggggagcccaccgccgagcagatggggcggctcggaatcaggtgtgccgagggcgtctccctctggggtccctgcgaccggcccgagatggcggagcgcgtcgcgccggtcgtccccacgctcctcaactacctgtcctcgcgccacgacctcgtggtggtggacacgtcgaccacgttctgcgaggcgacggcacgagcggcgcaggtggcagaccgtgtcctcctcgtccacgacggcgcgcgcgggtcgctcgcctcgctcagcagggcgagtgcgctcgcggtgaggctgggagtcgctaggacgcgcatggtgcgcgtgcagaacatggcggacccaagggcccggtttgagcccgcgctcggaagggcggaggcaggccttgagggtgcacgggcgttcatggtcgccgacgggggcgaggcgggcgaggagctcctcgacgccggcgaggtggaggacctcatgggcgagaggggcgacctcgcggagtcggtctcctacctcgttgcgcagatcctctcggagctggggagcctccccgactgcgaggatgcacggcgctcgctcgaggcgaggccggggaggcgaaggggcctgttcggcaggagaagggaggcggagtgatgtcggttctcgagcttgtcatggagcaggagggcgccgcgacgccagcggagcgggttgcggcggcggagggcgggggtctctcgcccaacagggcacgggagctcagggaggtcctcaagcacgaactggtcgagaggctggggctcgaggcggtggcatccatcgccgcctcgcgtgacccgcagaagtctcgcggcgagcttgccgtggcctgccgagccatcctcaacggcggacaatttgcgtccctctcgcccgaggagggggagcggctggtctcccaggtgctcgacgacgtgtgcgggctcggacccctgcagcgcctcctcgacgacgagagcgtcaccgaggtcatggtaaacgggaaggacgccctgttcttcgaacgggacggcaccatccaccccgcagagacggtcttcgactccgacgagcagatcctcatggtcgtggaccgcatcctcgcgccgctggggcgaaggttcgaccgcagctgccccatcgtgaacgcgcgcctcaagaacggggaccgcgtgaacgccgtggcccctcccgtcgccatcgatgggcccatggtgaccatacgcaagttctccaaccgcatcacgtcgatggcgcgcctggtggagctggggtcgctcccgccctggtacgcgacgctgctcagctgggcagtgaggctgcgccaggacatcgccgtggctgggggcacggggtcgggcaagaccacgctcctcaacgcgctctcgtgcgaggtccccctgggggagaggatcgtgacgatcgaggactcggcggagctcaggtttgacagccatcccgacgtcgtgcggctcgaggcgcgcacggcgtccatcgagggctcgggcgaaatcaccatcagggacctcgtgaagaacgcgctccgcatgcggcccgaccgcatcgtggtcggcgaggtcaggggagaggaggcggttgacatgctccaggccatgaacacggggcacgacggttcactcacgacattgcacgccgggacgcccgacgaggcggtcctgcggctggtgctgatgtcgcgctttgggatggacctccccaccgacatcatcgaggagcaggtagcgaccgccctcgacctgctggtcatgagccagaggttccccgacggcaggcgctacatcacctcgctctccaccgtaggcagggcggagggcggcggggtcagcctgggcgaggtcgtctcgttcgacgagggttcgcggtcctggcacctggtcggcgagccgggctttgtccagagggcgttggacgagggcacgctcgaaggcggggaggtgggggagtggaggcgctctgtgtgctagcggtggcactgctcgcatgggtggctccgtttaccctgcttggcggtgtcctgtcgcggccccatggctccgggggcatcgccaggagggcgaggcgcgccctcaaaccgctcctgctggccctggggaggggccgcctcgttcgtctcctcctgagaaacgagtcgtgggagggcgcctcccgcgcgatcgcagtgaggtttgcggtgaccgacgagcttgccgacgacgagggaggctgcgccgccctggttgcgggaaccgccgcgctggctgtgctcctctcactcgcctcccgatccctggcggggttccccgtcgccgttgccgtggtggggtcgtcggtcccggcgtggtggtcatccaagaaacgggagaggcgacgcgagctctcgcgggcgatgccaggggtgttcaggacgctcgcgatggcgatggggtcgggggagaccctctcgcaggcggtgtcctacctcgggagccacgagcgcggggcggcgggcgaggcgttctcgcgcgcgtcgctcaggctgagctgcggcgagtcggtggaggaggtcatggcgaccctccccagggagctcgacgccccgggggtcgcccttctcgccacctcgcttgcgatctctcagcgaacggggagtccgctcaggggactctttgagtactccgcgcgactggtcgagaggcagggggagttcgagcgcctcctgatggtgaagaccgcccaggtgaggttgtcggtgcgcatcgtctgcgccatgcccatcgccatgatcctcacgctctcgctcatatcccctgactttcagagggggctcacgcaacccgttggaatcgcctcggtagcgatcgccgccctcatggacctcgcggcgctcgccataatccggcggctcatgaggggtgtcctgtgatgggggccatggaagcgtgcctggcgaccgcggcggcgggttccgtgttcctggggacgatgggactcacctcggggcacgcccgtcgcgtacgggagactacccccggctggatgtccgggattgccgagtcggcggcgacgattcccgtcgtcagggagtcgaggcggcgtgcggagctcgacaggaggcgttccgcgtgcctgcgcgagctgccagggctcatcgacgtcctgacgctcggcctcatggcggggctctcgtttgacgcctcgctcgagctgtacctctcgcgttacgacactgagctttcggctgcctttggcgaggcgatgacctcatggcgcatggggatctccggcaggggcgaggcgctggaggcgctcgcggggcagatgggggtctcggcgctggggagctttgcctcgatcgtgtctcaggcgctcgagtttggctctccgctcgcggacgcgctcgaggcgcaggcacaggtgatccgtgacgagcagaggtccgagttggaggaggagatcgagcgcgttccggtgaagatgctcgtccctctggggacgctcatcgtcccggcgatgctcctcgcaattctgggcccgctcctcagctcgtcgctggggacggtctagccggaggcgacatcggtgcggatgaaaggagagggaatgggagaggaacggtgcggggttcgaaggagggccgtcgcgctgctgcgcgactgcagcgggcaggggaccacggagtacgcgatcctggtgggcgttctcgtggtcatcgcgatcgtcgccatcatcgcgttcaaggggaaggtccaggagctctggaccgccatcgcggacggcatgaacagcctctgagggttgtcgtgatcccgctctgcctcgctgccctcatcgccctcccctctgccgtggggagggtgcaggtggaacgggcggatggaggggagagcgggacggcgggggcgccgtcggacgcgggggacgagggctcatggcccacgagccacggaggcgcggggcacgacggaacgcctctcccacacggcagggacgtccccttcccccttcccgtggagcagagcgcggctgagctgctcgcagagtacgagtgcctggggacgtgtgcgctcgtgcgtgccggatacctcgacctgctaggggaggtctggtgctgcgtggtgcagggagacggttgggtcgacgtctgcgaggtgcgccccgcggagggcggcgggagcctggtcaccaggagaaggctcgactcgcgcgagtgggcggagcgatgcccggttgggaggacggatggctaggggagacgggaggggcgatcttgatgggacacgagcctccctgcgcctgctgtggtcgcagggagggcagtcgacgctcgagtacgcgctcgtgctggggtcgctgctcgcgtccgtcctcgctctcgcctcggtgtggcgggcgggcggcgacgggagcttgcagcgcgttgccctcgaggcggcctcacacgtcttgggggctggcggctcgcaggggctgcgtgacgtcctcctgttctagtgagaggggctcgtcgctcgggcagtcgagcgtggaggcggcggttctccttcccgccctcatgctcgccatcgcgctcctcctggagcccgcctgccttctctacacgcgggcggtcatgctctccgccgcgtcagagaccgcccgcgcgattctcaccgactacgacggggagttggaagactgcagggagttcgcgctgcgtcggctcgcggcggtgcccgagatccccctcctccacgttggggggagggcggactgggaggtgtccccatcgctcgatggcgggagggcgagcgtccagataagggggcatgcgagacccctcccgctcatgggggcgatgggcgccctttcggggatgtgcgacggggagggggtggtcctgtccgtcagggtcgaggaggacctgcggccaggctggttgggagggacgtatgaggagtggcaggagatgtggggatagggaaggagccgcgcgccctcgcggcaggcttgggctcgggaccttcctggacgacgagggagggtacaccacggtggcggtcgcggtggctctgctcatgagcctcgtcctgacgtttggaaccgccgcggcggcgtggagcctgtctcgctcggcagacgtccaggaggtcgcagacgcagtcgcgctggccggctccaacgtggtggcgggatacgcgaccgtcgcgcaggtgatggacgcctgcgtcctgagcatggggctgctggggagcatggtgtgcgccgtcggtctggtcgtcgccgcgatcccggtggtgagcaaggctgcgccggcgatccttcgggaggggaggaagatcctcgacgcgaggaagtcgttcgcgcgctcgtctgcgcgcgggctccagcgcctcgagagggcgatcccctccctcgttatggcgaactccgcctcgtgcgcgagggcgagctcggcgggtggcatcccctactcgggcgtggcggtcccgctcccgcgacaggggaagtcggacttctcctcgctggacgatgggctggggggagaggagcttgagcggcgcggccagaggatcgccgaggcgtctgcgagaaagcgcgatgccgacgagcgcgcgttgagggagcgtgagagggcgtggcgcgcggacaacgtggacgacccgctctgcatgcggagcagggctgcctcgctggccggactccccgcggcgcagaaccccgcctacccgtcaccggaggcatgggagttcgagtactcccgggtgagggcgtgcaactactacctggcacgctgggaggcggagccgtgtgccggcaacggtcccgacgagctgcagcgctcgtgcgcccgcaaggagttctatcggtacgcgcaccagaagatctcgaaggcgacctgcgttgacggaccggacgaggtcaagatcgacctccccgagctcccgcacaaccgcgacttggtgagggggaccgagctctacaccgacgtggtctggccctgcacgctcgaggagggtgggataacgctgcactgctcgctcttgtgtcccggagccacgggtccttccgcgggcaatgcctcactcgcggaggaggagggcggcggggtgctgaggtgcggggtgtgcaagatggacgccaaggcgatgggcaacgttgcaaacgccagcaccaacatccccaacgggttcgagcactactggaggatcgtcgtggaggcgtcccgctcctaccagagggcgcgcgaggagtccatcgccgcggagcgggacatgcgcgacgcagcagaggaggggagggggacgtttcgcacggccatcgacctgctgtcggtcccgcgccccaggctcgtgccacccggggcgtacggatgcgtctcggtcgtgcggcgcggggcttccgtcccggtcccctcggagctcaccgcggcgttcctctcccaggccgagctgcccgagggctgcgccatcgcgggggcgaccctcgcgccagacgactccaccgacgggagcgacgtcctctcctcggtgtacgagggggtcacgcggggacgcggcggcctcgtgctggacttcgccggagacgtggtcggtgcatggggcaggctgctcgtctcgtatggctcgtcctacgagtccgcgtcgcgcgtcgccgaggacatgctcgatggcatcggtcccgtctttggcgagagggtcgcctcgtggctcaggtccgagctctccgcggccgttcgcgatgcagggttcgagccggcggacatgcgggtcaggaagccggtgctggtcaacagccaagaggtgatggacagggcgggtctcgcaaagggcgagcaggtcaggagggcaatcgagtcgattccggcaagcccgggcgagctcgaggagaggatggaggcagaggtgaggtccatgctcggggagggcgaggtcgtcctggcggaggtgcccatccccggcatgggggagagtggcgtccccctcgtcctcgacctctccaccctcgggggcgcggcatgagggggctggctgcgggctcctcgccgggtaggcgtgacgcattcggcgagtcgggccagatgactgtggagatggcggtcctcatgccagtcacgatcgtggtggcgctggttgcctacaaccttgtccggttcgtcggtgcctgcgcgttgttcgaccgtgccgcagcagactgcgtcatcgcccatggcgtctctccctccgagggcgggggagacgggccagacgtcgagtcggtgcgggcggcgctcgagggagcgctcccaagcgagtcctgcgaggtgtcggttgaggcggagggatccggttccactgcgtctccgtcgggggcggtgacgtttcccctctccccctcgctcacgaccttcacctgcacgctgagatatcggccgtggccgtcgtcattcgtccttgcgggcgtggggttctcgcccccgctcgcgctcgtgcacgagcgttccgtcgtcgttgactgtcacagaccgggggtggtggtgtagatggcatgcgagggttgggccctggacgtcgtcgacctgggaggcaggagggtcgggaggttctgggtcaggggaggcgtcgtggggaggctgagagggctcctgggcacgggggacgacgcggaccccatcgccctcctggggtgcggctcgatccacacccatgggatgaggtattccatcgacgtcgcgttcgtgtccggggacggaagggtgctgctcgctgcgaggggcgtcttgcccggaaacgtcgtcagctgtcccggcgcccggacggtgctggagcgaccgagccgcgatgggtggtggccagtcgtcggcgacgtagtcgagctgcgcctgctgagggggagcagagtcggagggtccgtccctctcgcctgtcccgagtcctgtggaagggagtgagatggagaccaagacctgcccgtgctgcgggatggagctgttctccgacatggacgtgtgctatggctgcatgtacgacttcaccagggagccggcgggcgagcctgcccccgatcccctggcgatggacctggacgagccggacatcccacggcctcccgatccggtcccgggtgccgtgggcgttgtgggtgacaccctcgtgctgggggaggggtgccggcttcctccgcggggcatgtcgatcggactccgcggcaacgacctcgaagtgacgattcccttgccagacggagggatcacggtggggagcctcccggcaaacgacgtagtcctccattcgagggcggtcgcggggcggcagctgcgcatctccccctgccttggtggtgcgctcgtggaggacgggggctcggagaacccggcgacgctcagggggaggtacgtgtcgtctctcgccaagatgacccccggcgacgtgctggatgtgtgcgggaccaagatcacgctcgtgtgcccgcccgtggcgtgacggctgcggcgtcgcacgggggcctctggtagacttttgtgtgcatgcgaataggccctgcgatgcgtggacgacgaagcgctcgcacccggaagggagcggttatgaccctgcaacctgcgattagaaggctgcgtcccgcgttcgccgccctcatcgcgatgaccctggccctcgtcctgctcccatccctggcgtgggcggacggcgactactccatagacagcgtcgacatcgacgcgacggtcgcctctgacgggtccgtctcggtgagggagacccgcgagttcaactttgacggctcgttccacggggtgtactgggacatcccgacgggggacgaggactcggggatagggaccaccatcggccaggtgggcctgcaggagggggaccagttcatcccgttcgccgagtcgggcagcggagaggacggcacgtacaccgtcacccacgaggacggctacctcgaggtcaagatctactccgcccacgaggacgagtcggcgagcttcacggtcaactacaccgacaccaacctcgccaccaggtgggaggacactggcgagctctactggaagttcgtctcggatggatggcaggtggagtcgcagaacgtcacctgctccatccaccttcccgttccctccggcaccacggtggtccctggcagcaacgtcagggcatgggggcacggcccgctggacgcctacgtggatgtgggcaccacggggacggttacctacagcgttcccggggtggggacctccgagtatgccgaggtgcgcatcgtattcccgcaggaatggctctcgcaggaggccgtcacccagcaaaagaggctcgacacggtcctctccgaggagcagcagtgggcggacgaggcaaacgcacagcgcgagcgtgcccgactcatgggctacgtcgccctcgcggtcttcgtggctgccggggtggcctccgtcgtggtggcggtccttcgcaggaggaagtacgtccgtgaccacaccgcgcagttcgacgacaagtacttccgcgacgtgcccaccaaggaccatcctgcggttctgggtgcgcttctcaatgggggaaagcccacgcaggacgacttcacggcatccctcatgcgcttgagcgaccttggcctggtcaagctcgagcaggtcaagctcacgaagaagcggattctgctgggcgagaagaccgtggacgactatcgcctcacccgtctcgatggccccgcaagggagcaggtggacaagaagtccgcccggattgacgacgcggtgctcgacttcctcttcgagaccgtcgcatccaacgtggacggggcaaagccgcactcggacgagctctacttctccgatatcgaatcggttgccaaggataatcccgaactcttctcggagaagtacacggactgggaggacaccgtcgagggcgttgcgattcagcgtgggttctacatcgatcccaaggcaacgagcaagactccctgcatcgccctgttcgtcctggacgcgttgctcgccatcatcgacttcttcctcatggtgatcgagaccgtgaccgttggggtggggatgatctcgctgctggccctcgcggtcggtgccattgcgtcgatactcgccataaaggggatgaaggatctctcccccgaggcaattgagacaaccgccaagctcgaggccctgcgcaggtggctcaaggacttcacccggctggaggaggccgtgcccagggacgtggtcttgtggaaccgcctcctggtgatggccgtggtcctgggggtcgccgacgaggtcgtgaagcagctcaaggtcgcggttcccgaggtcgtgagcgaccccggcttcatgcccgtgtatgggtggtactactacagcccgtccatcgggacgcccgcgacggtctttgccaacgccgcggcttccgctcacaaggtcaccgcggctgccctctccgagtcgtccaatagctcgggcggcggctttggcggagggttctccggcggtggcggcggaggctttggcggcggaggcggaggaggtgccttctgatgcgagggatagtgagcatcggcgacgtcgtggagatgaacaaggttctccagggccaggggatacccgcctacgtccatctccatgacacgtgtgggagccagttctttaccttcggccctccaaaggggagtgacatccaggaggtgtcggagcagtccctcgaggcagcccgggagaaggtgggggagttcctctccttcaagggaataagggccgagttttccgaagacggcaagtcgttctggactgtatgaccctgataccggggggcggtgcgtcgaaggcagtttgttgggtgagaagaaaaatctagaatctggttgacgcccctcgaatctttgttatattaaacaagcttgctttgcaggcacttcggctgggtagctcagttggtagagcaggggactgaaaatccccgtgtcaggggttcgattcccttccccgccaccagaaagtcgcaggtcaggggccatgtcctctggcctgcttttctatgtgcgcgatggtgtgcgcgatatgtgcgcgatggtgcaaccttagattgcaaaagccccgttggccggtgtgcgcgtggccacaccccacaccgggcaagcccccgtgttgagtagacactccctaggttgagattggccacgcgaagcggcgtcaagcctatcggccctctggctcggcagcccctcgcccgccacgatgagcaaaagccgcgcggcaaaagcaccccaccaacgccatacagtctagattgaacaggtagaacgccgccaaacgtgctgagacgggatttaaggccatgttttagcgcatacgataaacaaccaatcggcagatgaacactggattagaaaggctctcgcagcgtctgctccatcgtgcgccggttctggcgctccgaatggcaggtgccaagccaacgacgccccacaaccgccacgcccgtgcgcgcgattacgcggaactaggcatatcggctatgtaatatccagatatcagtaacttctctgctatttcatgcatcggggggggagggggggggagaaaggccctaagctgccgggggcctccaccacgcaaaaagaccccccagggcctcccagggggtcgcgctcggcgttccggctgcttctcacatcttcttcagcgtgacgagtgcgctctcgtatgccttgagcaaggcaaagtatcttgtatctcgccgcgtgcacaacctgaggtcgttctccatggtggctatctcctgcgccaacggcctgagcagtctccgtttccgtttatcgcgttgggcttcctcgtcgcccaagtcccatgactccctacaaagcccgcagctgtctaatatccctaccgcgcgcgtggggacccagccgcacgtgtccgttgattgctcgttcgactccatcaaatcgtcctccatgtctgcctctctcgaaatgtccaacaccacctgcgccacgaccgcaaccgtcaccaggcgtgcccttagccactccggcgtgcggcgtcatggcggcatgccatcccacagaaaaaaatgcgccgtcgctcggaatccggggcttgggcgccgttcggggcggttcgagcggtgagggggtttggggcctcggggcgtggcatcccacacgcggcgtgcctccccccggctcgcgcgtacgaacgaacgaccggcgctaaagagtgtgtgtacgtacgttcgtcgggcgggacgtacgaacgaacggtagccccctataggggtgctcgtccgttcgccgcccgcctactgcccctcgcccccggactcgtccggaacgaccacacctccctccgtgtggaacgggaggctcgtgcagcccggcttcagccagttgcggatggtccccagccccacccccttgcccagcccgctctcgccgtggtgggcggcgtagtaggcggacacgtactcgggcgtgggcgacgcgccctccctcgcggcctcctctagcgccgcgccaaccagctcggctttcgccgcccaatcctgctcggcgcgctcccggttgctccgcgtgctgtgagcgccgtttgcctgtgggcttccgctgacgtagtagcgtgacagtcgccgctcgctgtcgggaacgatgcgcggcccgccaaacaggaagtcgatgctgtccccgtcgctctccacgttgcgcagcacgtaggacaggcggcgcgggtacagcttttccgtctcggcctggccaacgaactcgtcatcctcgtccgcgtccaggtagtccaggctaaaaatgttgtcaacgtaccttgacaggacgccggaacccgccccacggtcagcgacagacttctgcccgctagcgccctttgcttggtggtggactatccagacccccgaacacctgccttcctcaatcagccggtcgaagtcgcgcacgatgggctgcatggtggaggcggcgttctcgtcctgcccggccagcagcatgtaaaggcagtcgatgattacgaagtcgcccggcttgacctgcctgagcaggtcgttgactgcatccctagacgtttgggagatgccaagcgcctccctcttgggaagccaccggatgtggtccgccgccccctcgccccagtccccggcgcggcggattcggtcgaaccgctcccgcagcctgtcatccttgatttcgaggttgaggtagaagacggtacccggtctcctgccgacctggtgcccaaggaaccgcgccccgctcgccagggcgaacgccaggtacattgagagccacgacttgcccgccttcgatgcgccatagatgattgacttctcgccgtagccaagcagcccgtcgatgaggtccggctccggctccggcaggttggccccgatgtagtccgatagcaccagccagccacgcctctcgtccacgcgctcgcaagccgcgtgctcgtcaacgtacctcgtccaggcatcgaacgtgcatttcgtggggtcgttggccccaagaaaggtctgctgcccgtcgccgcgcgtggcccccggtagccgcgtgagcctgagagcgtccttgttgttggtgtccacgttgaagccgttcgcgcggcacacgcccatgaggtattcgaccctcgcgcggtactgctcgggtccgtccgcgtcgactcggcagattaagtgcaaggacttgccgccgctccacacagccgccacggcgggtagcctgaggcgtgtggccatctcggcctgagcctcaagagtcatcgggctgccgtcctcggcctcgtccgcctcgattagcgcgtacctgtaagacgccgcaatgtcggccttgcgcccacgctcccggaacccctcggggtccacctcgttcacggtcacccacgcgcccgcgcttctgtcgacgcgccccagcgggtcgcccgcacggtcgatgaggtcacccacgcgccacagctcgcccctgccgattggtgacggcttggcgggattcctcggattcggcccgcccttgaggtacagaactacgtacgtatcctccccgtggagcgcccgcatgtaccgcctcagctgctcggcggggtcgagtttcgcaaactcggagagcgagggtaccgttccgcccgcctccggcagaaccagcctcgggaactcctcgcggagctgcgtggcgcgtcgtggtgcgtgtaatgggcggatgcccgcgcttcccctccacccacactcgcgcgccatggcgaaaagcgtcttctcggtcacgccgcccggcttgctggggtctacgctgtcccaccggcgcaggttctcgcgttcgtcgtacctctcccggtcgcgcctgcaccaggcgtcccagtcctcaaaggcgacgccagccgacttggccgccatagttagtttgagccagccatcctgcgtcaggtcgctggggttgatggacttgagcgcagacagcgcctcgtcggggtcgtgtgtcttgccgtatgccatggcctcgccgccagctagtccgcgataccgaactgcctgagcagcgcggcggtgtcgatgcgccagcgacgcccgaacttgaccgccttgatttcgccgcgaacgcatgagtcgcttatgaaatggggcgaatagcccgtgagggctgccgcctgctgcacggtgcagagcgcgggcagtgttgccgtctccctgcctgtcgtggtcccgttgagaacatccatttggtcgactccttccccccgcgcgttgcggggtctagatggttggagccgtgcgcacggcctggggcgctctcttgtgcgtcccctcgccgtgcattgtgcttcattgggtttgcgcagttcaaacggcataactccggcaatagcaccacgggggcgcgcgatgcggcggcgtcggtggtgccacaatcgggaaaatcgcgcgtggggtgggcgtggtgcctgcccgcggcgctcttccatggggccagaaaaaacatttgggttttttgaattaggacggactcaggccagcgtgtccatggcgtctctggtctcggcgtcgattcgtgccagcagggcgtcgaacttatcctggttcgccgtcttggatgcgtattccagctccaccctaacgacggccagcgggtcgcggtagtcgcccctgaggcccagcaggtcgcgcctcagccattccgccgcattctcgcggaaccacctctcccaggcgtcatagccgtccagcgcggcctcgccctcgggggtaaagtcaccggtttcggggtcgcaggatgggcagccaagttcttgccaccacctttcgcgcagctcccacacgtcatggcaagtgcggacaaagcacttgtggccctgcgcgtcagtaaggcgccatgtctctatccctgcttctaaaaatgtaggtaacccgtcctcgtcgcaaccgtcaacctcatagtccggcgcggccttctcggggtccttggccttgccccaccactccctgagcgtctcgtattgcttgaatggcttcgcgccgctgccgtccgggctgtccgtgaggtcaagcaggtaccagacggacaccccaagaacgcgcgccgccctcaccaacgcctcgttcggcagccggttggcctttgcgttgttctcgtcgccgcttagccagcgccccagcgtggatggggcaacgctcatgagtgtggcgaactgctcaagcgtgaggcccctggcctgaatcacctttcgcatgttctcatgccccggcgctatgcgcctcgggtcgaggccccccacaccatcggggctgtagtcccccgcgctctttctccccacgaatacccacgacccccaattaatgccttggccgtggtctacaattaccggtagcggtaccgcccccacctgccacggcctgagggcggtaccgctgtattatcgcgcctgcccgctgccggtgtgcgtgagggcgtgcggcccgtccgcgtatccgtccagcgtgctcatcatgaactcgcagaacacggcggagccgccgcagcttttgctttcgcccgcgtacagcatggccatggccgtgccgtgcagaccctccgctatctcgtccgccgttctaacgtccaacgccgaacccctcaactaactccatgaccctgcccctcatgaccgcctgccttccgtcccggttggcctgaacgcctcaacctcgccgtgcctcggggcctcgcccatgaaccgggaaatcttctcagccgccatgcgccgcgcgtcggcgtcgctgctcgcataggtgttgagcgtcatggatgcgtcggcgtggcccatgattgccgacacgctcttgatatctgccccgctctggaccgcgatggtcgcccacgtgtggcgcaggtcgtggaacttcagcgggtgcccgttcgcgtcggtgacccccagcaggtcgcggagctgcccccactctcggctaatcgcgttcggggtcacgtgttggccgtcaagcccgcctatgacgtagcaggatgccagctgctccggcgtgggcagcacgtccagcccctctgcctcggccatgacctcggcccgcctcgcgtccagcgcggccctgagctgtggggtaagcggcacgtctcgcacggagtacgggttcttgggggccttgacgtaagccccgccgtcacccacgccaaccgccttgctcacgtgcagaacgcccgcgtcggcgtctgcgtccgcccacgtgagggcgcacacctcgccaaccctgaggccgcttgtgagggcgatacgcgccgccgctacggcccgcttctgcggcattgccgcgagggttcccagcagcttgttggccgcgtccttggtcatggcgtggggctgctccctgcggttcttgggcagcttcacgccctcgcacgggttcgccgccagctgccccgcctcagcagccgccttgagggcctgtgacagcagccggtggtgcttgatgacggaacgaggggaaagcccatcggcgttgagcagctgggactcccacgcctgaatctgggcggtggtaagctcagtgacccccaccccacccagcgactccgcaatcttgcgtgcgcttgcctcgtagcccgtcatggttgaccgctccacgtgctgagagcttacgagacggcccaagtaggcggtaaggtattcggataccgtgacgcctgacagcgaggtgccacgggcctctgcggcctccgtctcgctttccgccgccagaagctcgccgcgccaacgcgcgagggcggcaattgccgcgttcttgcccctattcgtatgtgattcgctagagattggcttgccgtccaacccctttagcatctttgtaacgttgtggtgtgacccgtccgggtcggttcgggtcaactggccgcgccaccttccgcgatacttcatcaccgttccagcgctgtatgtgcttgccattccaacccctccccgcaatgtgcgcgatggtgtgcgcgatatgtgcgcgatggtgcgtgggttgagtatatccaccaagaacagcggaacgcaattgagaacttaaagatgcaggtagacagcatagtttgcagcagagaaaggcgttggagttcaaccgaagacgcacagcaaatggttctgaaaatccccgtgtcaggggttcgattcccttccccgccaccagaaaagcgcaggtcaggggctgtgtcctctggcctgcttttctttagagcggacgtcggccacggactctgtaggcaccgtcggacttgcgcgtatcagagacgtactcgtcccacagctcctgcagagataggccaaggtagtcggcgattaccttggcgcggtctaccgtcggcatgtgtatctcgcgcgaggacacgagcctcgaaatataggattttccgaacctcgagtagttggccagcccctgctgggtcaggcccctcgccctcaacaatcttagaaccgtcgggccgaagtccaggtcctccctgtcgtacacgaaggcacctcccaactcatcccaaacgtagcacctctcaccaattaacgtgcgttactcatagcgcattgtcacccttccccggcacggcaggcggaagatcgtggagtcgaagttctgtcccaggtactgcttgccgagcgcaaggagcatggagcggtcgccgtcgagcgcggcagagcacctgcacgttgtccgggtcgaggcacgccctgcgcctcagctcctccgggagcctggacacgggcacaatctcgtcgagctcggcggagttggggaggtacgggtggtcccagtcgagtgtcgccccgcaaacggggcagcgctcgtacatgccctgagcctcgccctcagcttcctcctggcgttgccgttggcgtatcgggggtttggctccgcgtcgggacatggctctgaccccccaacatgaaccggagtcgcgcggactccgccgcgcgaccgagcggagcgagggttcatgttaccccctccagggcacatgctccgagtctaccttatacacccgaaacgcggtctcatccagtgtcatcgcatctcatttgatgtcattcgatgtcaactttcccaggccggcacgcgtctgcgtgtggtcatggcctccacggaagtccccgtggcggccgggttgcgctcgggcgggggagtcttggaggggaggtgtggcgcgcacgctgccgaagacggccccgtcggcacgccgcacgtcgccgtgcccctcgggaggcgcacgatgatggcggcggcctgcggatttccccggttcgcgcttgacttttcgcctcgggggagattggcactatgccgcggtggtcgccgtgggccagggggatggtacccccccagggtatgtcgacgtgccgtaaataattaatattccttatgcaaaccgatatttaaagcaaaaaacatttatcaagcgcaaagactcgccaaggcatgcgcgtaacgcgcaaacgtaaccaaaggctaactctctccactctccccatgcgcccccacccgtcccccatggggcaagcggtaccaatgcgctagctagtagcgccatgtacctatgcgcacaaagaaagaggcgcacggccccgtagccacgcgcccactctctctctagtcctcgcgcttgactctgtgcggcgggtcaatcgatgctactacctcacccgtctcgcggtctaccaacttcacatcaaccccgcaaacatccgcaatgtctgcaacggtatccaacaggggcctagtgtgattaacacttgaattccttgcccattctggagactttcccaaagcgctagagactttccagtaagcgagtccagaacgtctaataagaaattcaagcacgtccttagaattcatgcgtccccttttctataacccctttcacctgcgaaaacattctatcagacgcactaaatatatatgtagccacaagtgtaattgtgaagagccacaaacaagcttgccacaaacctaagtgtgcgcactatgtaatcgcgccgagggaaagcatccgacgcaaggaagcaaaaccccggaccttaaaagccgaatacacaccccaccaacgtcgcggcgacaaaaaccggagagctgaaaaaggcgttcgatagcgcggggaagcaccaacgcatgcaagcacggctagaaacgctccaccgaatacaggggtgaccgtctccgaacccgggtgaggagaagaaagatgaaagagcttaacgagattctgcaaactctgattcttactgcccagcttgttaccaaagtcctatagaacgcaagggcgattgtggactctagaaaaacaagaaagcccccacgtccatgacgtaagggcttttctccgtcctaaccatttctgattagggttcggggacggggccaaatccgtccgcctatctcgcattgtaccgccaacgaagcaagacaacaagaaaggggagtttcaatgtctaccaagagctcaagggtgtgggagtcccgcaaccgcaacgctcataagcttgcgaaatgtctatgtctcttaagtctctctagccctcgcccgcgccgtccgggtcgcgccgcgtcccgtctatgtctatcgtctccccacgccccaccagctgtagacgatagccgcatgcgtgcgcgaggtctgctagcacgcccgaggccacgtcaccatctctacgaataagaacagaaacataagattgtgctctaccagcggctctagagaccccataaccaccaagaccagatcttttgaccatgtgtctgactgcatccgtggcgtccactttacccccttttatctgcagaaactctaataaccagtctatcacatagagaatcgctaaccattgtttgtgtaggaattgtgaatgcgcgaatccccgcccgcgctaactatgagtagccgacattatcttaggcgtcaagcgcgaacagctattagtgcaacgacaaggaatcaaaaccccgaaccttaaaagctaatacacaccccgccaacatcgcggcgacaaaaaccggaaagctgaaaaaggcgttcgatagcgtggggaagcaccaacgcatacaagcacggctagaaacgctccgccgaatacaggcggggcgggcgatgcaatgcgaggtaggcgggcgtgaccgtctccgaacccgggcgaggagacggcagatgaaagagctaaacgagatccttcagactcttaatctaacaacccaacttgtaaccatggttctaaagctcattagggcgattagggacctgcgaacaacaagaaagcccccgcgcgaataacgcaggggcttctacccaacccaatcaatagacattgaacgggttcggggacggggccaaatccgtccgcctatctcgcattgtaccgccaacgaagcaagacaacaagagaggggagtttcaatgtctaccaagagctcgagggtgtgggagtcccgcaaccgcaacgctcataagcttgcgaagatgggggacggcaacgaggaaaaggcgatgagtctcattcttcgaacgattcgctacgcactgtcagctgttcaggagcaggaggctgagaattcaagcgaacagcactccaagtctcgtgaggcaaagcaaagggtgaagttcctcgaatcgcgtcgcgcgaacctggagtgtgagtggaacgagtacgggttgaccatggtgaactatgggccttacccgacaataaatgacctgttgagcgggacccaagacgttatccatctagcctactttgactgaggggctcggaatggggttcggtcgggatggcacccttcagatgatgtaattcactactgccagcattggggtgcttaatcttcctaggtctcgtgggatttgacctcgcggtgcttagctgtcctaggcctcatgctggtttttcgatgcccgactcacacgagggctaggaggattaagcatttggccttcaaatccccatgagggctagtggcgctaagcagaacgtgcggaaatccgcgtgagggctagcgggattaagcatcggcacccccacccgcaggtttaccggttcggcaccgtttccggtgctgccatttgcgcgggcgccgacgcaggtggccccgtccctctcaccctcgaaataaggggaggccgactgtccctactggccagtgcaccctagaacctcacgcggaagtccacgctcgcgggatcgggctcgatctcggacttctcgtcgatgcggtagtcaatgggaaagcgcgagtacgtctgttgaaagttgccgaagaagttcgcaatctggtcgtcggtgccctgcagctccatcgagacgctcccgtcgggctcgtttctcacccaccccgtgcatcccgagcggtcggcgacacgctgcgaggtccagcggaagccaacgccctgcacctggcccacaaagcggagcgaaagccggcgggtccccgttgggagctcgcgtgcctcgcccttctcacctgtatcgtcgcgcttcatgccaaacacaccaacacccccagctgggttagaacgcctcctttacgcgtacaatacccaaagaagctcagtaacccacgatggcggaggaaatccaatgcccgcaaagttcaacctgctctgtgactccacgtgcgatttctcgcaggagctcatggacaagtgggggctcaggtacgccccgttcacctacgttgaggctgacaagcccgatggcggcttccatggggtggacgacctcttccagtcccgctccccgcacgacttctacgagaacattcgctggggcgcagcgcccctcacctcccagccctcccaggctgagtacgacaagctctttagggaggcattggagacgggcctgccctcggtcatggtgtgcatctcaaccgggatctcgggcggctacaacggcgcctgcacggccctcgaccgcctgaaggaggagcgcggggaggacgtccctatctacgtggttgactcgctcctggcgtctacgtcgctcttcctcctgatgcaggaggccgtgaagcagcgcgacaagggcctctccgccgaggagttcgtgcgctggatcgaggacgcccgctaccacgtgcagaccatctttatggtggataacctggacaccctgcatcacggcgggcgcatccccaagtcggtcgccctggtctccggtgcgctggacgccaagccgctcctgtcctggaagctcgacggcggccttaccatcatcggtgtcacccgcgggcgcaagaaggccatgaagaagatggtcgactactatgagaagaaccactccaacgcgcagtaccctgcaatcgcctgcattggcaacgcggattgcgaccacgacgggatgcgcctgggggcaatgctggccgacctggacgactccatcgagatcatgacctccaacatcggtccgaccatcggttgccacgttggccctggcatgctctcgtgcgtcttctggggagaggaccgcaggtcgaagaagtccttctccgggaaggtccgcggaatccgccaggcctagcccggcagcgaagggggtagcagaggcatgaacctcacaagaagggaatttgtcaccgcttcgtcaatcatggcggcccttgggcttgcgggatgctcccgcgcggctaccggtggcggcagcagcagcgactcgtcgcccgacagcaaggcctcgtcggtcgacctcaaggagtttgagtcccttgccctggacggcgacgcctggaagtatgacaaggagaacgactgctactaccagcttgggctcaagtactgcctcaagcccggcagcacatcgtacgagtcgctcgccatctttgttcccggcgggtactttgagggcaagaagaaggggagctcctacacctgcacggtgaaggaggatgccaaggtgggcaacttcacctcttccacggcccccgtcctcatgcccatcaactcccttcgcttgagcccgcaatcgtgccccacctcgtatgcctacaacgggctgtcacgctacctctcggcggggtgcgtgtacgtgtactccggtttccgcggccgctcgagcagctacgagagcgactcgagcaagctggtcgcgggtggcgcgccctggccggcggtggacctcaaggcggcggtgcgctacatccgctacaacaagaagagccttcccatcgatgcggagaggatcttcacctttggctacggagccggcggcgggctgagcgccgtgatgggctccatgggcgactccccgctgtttgacaagtacctggacgagatcggtgccatcacgcacgacgtggacggcaaggacgtctcggacgccatctttgggtcggcttcctggtgtccgatcacctcgtacgacacgattgacagctcgtacgagtggatgatggggcagttctcgagcgacgacgcgcgagcggacggcacctggaccgcccagttctccaaggacctcgccaacgcgtacggggactacgtcaaccagatggatctgcgcgacaaggacggcaacagcctgaccctggaccccgtggaggatggaacgtaccttgcggggacctactacgacaaggtcctctcgatcgtagagggtgccgcgaccgacttcttcaacgatacgtcgttccccttcacctacaccccgtcgcgcatgtccgacccatgcttccccggcgaccccaacttcgaagcctcggcgtcggaggagatcgatgccgtgaccgggggcaccgacgccaacgcgaccgccaccgaccagtctgcctccggcacggaggacgggacccagggtgccaactcgtccacgggggtctcgaaggtccagtcgacggtctacgactccgcctcctcgtacatctcggcgctcaacggggatgaccgctggctctcgtacagctcatcggcgcagagcgcgcgcgttaacgacctctggaactacgtggagcactgccgcaaggcggagaagtcggtctgcgcatttgacgcgctcgaccgctccaacaccaccaaccagctctttggcattggtgacgagagcacgctccactttgacgccacggcaagcgacctgctcgacaagaaccaggacacctatgccaagctctcaaactggaaggcggactacgtcagcgactggaagaacgacctcgcgaagaaggactccgaggaccagacggtgaccgaccgcgtaaacgcaatgaacccgctttacacgctgagcggccactacgacggctttgggaaggcgaccgtcgcaccccactggcgcgtgaacacgggcctgttccagtccgagaactcccttgcaaacgagctcaacctggcaagcgcgctcgtgaactacgacggggtcaaggacctctcgttcacggcggtgtgggcaaaggggttcgagctcgccgagaagtcggggaacgcgcaggacaacctcatcacgtgggtcgaaggctgctgcaaataggggagagaggaacgacaaaacgaaataggctacgacacacagttgcctaacacaagggttattcgataaaatgtgtgaactttgcttcctccgtggtagacttgttttagttgacacggagggagtgttggtatatgtacgaggttggagactacatcgtccatcctggccagggcgtctgcaaggtggacgagatcgtggacgggcccaacgagtcctacatgctcatgaccgtaggcggtcgccaccccatgcgcatcagctacccggtctcgggcgaggggcgcctgcgtcccgtcctctcccagaacgaggcggagaagatcatcgacgagtatcccagcatgtccgtcgaggactttagctgcaagagcaacgcgctcgaggagcagcactttaaggacgagatgcgccatggcacctgccgtgactccgtccgcatcgtcaagaccttccgcgtgaggatcgaccagatgagggcccgcaacaagaagccgccggtggcctacgagcgcattctcaagcaagccagccagcgctcgctcgaggagctctcggtcgccctcggcgtcagcgtcgaggacgtgcagcagctcttcaaggcacaggagggcgagaggcccgaggacaactagtaggatcccatcccgtcggctgcggcgggcgagaggccccttcctgcggcgcgtcacgttgcaagcgtggcgcgccgctcgtctctcccgtcaccgaggtttcaaaatgggcaactgggccctcataattggttgaggccttttctcctgggttaccatggagggaaggcgtcttttatgccttgacccgcaaacggcgaagggaactgctgtggcaaccacgaacgacgactccaagacgcgtgccatcatcactgtcctgggcagcgaccgaccgggcatcgtcgccgcggtcacatccgccctcgcggggcacgacgccaacatcctggacatctcgcagacgatcctgcagggcatcttcaccatgaccatgctggtggacctcgccggctccagcgccgacttctccgccatccaggaccagctcgcccagatctcgtccgagcttggcgtgcagatcaccatgcagcgcgaagaggtcttcaacttcatgtatcgcctctagggaggcaggcgcagggcgcacgcccccaggcgcaaggagactccctcccgcacgggggaggagggcaatcgcctgaccccgggtctctcgcccggtaagcaaaggcaccctgccgctcccgtgacccgaaggaggacaatgaccataggagacaagcccataggtcgcaccaagcggcgcttcctcacgccaaaggacacctctgccttcacgcacattgcggacgtctaccccatgccgtccgtgggcatgggtcgtccgcccgtgtctgacaccctgtacgagggcatgcagcgcgtggaccgcgtgcccgacgagctgtacacgcgctacgacgtcaagcgtggcctgcgcaacgccgacgggacgggtgtcctggttggcctcacgaccatctcaaacgtgcaaggctacaagaaggtggacggcaaggtggtccccgacaggggagacctcacctatcgcgggtacagcatcgccgacctggtggcggggtgccacggcgagggtcgctttggttatgaggaggtctcgtatctgctgctcacgggcgctctgccaacggcggaggagctcgtggacttcaaggagcgcatcggctccaggcgacagctccccgagggttacctgggactcttcccgcgcgtgacgtacagcacctcgattatgaacgtcctgcagcgcgcgacgctgcttctatacgcgttcgacccaaaccccgacgacacctcgcccacgcacgagatcgacgtggccctttcgctccttggtcgctggccgcgcgtggcgagcgttgcacaccaggcaaacgaggccgccaaaaaccgcgagcgcgtgaaggttccgcccgcgcaggagggctacaccatggccgagacggtcctggacgtcctgaggggcgaccagggcttcacgcgtgacgaggccatgatgctcgacgtgatgctcatgctccacgcggagcacggcggcggaaacaactccacgtttacctgtcgcgttctctcgtcctcgggaacggacgcctacagcgcctacgccgcggccctcggctcgctcaaggggcccaagcacggtggcgccaacgccaaggcgggcgagatgatcgacgactgcgctgccaacgtcagcgattggtcgagcgacgaccaggtggctgactatctcaccaaggtcctcaacaagcaggcctttgaccgctctggcctgatctacgggctcggccatgccgtctacaccatcaccgacccccgcgccgagatcgtgaagggctacgcccgcaagctcgcgcgcgagaagggccaggaggacaagctcgacctcatcgagcgcgtggagcggctgggcccccaggtcatgcgcgacgtcaggggcatcacaaagcccatcagcactaacatcgacatgtacaccggcttcgtgtactccatgctaggcatcccaaaggacctctacacgcccatcttcgcgattgcgcgcatgtcgggttgggcggcgcatcgtatggaggagctctacgggcccgcccgcatcatccgacccgcgtacaactcgtacatgacgcaccaggagtacgtccccatcgacgagaggggatagggctgtggcaggcgagagacgcctcgcgttctcggacatggactccaccttcctggcgtccgacaagtcgattcccgccggcaacatgtcggcgctcgatctcctcgcccggcggcgttgggggttcgtgccatgcacggggagggcgctcggggcgatgcctcgggagctcctctcccattcctccgttcaccttgccataagttgcaacggtgcaatggtgagcgacgtgcgtacgggaacctcgctccggcaggcgctgatgggcgaggagcgcacgctcgccctctgggaggcgctgagggatgtcgactgcaccttcgacgtcttcgcggacgggctgtcgatggcggacggcgagcgcttctcgcgcattggccgctatgggatcgacgggcagaacgagcggtggctcagggtcacgaggacggtcctggaccagaggaccgacgacataattcgcaatcacccaaacgtggagaaggtcacgctgtacctgggctccgatgaagcccgtgccgccgtgcgtgcggccgtggcgcgcatccccgggctccgctgcacgagtagccaccccaaaaaccttgaggtgggggacgagcgcgcgaccaagggagaggccctgctgtgggtctgctcgcatgagggagttgacccgcatgacgtcgtcgcctttggtgactctcccaacgacctcccgatgatcgaggcggcaggagacggggtcgcggtggcaaacgccgtgccccaggtcctccgtgccgccgaccacgtgtgcggcacaaacgacgaggcgggcgtgggtgcctatctggaggcccttctcgcctgaccaacccctgatggcggcaagcgccccgtgtgagcactttcgtggacgaacggcagaggactcccgatgtgcgcgctcatatcgggagtcctctgccatgattgcaatgcatatgagagctcaactgggcaaacgcagctggtccccctgccgtgccggtcggagcctgaagcaagtactcacgtcgggattcttctgccagcaggtccgctgagagatggaccagacctgcgaccgggggcggtttctaactgcggaagagctataagagggaaatattgcgacctagcgcatatagagacgcggctggttcatatggacgagcggccagtccattcttagcctattgagtgggatgccccgccatacgccagtgtgccaggggagagacccttccgtaacaaagggcgcggggccgaaacgattggtttcgacctcgcgccgtcgtgtctctccctgatgggggacgtgcctactcctcgccctcctcggtggagtccgacccgtcctcgtcttcgtcctcgtcaatcacgaggggacggaagcttgcggtgtcgccgccaacgacctcgtgctcggtagcctcgatgacctcggagtgctccttgaccatcttgtccgagaagatgtcgccctcgtcctcctccaccacggaggcggcgctgacgggcttcatggagccggtgccggagggctcggtgacgcgcgtgagcctgtgctgacgcttggtcttgccaaacagcggcacgtactcaaagatcaggctggagttctcaaggccataccagcgagcgggcgagccgcaaacgtggcggatggcgtacttgaggttgatcacgttggcgttgccgccgctgatgtcagactcgggggtgagcaccttgcgaatgaggcagaagcggaagtcgcccacgttgccgtggtcacggtagatcgagtacttgtggttctgcggagccagctggtggtgtgccatgaggtcggcgacaatctggtacagataggtgttgacgcgctggttgaccttgaatcccaggcgcagctgaatcttgaacacgaagttggtgccaaagtcgttcacgatgtactcgtgcgtgaacgggtcgttggtcacctggacgttgaggaagtagtacgccttggcgcgcttggggcgcttgtccaggatggagtagaggatgtcgcggtcgagcttgtcgggcgacgagtcgttggtgaggaacaccaggttgtcagcgatgtaggggtagttgtcgtcgtggcttagctgctggagctgatcgatgtacttgctcacgggaaggtacaccgtctgggtgcgctcgatggcggtgccgcggcgccagatgtacatgacgaagaagattgccgttgccatgaggacggtgaagtagccaccgtgcatgaacttggtgagcgacgagaagaagaacattgcttcgatgagcccgaacgtgaccacaaagaggattgcggcaccgtgcttgtgacgaatctgcgagaggtacgtgtagagcagcagcgtggtcatgagcatggtgaccgtgatggccaagccgtaggccgcttccatgtggctggagcgttggaagaacagcaccacgaagatgcaggccacccacatgatgttgttgaccagcgggatgtagatctggccgcgggtctgcgaggggtagttgatcttcatatggggcatgaggtccaggcggatggcctccgagacgatggagtaggagcccgtgatgagcgcctgagacgcgatgatggcggcaaaggtcgagaggatgaccgccagcgcgcggaggttcgcggggatcatctggaagaacgggttgaggtccgccacggtggcgagcgccgcgacgttgcggttggccaggatccaggctccctgccccaggtagttaaggatcaggcacgccttcacgaatggccaggtggcatagatgttggccttgcccacgtggcccatgtcggagtacagtgcctcggcgccggtggtgcacaggaacacgttgcccaagaccatgaggccggcggcgttgatcctgtggtcaaacaggaaagtaaggccgcgcacggggtttagcgcacggaaaacgttgaggttgccgcccacgttgaggagccccgtgatgcccaggtagaggaaccacacggtcatcaccgggccaaagagcctgccgatggtcgaggtgcccgcgcgctgcatgccaaacaggatgcacagaatcacgatcgtgatcacgatcacgatctgctggttgtcaccgatgaccgagtacaccgggccgatggtgcgcaggccctcgatggcggtggtcacggtgacggcaggggtcaggatgccgtcggcgagaagtgcagcgccgccgatcatggcggggacaatcagccacttggcgcagcgcttaaccaggctgtagagggcgaagataccgccctcgttgtggttgtccgccttcatggccaccaggacgtacttcaccgtggttatgagggtgatcgtccagatgagaagggagagcgcgccaattaccgtgtcgtctcccatggtcgtgagcccgccgttgtcggacatgatggccttgagggtgtacattgggctggtgccaatgtccccgtacaccacgcccagcgtgacgaggatcatccccgccgagaggggtatcccggcgctcttcgaccccttgtgggccctgcggccggattccgcagctctgacgttactcatttcgctccttcagtcggatgcgttaagccgtctcgcttgggagggaacgtgttggctccccaacgagaaaagcatagtgcaagtgcagaatcctagcactttaaggcacggtaaaggaggggccctgagcggggcaaattcggcgaatcgaagccactgggcggtggaatacaattatctgacgtttccattgcgagcagttggccaaatgccggcaggcgcaggccagagaggagagcccagatggcagaagacggagagggcgccccgcgcgagcaggcggcatccgcggtgcccagggatgcgttcatgacggttccggctgacgcgcggctcaagacccccgagccagcgagcgcccacctgtcgtgggagggctcaggctcgcatgcaggagagaggatcgactacgtggcaacggcggtccacctcgacgtgcgcggggacaccggggcgctggtgggcaagatgttctcgctctcgtacgtcgccgacggggaggacaccgccgagcgtcccgtcaccttcgcgtacaacggtggcccgggctgcgcctcggtgcccatcaacttcggcggcatcgggcctcgcagggtggtcacggagggctgcgaccacctgggcaccccgatccgcattgaggacaacccctacacgctgctgcgtcagaccgaccttgtgttcctggacgcgctggggacggggtggtcgagcgtggccgagggggcggacacctccaaggtgtttggcgtcgacggcgacgccgacgccttctgccgcgcgatcaccacgtggctcgaggagaacggccgctggcagagccccgtctacctctttggcgagtcgtacggaacggtccgcaacgcggtcctcatgagacttctcggcgagcgcgacgtcaaggtcgccggcgttacgatgctcagcgccatcttcgactgggtccaggtgatcgagggagaggacctctaccaccttggcatgaccccgaccatggcggcgacggcgcagtactttggcaaggctggccagggcgtcggcgtcgacgagtggttctcgcgcgccatggactggaccgatcagacgcttgcccccgcgcttctccttggcgaccgccttcccgctgagcgggaggcggaggtcgcgcgggagatgggcgagctcatcgggcttcccgccgagcacgtgaggagggcgcacctccgcgtgacgctggacgacttccgccgcaacctgctggatgacgaggggctcgtcaccggcaggctcgacatgcgcttcacgagcgacgctccgctggcgctgcagtccgacgccgcgtggtttgcgggcgaggacgcggcggacgacgccgtggaggctagctggacgagcgccttccgctcgttctgccacgacaccctgggctaccacggtcccgcccgctacctcagcagcaactacgagcgcgtgggcaccaactggaagtgggagcatcacgagccgggcaagctcgacgccagcgcgagccccaacgtcgcctacgacatctccgcggcgctgcgccgcaacccgcgcatgaagctctccatcctgggaggtcgctacgacgccgccaccacctattggaacgtggtgcacgacatgtccacgcagttcctctctccccgcctcaaggagcgggtggagtggcacctctacaactgcgggcacatggcctacgtggacgtccccacgctgcaggcgctctccgccgacatggaggcgttctacaacaaggcatagcgaccatagcgaccctgtgcaggggagaggagaggcccccgtccgcgacctgaactgctgcgggcgggggccgtgtcgtgtctcgccttggggcccgcggctacgggcgggcgggaatctcggttcttctcaccaggtagcagtggtgcaccttggggttgcgggagaagtcctcggggatggtctgggcggtcacgtcctcgatcttgacgccatagcgcgcgaggtagtccacgtcgggcctgaagtcgcggcggttgcacgagaacaccgccaccccgttcctggtgagcaggcggctgatgccgatgaggagctcggcgtggtcgcgctggacatcccagctcccgctcatgcggctcgagtttgagaacgtgggcacgtcgcagaacaccaggtcccagcggttcttggtcctgcgctggtcgctcacccagcgcaggacgtccgcctggacgaactcgtggtcctctcccacaaagccgtttcgctccatgttgcgccgcgcccagtcgagggagggggcgctcatgtccacggtggtggtgtgcttggcgcctccgtctgccgcgtagcaggtggcagtgccggtgtaggcgaagaggttgaggaagcgcttggagcccatggtctgcttggccatctcgcggaccattgcgcgcgtctcgcggtggtcgaggaagatcccgcagtccaggcgagacgagaagttgacctcgaacaccaggccgccctcgtcgatcaggtgggagcccggcgggagcggcacctggccgggacgcgaggccctccggcgatccgcgaggccgcgacccgcctcggcgtactgcgatccgcccttggagcgcgtgcgcacgtggacgaaggtgttctcggggcgcacgtccagggcgaggggtgcgatcgagagcacgtcgagcagccgctcgcgcgccagggcggggtcgatctcgcgcggggcggcgtactcgctcacctgcagccagcggccgcgcctgcccctggcgggcatgatctgcgacccctggaacaggtcgatcgtcaccgcgtagtcgggcaggtcggcgtcgtacacgcgatagcagtcgatgccctccctgcgggcccacttggcacggagcctcgcgaccttggccagacggcgggcaaactgctccgaggtggggaccagcaccggcgtggagcctcgtccggggagctcgacggtcgtgcgctcgggcgcctcgtccaggtcgtacaggcggatcgaggcctcgtccctgcccacgagcacggacgtctcgtccacggggctgtcacccatcacccggtcggtcatggcgttgggggagaggaccacggcctgcgtgccctgcggcagccccgtgatggcggcggtgagggccgagagggcggatgcctgggtagcgacctcgtccgcctcgatccaggagaggtccgccacgaggagggaccgcccggacgcctcgctcacgcaggcggggacctgcggagcgtcgacaaagcggggctccacgtggatgcccgccgctcggagggtctgacgcgcctccgcctggacgttgccgcggtgctcgtaggccacgagggtgcagccgtgggcctctccctcctccgctcgctcgcgggcgtcatcgagcagggcgttccatgcgtcgccgtcgtgcccgccccatcccgtgaagccccaggaggtgcggagcagccccggggcgcggttgagcgcctggccggctgcctcggcgaggatggtgccggtgccgcagtagagcgaggcgagagcggggtcgttatcgcggcaggcgcgccaccagccgcccacctcgaggagggcggcggcgtagtcgggacgcaggggcacgacgcccgagcgctggctgcgggcggactcgtaccccctgcggaagaggggccttccggacaggtcgatgcccaccgtcgcgcggtcgcgcgagacgcggaccgacacgcggacgtcggggctgtgcgtgtcgaccatggggcgcacgccgcgtttgccctgcagccggtcgacgatggcgtccttggcgcgcagggccacgaactgggagttcctcagggcgtcgttggtgccgtgcgcatctacggcgacggttgcccccatgggtacgtggtcctcccaggggatgtcgtacaggccggagtagagggcgtccgagctctgcgcccccacgtgccccagctccaggaccacgctggaggcgaggcgcgaccacaggcacacgccgtaggcgtcggttagggtgcccccaaagctcacctggccgcggagggggcgtacctggggggtgccaaaggacgagagctcccccgcgaggagggactcgaagcccttggggcagcgcgcgacaaagcggggctgcccatcctgggatggcgcgttctggtcaagctgttgcatcgggacacctctcgcccgtgggaatgccgtcgtttccccacatcatacgggcttctcgcctgcctgggacctccgggcgggagctaccagcaagacaccacagggggcgatttgaacgccgtggattcgactggtcccgatgacccccgagcgcgtcgcgtttgccgtatcgcggacgggcggaacgcgggatgcgactatcatgcggtttgtacgaccaacaggggcgcgccccgccccgtgagcgatcgaggagatgcagatggacaaagctacagaggccaaggtccagctttggagggacaacgtcaccgatcccgacctcaaggatgagctcgaggggctcgtgtcgggtgacgaggagaggctcaacgacgccttctaccgcgacctctcgtttggcacggcgggcctgcgcggcgtcctcggcgtgggcaccaaccgcatgaacgtgtacgtggtggcccaggcgacccagggtgtggcagactacctcaacgcacactacgaccatcccacgcttgccatcgcgcgtgacagccgcctgaagggcgaggacttccagcgcgtcgccgccggcgtgcttgcggccaacggcgtgcacgtgtacgtgtacccgcgcatcgagcccgtccccaccctgagcttcgcggtgcgctatctgcacgcctcggcgggcatcgtcctcaccgcctcgcacaaccccgcccagtacaacggctacaaggtctacaacgacaacggcggccagattgccaacgaggcggcggacgagatctctgccgccatcgcccgcacgcccgtctttggcggccccaagatgatggactttgacgagggcctagagaagggcctcatcgagtggacgcccgaggatgtcctggacaactacatccaggcggtcaagagggtctcggtccccgggttcaaggtgtctgacgactactcggtggtgtacaccccgctcaacggcaccggcatggagtgcgtgagccgcatcctcaaggagattggcgtcaagaacgtgacggtcgtccccgagcaggcggagcccgacggtaacttccccacctgcaagtaccccaaccccgagttccgcgaggctctcgacctcgccctcaagctcgcggacgagaagaagcccaaccttgtggtcgcgaccgaccccgacgccgaccgcatgggcacggcgatcccgcacgccggcgagtacaagctcctcaccggcaacgagatgggcgtcctcctcatggactggcttgccggccgcgccaaggatggcggggaggacgtctcgcgcaaggttgccgtctccacgatcgtctcgtcgtccatgcccgatgcgctggcgcgtgacctgggcttcgagatgaggcgcgtgctcaccggcttcaagtacatcggagaccagatcgaccagctcaaggacgagggcgaggaggaccgcttcctcatgggcttcgaggagtcctacggctacctcgtgggcacccatgcgcgcgacaaggacgccatcgtcgccaccgagatgtgcgtcgagatggcctcctactacgccgagaagggcatggacctctacgaggccatggacgccctgtacaagcgctacggctactacctcaacggaaccgtcaacgccatgttccccggcgagtccggtgccgccaagatggcggccatcatggaagggctccgcaagaacccgcccgcgcagatcggcggcttcaaggtcaccggtatgaccgactacgagacgggtgcccagatgccgcgcgtctctggcctccagaaggagccggcacagaagctcccgcccgccaacgtcatcgagttcaggctcgaggacgacaacaaggtcatcttccgcccgtcggggaccgagcccaaggtcaaggcgtatctcttctccaagggcaagacccgcgagcactccgaggaggtccgcgccaagctgcaggcggcggcggaggagatgctctcgtaggccagccgcatgtgacgcccgacacaagcaggggacccgaggctcgccctcgggtcccctttctgtctcgcgcgcggatgcgatgggggagagggtcacgtccgtcgcgatggcattctccccttgggcggcggaacgagggcgttgtcgcgcccgtctccctactggctcaccgacagggcgtagaagccctcggagttgctggcgatggtccccatggcccaggtgtggctcgacgcctgcttggaggtggggtcgcagagcgtgaccgagttgtcgtcgttgagcgccgtcaccacggcccagtgctcgtagggggagtcgaagtccttcttgagcttcacgaccaccacgctgccaccctcggacagaatcgagtagaggttgtcgctcgagggcgtgtagcccgtgcaagtcaggccaaggtcggccgtccccttggagaagaggtcgtcggaggtgaatgggtcggagtcggtggcatagcccgccgaggtggaggcggaggcgatgtcggcgggggtcttgtcagacttgcccgtgaggcccatgtaagcaatggagagggacgtggggccagaacccgtgaccgcgaggacgctgcctgcatagctcacgttgccccagcgggagtcccagtccaggagctgcgggtaggtgccctgcttcacctcgtcgtcgtaggaggacgccttggtgctcgcgctgggctgcgaggcgacgaacgaaatcgcgtcgggctcgagcagggcaagctcgggaagcctcttgtccgagtagtcgcccgcgctccgtgcgatcttggcgagcttctcgttgctgtccagggcggtcgtgaactcctgggtgagctcggaggacgcgccggccgagacgcgcgagtctgcctcgttcccggtgcccgatgcggcggcggagtccgacgtcacgtcgctccccttgctgcagccgcgtgcgcaggacgagatgcccaggatgaggaccacgagggcgacgatcgccacgacggcgaggatgagctccctccgctggccaccgccccccagcggggagcggccacggcgcttcccgcccagggagtagccggtgtcgtgtcccgtgagggtgcggtagttgtggtcgctccggtactttccgtcccgcctcgtgctctggtgagagtgccccttgaggtccctgccggggcggttcctggtgtagtcccgctcgttcgtggagccaaagcgacgaacgtcgtgaggctggcgcccgtttcgtcccgagttgcttgacaaggccattgcgcgtccccctggtcttctcgcgcgccaacggcgcgcctgggattggttccgccaggctgaaggatgcccaacgtctgagcgcatcataaggcaggcgtgcgtgcatgtttgcaggaaatgaggggaacgggcatattcgacccgctgggatgcacgtggggaagggacgggcgagaggcgcgtgctagtattttcacgcaatctcagcggcggaaagggccatccatgggcaagctcatagcacagtttctcaagttcggcgtggtgggcgtgatcgccttcttcatcgactacggcgtactcatgctcctttccgttgggataggcttggaccccgtcgtctccgcagccatttcgttcaccgtctcggtcgtgttcaactacgtcgcgtccatgcggtttgtcttcacccaccgcgaggacttgagcaagaggcgggagttcgtgatctttgtcgtcctgtccgtgattggccttctcataaacgaggtaatcatgtacatgggcatccaggcactggggaagagcgccctcgccatcaccgtcaccaaggtgatcgccaccgccgtcgtgatggtgtggaacttcctcagccgcaagaagtggctcgatgcgggggactcccgcgaggcctagccaggggataaaaacttaggcgagcgtggtttcgcgccaattgtcggcatgccgagaattgcggtgcgtttaaccaatacttcttgactcttatcaactctacgcttagcttcattcatgtgaatgagaataacgcgacgtgcatgcagcaaattcgattgcaggcacctgaggggtagagatggtcaagaggcgtaacaacaggcaggatgccataagggacatcgtgcgaggcaagtcgatacgcacgcagcgcgcactggtggacgagctgcaggctatcggcttcaactgcacgcaggcaacggtctcgcgcgacatcgcagacatgggccttcgcaagctgagcgagggcatctacgtcctggcggaggacctccacctccagcgcatggtgtcggagttcgtcaactccgtggaccgtgtggacaacttcgtggtcattaagagccagcccggcacggcgcccggcgttgccgccgccgtcgatgccgccgcgctccccgaggtcattggctccgtcgcgggtaacgacaccgtcctcgtggttgcggcaagctccgaggcctcggatgatttggtcaacctcatcaacaagctccgcgacgcgcagaagtagcggtttgcgccctagggtttggaagtaggggagagggaatcgtccctctccccatatttatgtgccgccggcaattcccacacctgctcgcatggtttggcctaacaagagagggaccccgggaaagccccgaggcccctctcctgtcatgctggatacgcggtatacctactggccgcctccggtctccccgccggtatcaccgccgcccgtggtggctccgcctgcgtcgccgccgcccgtggtggctccgccatcaccggtgtcgccgccacccgtggtgcctccggtgtctgcggtcgtgtcggtggtcgtcgtaccgtttccggtgttgcccgtgtagcccgagttggtgttggtcgatggtgcatacgtggtcgtcgtggcgtagtcggttcctctctcctcgtcatcgtcgttgctgtacgagtacgtcttggacgacgtggtgccgctcgtcttgctgaacgtccactcgctgttggccttgtaggttgccttctcgtcggtggtcgggaactcctggtgcgtctggccggcgagcgcctggttgatgaagctgatgaagatggggaccgacgtggtgtatggatggccgtacgagccgttgatggtgaccgcggcctcctcgcggtagccgcaccagatcgagaccgacagctgcggggtgatgccgcagaaccagaggtcgcggtagtcctcggaggtgccggtcttgccggccacgggctggtcgacggtcatgcctgtcgagaccgcgctcgccgtgccgcccgcctggaccacgccctccatcaccgagcggacgtcctgggcaactgcggcgtcgacgacctgtttggggtcgtccttgtgctcgtagaccgtgttgccgttgcggtcgagaatcttggtgatcgcgatcgcgtcgcggtggacgccgttggtggcgatggtcgcataggcctccgccatctggatgggcggcacgcccacggtgcccagcgtcagcgagtcgtaggcgggcaggtcgacgtcgatgcccatgtcctttgcctcgcttaccaccttgtcggccccgactgcctgcatcacctggacaaaggccgtgttggacgagaccgcgaaggccttcctcagggtgatggtgccgtagctctcgttgccaaagttctggaccttccaggtggaggagaaggtcatgggcgagctcgcgttgatgtagatgtcggggctcatgccgtttgccagggcggcggtgagggtgaagagcttgaagctggagcctggctgcctgcgcgcctgggtggcgaggttgaactggttggtgttgtagtccctgccgccgaccatggcgacgatgtagccgttggtggggttgacggcgaccagggcggagtcgagcctgtcgttgcccaggtcgtccagggtgctggtgaccgcgttctgggcggcctcctgggtggcggggtcgagcgtggtgtagaccttgaggccgcccttcatgacggtgtcctcgctaaagtcctcgagcaggaccgacttcacatagtcggagaagtacgggtagttgccggtggcgtcgtcaaacgacccctcggtgcactgaatgggctcagccacggccttgtcatgctcctcctgggtgatgtcgccctgcgagagcatgtggtccaggacctcgttacgccttgcggtggcggcggaggggttgacgaaggggtcgtagctcgagggggactggggaaggccggcgagggtcgccgcctcggcgagcgtgaggtccttcgcatccttgttgaagtacgtcttggcggcggcctcgatgccgtaggcgctgtggccaaagtagatggtgttgaggtacatgttgagaatctggttcttcgtgtacatcttctccatctggatggccaggtacgcctcgcggaccttgcgcctgagggtcatctcaaactgctcgtccgagaggatcgtgtttctcaccagctgctgggtgatggtcgaggcgccctccgagccacccgcgagctgcacgtagacggcgcgcaggatgccttgcaggtcgacgccgtggtgctggtagaagcggacgtcctcggtgtcgaccacgccctccaggacgtagggggagatctcggagatgtccacgctgcggcggttctgcaggtagtactcggctatgaccgagccgtccgcggcgtacaccgtcgtgggctctgagacgaggtaggcgtccgccgacgtgtagtcggggaggtcctgcagccaggtgttgacgagcgccccaagcgaaatcgcgagggccgctacgagcagggcggtaaagccaaggaagccggcgaagccaaacgcaacgatgtgcgtgcgcgagtgccggtgggccctgcgggtgcggattcccatgtaatcctcctcattcgagacagtcggaggacattatagttgaggaccccatggcggctccgcgtgtggaggcaatcgctctagtctacagaatcctggcgaaacggggtggcatccatcagcgtattaaaaggtctgtgccgtctgcgggccggcgggtggggggtgccggaggaggtcaccgccgcctcgcggtggcttgcggcctgcgtgcggtatccttgcaggggctcccacgcctgcgggcggggggaggacgtttcgcgcaacaacatggaggacagagcattgctgccagtcgacgagcaacttaaggtcatcacctcgggcaccatgcagatcgtgccgctcgaggagctcaaggagaagctgaagaggggcaagccccttaccatcaagatgggcgttgaccccaccagccccgacctccacctgggccatgccgtcccgctgcgcaagatgcgccagttccaggacctgggtcacaacgtcaccctcatcatcggtgatggcacggcgctcatcggcgacccatcgggccgcgacagcaccaggccgcccctcaccgaggagcaggtcaacgcaaacgcccagacgtacgtcacgcaggctatgaagatccttgatcccgagaggaccaccgtcgtgcacaacggggactggatcaagcccatggaccttggcaagatgctggggctcatgagcaagttcaacgtggcacgcatcctcgagcgagaggacttccacaaccgctacaccaacgggcagtccatcgctctgcacgagttcatctaccccgtgctgcaggcctacgactcggtcgtggtgaaggccgacctcgagatgggcggcaacgaccagatcttcaacctgctcgccggccgcgacctcatgcgtgacatgggcatggagccccaggtcgcgctcaccatgccgctgctggtgggtctcgatggcgtgaagaagatgtccaagagctacaagaactacgtcggcctgacggacgatgtcaacgacatgtttggcaagctcatgtccatcaaggacgagctcgtgcccatgtacttccgcttgtgctccacccttccggtggatgaggtcgacaagatagaccaggccttcaaggacgggtcggcggacccctacgagctcaagcaccggctggctcgcaacatcgttgacctctatcacggtgcgggcgccggcgaggccgccgagaaggtcttcatggacaccttcaagaagggccaggttcccgacgacatgcccgagttccccgcgtcgtcggtcgtgcagctcaacgacgagggcaaggtctacctgccccgcctgctcgcctcggtcggcttctgcaagagcgccggcgagggtagacgccttctggacggcggcggcgtcaaggtggacggcgtggcgcagcagcccagggtatacaacgtcgatcccgagctcttcaaggcgggagcagtggttcagtcgggcaagaagcactgggcgcgcctggtctagcgacgtagcgcaacgtgtttgggcgggcgggtggctttggctgctcgcccgcgagtatgaacaccttggagggagtaactctatgagggtcttggcaggggagaggggcgcgacaccgcgggtccacgaccgcgccctctgggtcgccggcatcatcgtcttcgtagcgtccctggtcttcttcacccaggtgtatcccctttccatgagcaacgcggacgactggctcaacatcaccaaggtgcgctccggtctgccggagtggggaggcttcaacccgtccaaggtgctgcccgagacgctcttcccgctggcggggtaccttgccgcctacgtggtgtatcccctctcgcacgactacctgggtgccatcacgctcgtgtcggccctcgtggtcgcgggggccatcacctggtacgtcgtctcgttcgggcgcgtgctcgagcgttacgccaagactggcgcgttcgccacggcctgcgtgatgctcgtcttcttcctgtgccacttcgccttgctcttcggcgccctttcggacggtggggccgcctacctcttcggcgcctacgacctcaccgggtactaccactacatcgtccctgccctgtggtgtggtgcgctcgccttctcgctgattgtccgcggtgccgggcttgaacccaatgacggcctcaccgagggcatgggacgcaagtctatgggcgtccttctcatctacctgggaatgttctcgaacctgttcagcagcatcgcgctggcggcattcgccggcgcgagcctccttgtcgacctcccctccctggggagggcgcacagaggcgatgccaccatgccgcaggcggtcgcgtcgtacgcccgcaggaacgcggctctcctgctggtcatcgcgttctggctcgtgaccctggccttcgagttcagtgggactcgtgcctccggggccatgtcccaccagcccttggccctgggcgccgtcctgggcaacctcgcgattgtctggaacctgctctacaagcgtcttctcgcgcttctcgccctgtgcctcgtcgcctacgtggcgtggcacgtgcgcggtgcatcgcccgcaggcgaggcgcgcgatgccaggaggctcgtcgtcgtggtcttcgtcgacctcatgcttgctctcgccttctcggtgtgcctctccgctcggatcgaccccttccgcgtggtcgatggggtcacggaatactacatcgtgaggggcgacgttctccttgcggttatggaggcccccctcatgctgtgctgcgtcggaatgggatacgcccttgggcgtgtccgatggctgcaggtgctggcgccactttgtgcgttcgctctcgcggtgaccgtcgtgggcaacatcgggtcctacatccctcccgtgagcgggcgcatgacggcgaggcaggacatcgccgtcaccaacgacctcatcggccagattgttcgggctgacagcgaggggaagtccgaggtgacggttgccacctgcaggttcgacaaccccaaggctatcaactggccccagactccgggcatggtcgagtcgatggcgcataccctgtatgtccatggtctcacaaagcgcgagctcacgacgacctggtacgctgacccggtgttgaacgagcgctacggaatctcggaggacatcggcgtggagtagggcattcggtacccagtccccagacgccctcgatcgagtcgggaacgtcgcccaccacgcacgagatgatgtagacggggcggcgctttgcctcgaggtaggtcttttgcccacgtactcgccgataatctccaggctcaccagctggacgccacctacgaagcagatgatgcacgtggtgctcgcccatcccctggagcaggcggtagtagtgcttggccgtcccgcacttgaacgccgtgtcggttgtgcgtgagctccggaccccatagaccacgccgtagccctcgcgatagcgctcgaccatggcagtcatggcatggatgtcgtcctggccgtcgcagtcggcgctgattgcgacgtcggcgaacgccctcgcctccatgaggcctgcgacgaccgcagcctgatgctcacggtttcggctctgctggatgtccgcgaagtggaggtcccgggaggcaagcgccacggtgacctgccatgttgcgtcgcaggttccgtcgtccacataggggatgcggctctcgttgctcaccaggtcaccctcgatcatcgagtgcagctcgtccaggaggatggggcggttgcggggagggcctcctcctcgtcgtaggtgagaatgatcacgcagagcaccgcgggcgccacgtgttccgcggtgcgcttcacctggcccgtccgtgtcgcgggcaccgcctcccgaggtgcccccaggctgtatcgcatgtgccccttcccctggttgcatcgtctgggcgtcgcgtcgaacggtattcccaatcgatgccatacgagtgttcgccgggacggggcatactggtttgttttgcgttgctttgggcgtgtgcgttccctgcatctccgtcacgatagacttgcagggtcatatgcatcgggaggggcggaagtgacgccccacttttgggagactcatcaccttggcatttagagacacgcatagcgttccggagcttcttgcccccgcgggcgggcccgagccgttcaacgcagccctcgcgggtggcgccgacgccatctactgtgcgttggggcacgacttcaacgcccgtcgcggggcgcacaacttcacctacgagaccttcgaggccgcctgccgctccgcgcacctggccggggcgcgcgtgtacgtgaccgtgaacgtggtggtgaggaccgacgagatgccccgcgccctctccctcatccgcaaggcgtggacgctgggggcagatgccttcatcatccaggactggggtctgctcgacgaggtccgtcggcgcttcccccagatggagtgccacgtctctacccaggcaaacgttcatgatgcgcgcggggtcgcgtggtgccgagaccttggcgtggagcgcgtgactctttctcgcgagctcagcgtggacgagatcgcacgcatctcgcaggagggcgtggagctggagagctttggccacggcgccctgtgcttctgctactccggcgtgtgcatgatgagctcgcttgcaggcggccgatccgcgaacaggggcctctgcgcgcagccgtgccggctccccttcgacctggtggacggcgacggcaaggtcatctcggccccgggcaggggacgccccctctgcccaaaggacttctgcaccatcgacgacgtggagcgtctcaccagggcggggcttggctcgctcaaggtcgagggcaggatgaaggccccggactacgtgtactcggtcatctccgcctaccgtggagccctcgatgaccttgcggcgggacggaccccctcggcccctgacgacgaccttcggcacgagatgctccgccgcgccttcaaccgcgacttcaccaacagctacctggaccatcgcgcggacgacgacatgatgagccacgagcgctccaacaacaggggagagctcgtgggcagcgtggtggcgtcccgtgacctcggcggcaccagggtgcgcaggggcggctccaacggcggccgcgagcggttcaggtccaagaccgtcgccgaggtggacgtgcggctcgaccgccacgtgggggagggcgacctcctcgagatccgtcccgtcgacgacccgtcgcagttcctcaccacacatgccccggcggacgcgccggcgggcgcgaccatcacctgcaggaccgtccgccccatgaggtcgggggacccggttcgtgtgatccgctccaagcgcgccatggacgaggccgctcgcgtctcgtccggcgacgagcgctacaagcgcgcggtgaacgtgagcgtcacctgccgcctggggcagcccctcgtcgtatccctctcctgcgttgacggcgcggcggaggcaagcgcggaggggcccgtggtggagcccgcccgcaccaaggccctcacgcgcgacgagctcgtggagcacgtggggcgcatgggcgggactcccttcgtgcccgccgcgttcgacgtgaggatggacgagggctgcggcatgggcttctccgccgtgcaccggctgagggcgcaggcgtgcgagcttctggaggagaggctcctcgcgccgtactcggggcgcgaggggtcgctcgcgagggtccccgacctccccgacctggcgctcgaactcgcgaacgtccggagcggtgccggaattgccccggcgggggtgcgccctgagggcacgcctgcggcggaggtctgcgccctggtccccacgcccgaggttgcggcggctgcgctcgcaggcggtgcaaccaggctgtatgcgaccgacggtgccctggaggaggcgcgccttcggggagcgagctggccggagggcgtggacgtcatcccctggcttgacgaggtgtgccgcgagtgcgaccacgaccgcatcgaccccctcgtggagaagggcaggccctgcggggtgggcaacgtctccgagttggcgcttgccgcggagaggggtgcgcttcccgaggtcaggccctgcatcccggtccacaacgagtcgtgtctcgttgccctggagcgtgccggcgcccgcgggctctggctgtcccccgagctcacgctggaggagtgcctcgccctcggccgcgccgcatcggtccccgttgggctcatggtcctggggaggaatcgtgccatgaccagcgagcactgcgtgctcaaggtcgccgaccgctgcatccacgactgcgcgaggtgcgcactcaggagggggaggaactcgctcagggaccgcgacggaaagctgttgccggtgcgcaccgacctccaggctcgaagcaggatctacgccgcgtacccgctcgatgccacgccgcaggcagcggagctcgtgtcggcgggcgtctctcgcctcatggcggactgcacgctgctgacgccgcacgaggctgagtttgcctgtgcgcgggtggcccgtgctgcccaggcgtcgctgagcgggaggaaacccgccccgtgcatggcgggggcgacctccggccatctgttctcagggatcggataggggagtcgcgtcttccctgcgtcggtttttctgccacgggcaaatcgcgtcggcaaacgggtaccatcagattcaattgcaacaatggcggtgggatttccaccgcggtggagaggacactcacatggcagagaaccaggagagcacggagcccaaggccgaggccacgggtgcggcagagggccagacccccaaggtcaacagggagctcctcgaggcgaccatcgacgtcattcgccagagcctccaggcggacggcggagacgtggtgctcgtgagctgtgacgacgacggcgtggtcactctcgagatgcagggcgcttgcgcgggctgcccgctctcgacctacgacatgagcgaggggatcgagcgcatcctcaaggagcacgtccccggtgtcaccaaggtccagccggcaatggcttggtaggaagtacgcagtagtacggtatggggcgaggggagcggttccctcgcccctccgctctggaacggtttcggggcggagcacatcgagcgcttggagggcccatgtggcttgacaccatctaccatgccaccaacccggtcgcgtttgcgcttgggccgctcacggtccgctggtacgggctcgcgtacctcgcggggttcgtgtgcgcggggctcgtgatgatgcgcacctcgcggcgctggcgcctggggctcacgtcggacgaggtcctcaacatcgtggtgggtgtcgccttcggggtcatcgtgggcgcgcgcctggggtacgtcctgttctacggcgctggatactacctggccaaccccatcaagatcctcgcgttcaacgagggcggcatgagctttcacggcgggctggtgggcgccatcgtgggcggcgcgctcgtgtgccagcagatgcggatctccatccccacggtgtgcgacctcgcggtcatcggagcccccatcggcctgttctttggccgctgcgccaacttcatcaacggcgagctgtggggcaagccgaccgacctcccctggggcgtcatgttctccaacacgggcggcggctacgtgtatcgccatccctcccagctctacgaggccatcctcgagggcatcgtgatcttcatcgtgctgtacgcgctctcgcgtcgcgtcccgccccggccgcagggcaccttcctcggtaccttcctggcgctgtacggttgcttccgcttcctgattgaattcgtgcgcatgcccgacagccagctgggctacctgcttggcacgggctggctcaccatggggcagtgcctatcggttcccctcgccatcctgggcgtggtcctcgtggtatgggcgcacagactggaccggccgcaggtggggcatctggagtctgcgcgggggtaggcccagggggagccaagtcgtcccgtccgagggggcgcccctctcgcctgtgtgggctttgggtccactcgcgcacaacggtggcgccacttcattcgtgcgatatcaagtttgtcaagccttttcgcccgctggtcatttttcctgctgctagaatgcatgcaactgaacagactctgagggcacggtccaacagctgtcatgcctaggtaaaaggattccggttctactccggatcagcggaaactgtgttccgaggttgcaggggagaggtgcgtagcgccacccccgcagatgggttgccttcctggcttccaatcctgcctgccctctttgtgtccgatgggaccggaggtgcgggacatgcttcccaagcgatgcacaaccgccagccgagcgctggcgatcatcctctctgccgcggtggcgtttggcggggtgcccacgagggcgctcgccgagattgccgacgagctctcgacccaagacggggcaacggaggcatcccagtcgtccgatgcgggctcgtcagcagggtcgaccgtgcagcctacgacgggcgagacggtcgagaccgctccgactgacgggggtaccgccacggcgggtgcggcgggtgcgagcgagggctcctcgaccaccgctgctcaggacgcctcctcggactccaagtcctccgagcctgccgcgtcggcacgcgcgactgcccttgactcccaggcctgcgtctctatccaagaccagaaggacaagggcggcgcggcggacgaggcctacggcgaccaggcggttggcaccaccctctgggcaaacgtctacgactgggtcgaggacgaggactacggcgatggcgactacgagacctgggccaacgacggcagcgcctcgtatcagtggttcgagtgcgacacggcatcgacggacgtctcctcctacgcacccatcgccgggcagacctcgcagtccatcactctgacgtcggaccttgcaggaaagtacctcgccgtgcgcgtgaccgtaggctcgtccacgctctgggcgccctctgccggcgggtccatccaggcgcagaggctcccgcacgtctccgctgcgtccaccccgggcgagggcggccagtccacgcccgtcgacatctacagcgcgaccacgagcctctcccaggacgggtccagcacctccctctacggggagggcgacacgctctgggcgcaggggcgcgtcaaggacgggtccacgtacgttctcgcggacccctcgctcctcgtgtttcagtggcaggtctccagcgacaactccacgtgggaggacattgcgggcgcgacctcgcagtccctctcgcttgccggctatgcgggcaggtacgtgcgctgcaaggtgagtgacgtggcgggcaccagcgccaaggtcaccaggtcgcgcaacccggtgacggcagccggggcggttgcggtcaccagcgtgtcgctcgaccgaacgggtcaggtccagccgggcgagacggtcacggcaacggcgaaggcgtcgggcaccgatgtgagcgactcgcagggggtcgcatggtcgtggtacgtgacgtcgtccccttatgcctacggtgggaccaagatcgagggtgccaccggtcgcacgttccagattcccgcctccgatgattccttcctgggcaagtacgtgtatgcggtggccgatggcggcactggcggcgtgtcgtccaccaccgctgccggccccgtgagggaggcgggctcggtctcgctccaccacgtgagcgtgtcgggctccgccaagattggctccaccctcaccgccaccgcctacaagagctcgtacgcgacggtcgcgagcggcgacaaggtcacctaccagtggcagtacagccggaccaagaccacgagcgactacgcgttcagcgacatcccgggtgccacgtcgcagacctacacggtcccccagagcatcacggtgggaggccagactgtctcgctagttgggtgctacctgcgcgtgagggccgtgagcgacggcagcgtggtgagcacgagcgtcaaggggtactacggcaccacggcggtggacccggtggggcccgtctcgcccgacgggggctacgacctcagcagcgtggcgctgtcctcctcggatgtcaacgccaaggtcggcgacaccatcaccccacaggcaaggtacgaggttcaggggacgtattcctcatacgagacggacgttccctccgatgccaggctcacctacacgtggtatgcgagtgacgcggacgggtccaaccagcgtgccctcacgccatccgatggcgtcagggaggacggggcgctcgtccccactgcggcgctctccggcaagctcgtgtgggtgaccgcatcggctctgatgagcccggccacaagtaaaaaggtgagggtctcccccaagggcgagtacgagctggaccgtgttaccctgagccactccggcacagcggtcgtgacgggtgacgtggtgagcgcctccgcctacgctctggaccttgcggggtctcgcaaggaggtcacgggcagggaaggtgtctcgctccagtggtgcgtcgcggactccgaggacgcgccggcggaccagtggaccccgctcaaggggcagacgtcggcaacgctcgtggtccctgccgaggccgccggcaagtgggtcgccgtcgtcgccacgagcggcaccagctccgcgtctgcgaccctctcctccaaggcggtctccgcctcgtccctcgagggcgctgctgcgatccttgccaacgaggggacgtccggctggaagcccaaccccacctacggcatcgacaccaacgtcgacgacatgctcctcgccgagctcgcggcaacggggtttgacaccacggggctgagcgtgaggctcgtctcagccaccttctcgtccaccaaccccaacgccaccgtggggctctccacctcgtcggagagtaacggcacgatcacctactactcgggcgaccccgacgtcgtgggccgctacgccttcaacttgcttcacaccgttgactccgccacctttgagctgacccggggaggggagacggccacctacacaacgggcagctttgggattccctgggacctctcggccgcacgagccctgctcgaggagaaggcggagcagctctcggtgggctttgccgacggcgacgacgcgtcgggcgtcacggggacgctcaccctgccctacaaggcgggcgagaacggctccgcctcgtggaccaacgttgagtggacctcggacgactcggccgtgaccgtgagcgggtatggctgggacgactacgccggaaaggtgaccaggggctcgtcggacaaggttgtgaccctcaccgccaaggtgagcgggcttgagaactacggcctccccgcagacgtgagtgtggagcgagcgttcaaggtcacggtcaaggccgaccccgagaaggtccaggaggagcgggagcagctccagcaggcggtggacaggttctcgtacgacaccgtcacctatgccaccggggatgccatcgcctcggacggaacgggcctctcccaggaccttcagcttcccaccacgcgcaccctgggcgtggacgggaagtactacaaggtcacctacaccgcctcgagcgaccagatcgtgcccaacgggtatgctgcgtcggtcgtgagggggctgcccgggtcggactccggcaacgtcagcgtgacctgcaccatcacgagcaagacgaacccagagatcacggcgagcaagacgctcgtcttcacggtggcgccgctcgcgtcctccgacgtcgacgacgcactggcgctcatggctcgcgtgaaggccgcctacaaggacgcgcttctcaacggccaggcggagcccgtctcacagaacctcagcaccttctacggggcctacctggacgacgacggcaacctggtgtgggcgcgcagcagcgccgagatggcatcgcacgaggggatcgtgctcgaggagcttccaggctacgacagcatgggctccgcagaccaggcgcgcaccgtcaagcccagcgacaccagtctcctcgagaacgaggacctcaagctcgcctggaacgtcgatcccagcgactacctgggtcgtcaccacgaccagcctacctacaacaagtccgtcaccgtcacgtcggttgtgagcgactcccgctacagggcgcttgccgagaggtacgcggacgaccccacatggggcgcgaagctctcgcagctggtcaaccagaccgtgagcgccaccgtgagcgtcgcgggcaccacgggcgaggacgagcccgtcccaacggccaaggtcaccgccaccgtgattgggcgcgatgccttcggcaagcccgaggtgtgggcgagcaccgccacctataacgtggagcaggggacgtccgcggcgacgctctccgagcggctcttctccgacagcggactcacggtgtcgtcgagccagacgcagtacggctactacctgcagtccatctcgtctccctcgacggggaccccctacggttacgacgccgccaccggcaggtactggcagctgttcgtcaacggcaagccatcggacgtgggggcggacggcgtcagtctgtctgacggcgacagcgtgacgtggtactactcctcgtggggagaggcgcttccctcccaggacgaggacaacgtcaccgcaacggtcaggatcgttggccccaacgcggcgggcgacccggtcaactgggtgccgtcgaccgaggtcagcgtgcccgagggcacgaccgcggcgcagctcaccaagaccatcctcgagcgcagcggcatgacctgcgacgacggcatgtacaccatcagcgcggcggggggctccacgctccccaacggtggcacgtccctctcgtactcgcaggatggccagggcaactggtcgtggtggcagttctacgtcaacggcatccttgccgacaccatggcggcaaactacgtggtcaagccgggcgactcaataacctggagctttggcaccatggggtcgtccgtcccctcgggagacgtgcaggtgtacccagacgcaaagcttcccgactggtcctccgagtggcccgggtacaagggggccgggcaggcgggcaccacgtctgcgaacaccccgaccaccggctccaagctggcatggcagcagtcgctcatcggaagctcgatgatgaccctcatgagcgacccgatcctggtgaacggtgacgtctatgttgcggcgggctccaagctgcaggttcgcgacgcatcgacgggcgagctcaggtcaaccgccgacctcgccgccaacgtggagtccacctgccgcctggtctacgccgacgggctcgtgatcgttcccctgcacggcgggaggctccaggcgctcgcggcagactccctcaagacggtctgggtcaccgacgccctgcccgactccgtcaccgcggcgggggacagcgtggcgcagcagcccatctccacgctcaccgtgagcggcggctacgtgtactttggcaccgcggcggcgaccttctccggcggcaccgttgggggctacctgggctgcgtcaacgtccgcaccggcgcggtgcgctggatggcgggcaactcgggcaccggctactactggtcgggcgtcgctgtgagcggcggcagcgcgctcgtcgccgacgactcgggcacgctctggctgcgcgactcctccacgggagaggtgcgcgcgagcctctcgcttgggaccgggtcccgtgccggagtcgtgaccagtgcggacggcgcgacggcctacgtggtcaccaccgacggcgtgctccaccgcgtggccgtggggcaggatgggacgcttgccgagacgggcagcatacagttctgcgactacagcacgagtacgcccacgcttgtggacggccgcatctacgtgggtggtggcaacggcccgcagtcgtcccgcacgggcgggatgtacgtgatcgacgcctccacgctccgggtggtcgcgtccgcgaccaagctcggcaccggcgcgacgatgtccggcgactccaagagtgccccgctcgtctcgaccaccgccaacgggacctacgtgtacttcacctgcaacggaaagcccggcggggtgtacgtgtacagggtcggcgactctgcggcaagcctgctctacctccccgaccaggcgcgccagcagtacaccatgtcctcggtcgtggccgctgccgacggcagcctgtactacaccaacgactccggctacctcttcaagatccttacgggaagcacccttccggagcagcccgagccccaggcgccccccaagccgtcgggcggcggctccacgtctggcggcacgacgggggggtcgaccagtcccaaggcgtcgggttccaccaaggggacagcgcccgggacgtcaggtgcctccgcctcgcgggacaccgctggaatctccgccctctcgggggtgccgacaacgtcgacgcaggtccagggtcgtgccctctcactgctcgacggcgtggagtcctcaacgctcgccggggagcagcgcatcaccacgaccgtgactgacaagcccgcgtcccagggcagcgacaacgagtccgcaagccccgcgcggaccctccccatctggcccatcgtgggcatggcactcggggcaatcgcactcgtcctcgcgctcctggcgcgcaggcgcaacggcagggaggactaggacatggcagaccttaacgtcaacaccgcggccacgggggagaggggtgccggcaccccggcccaaaccccagcggatggcgggaacggcggacgtcgccccaacgcggcacgggtggtcctggcggtcgccgccgccctcgtgatcgccttctgcgcctggagcatgggggagtacgtcaacggcagggacccgctcgcgttcctctcggcggggagcagcgtcgcctcgccctccccggcggacagctcggcgtccgactcggcgccatccacctccaccgccaccaagacctcgagcgtcacgggcgacgacatcctatctgccctgggaaccctccgctttggctcggatgacgtgtccctctcgcccgacgacgcccgcgtggtgattgcgaaagacggagtctgggtggaggagaggagctcggacgacccggctagcctggtgactcgcacggccgagcgtgccgcggccctcgcggaatgggtgcgggggaggggcgtgtccgtctccacgctcacctggatcaccgaggacgacaacggcgtcatccgcatggtactgtgcgttgggggagacgcaaaggcctccggcgctctcgacaagctgctcgcggcatccaagggctacctcatatcggagaagacctacgccgacctggactcgccgtccttcccccggacctcgggagaggccccgaccctcccggacgggagcgacgccacggtcgacggcacggtgaccctctcgtcgggtgggaggggcgaggtcgtctcccagggcaccggctcgtcctccgcgtcgaagtctggtgcctctgcgtccggctcccagtctggtggggcgtcgtcctccccgtcgggaacggcttccagcggctcgtccagctccaccatctctgtcacggtgtccatcggcggtagctcgcagagggtgagcgtcgcctccggctccacggcgtacgccgccctcctcgcgacgggcgcctcggtgagcgccggtgccaacccctatggctcgggaacctgggtgtacggcatcaacggcctggcccaggacgcctcgcacggctggacctacgcggtcaacggctccatgccctcggtcatgagcgacgagtgcaccgtccacgacggcgacgtcgtcacgtggagctacgtatagcgatggcagcccgtttgtctcgtcggcacgtggccttcgaggggtcgcaccccctggtccccgcgacctgcctcgcggggaccctcctggtgtcgatgtttgccatccagccggtcctctcctgcgtctcgctcgtcggggccatctcgttctcgctctgctgtctgggcccgcgcctcaccgccgagcgcctgaggtggcagctcccgctcctcgccctggtgtgcctggcaaaccccatcttcgtgcgctccggggtcacgacgctcttggtcgttggccccgtggaggtgcacgccgagagtctggcgtacggcgcctgcatgggggcgactctcgtctcgaccctgctttggatcgagtgcgcgtcgcgcgtgctctcgacggaccgcctgctcggcctgggagggggaccgctccccaccgtgcagctcatgctctcgatggcggggcggctcgtcccccagctgctggcgcggtcgcgcgaggtgggctcaacgctcgacgcctgcaccgccggcgggggtccgtcctccggcgggaaggccggccgcgtccggatgaccggcgtgctattgggctgggcgctggaggattcggtggagaggtccgactccatgcgggcccgaggctggggtgccatgggcaagaggaccagctaccagcgggaggccctgcgcgcgcgtgacgcgcttgccgccgcctgtctcgccctgctcgcgctggggggcgccgttctcgcatggaaggcctgttccgagtggcgcttctatccgtccatgcccaccctggtcccgtggctggggtaccttccctattgcgtgctcgcggcggcgcccaccgcgatcaccctggttgaccgggcgcgatgggcgaggctggggtgacgatggcgggtctgtgcaatgcgcttgaggtgcgcgacctctcgtttgcctatccgggggcggaggcgggcgagacaggctgggtgctccggcacgtgggcctggccgtcccggagggtgcgttctgcctgctggttgggcccaccggctgcggtaagaccacgctcctcaggctggcgaagcccgagctggcacccgtcgggatgcgggagggttcgatcagcctcttcggcgagccgctggaccgcatcgccgcggaccccagggagagcgcacgcactgtggggtacgtgttccagagccccgaggggcagatcgtgtgcgactccgtgtggcgcgagatggcgtttgggctcgagagcctgtgcgtgccccgcgacacaatgcgacgcagggtggccgagacctgcgacttcctgggcatgggcccctggttccggcgcgagtgctccgagctctcggggggccagcggcaggtgctcgcgctcgcctcggtgctggcgatgcgcccccgcctgctgctgctcgacgagcccacgtccatgctcgaccccgttgcagagcgcaacttcgcgtccctgctgttccgcgtcaaccgcgagctcggcgtgaccgtggtggttgccacgcacgacccccgccccctcgtggactacgcggacatggcggtctcgatggagggtggcgccctccgagaggtctcgccggacgcgctgcgagatgagcccgacctggccgaggggccgctccccgccgtcacgcttggggcgacccaggtccaggcgagcgacgcgtggtttcgctacggtcgggacgacgactgggtgctgcgcgggctcgacctttcggtttccgggggagagacccgcgccatcgtgggtggcaacggcagcggaaagacgacgctcctctcacttgtggcgggcgtgggacgtccccagcggggacgcgtgcgcaattggctccgcggtagccaggtgctgctgccacagaacccaaaggcgctcctgtcgcagcagagcgtgctggaggagctgatggagtggtcccgcaacgtgggctacggtcgcgacgaggcggtggacgcactcgacaagatgggcatgggcgaggagctcctcccacggcatccctacgacctctctgggggacagcagcagctgcttgcctacgccaagctcgcgctcgcgcaccccgcgctcatgctgctggacgagccgaccaaggggctcgacctcgccgcaagaaggtccctcgcccgtgcgctcagggaggagcgggggcgagggaccacggtcctgctctcgacgcacgacctcgcgttcgtgcgggcggtcgcggatttggtgacgctgctgttcgacggccaggaggcttgcacgcaggctacgggggagtactttgcgcagtcgtggctgtgagccgcgacgacgggcgctgcccctctcgcccggctactccaaggtgaggaacggctcctcctcgccttcctcctcatccgagtcgtcgtctgcctgggcgtctccgctctgccagctgtaggcctccgccgcctccgccgagtcctcggtgggaagcacggcgctcaccatgctcagcccgtccacggcgggaacgatcttggtccattgggtcagcagcggctcggtggggatctgctccagctcgatcagggagtccaggtagatctcgcccgcgccgtccaggaggtcggacttggacctcacgtcctcaaacatctccgccatcttcgagagcgcgtcctcggggtcgtccgcctgcactatcacgggcatcaggcagtagttctcagccgagtcgttagcatcgtcatagttgaagttcccaatgtagaacatggtgcccctccccgatcgcacggttgcttggttttgcctgtccccaatgtatcgctcgcgcggccgcatccccgcaccgctctggcgggcggtcgacgtttggtggcggcggacggcattgccggggagggggacgtgcgacactatgggggaacggaaccgacggggtgagaggggaggagctcgtggcgcgacggatgcgtggcggcggggaggcggtcggcctgcccgcggtcgtggaggtgctcgccctggttgcggtgcccgtctcgatggcggtctgcgccgtcctggacgtggaggcaaccgccgtgctcacgctcctcgtcacgacgctcgcggtcctgctcatgtttgcgagctacgaggcgtcgaggccaacgctacggcagctcatgcccaccgtggtcctggggtccgtggccgccgtggggcgggtgctctttgccccgattcccgacgtcaagcccgtctctgccatcgccatcgtcgctggctcggtgctgggtaggcgcagcggtttcatggtgggggcgctcgcggcccttgcctccaacgtcttctttgggcagggcgcgtggaccccgtggcagatgtacgcctggggcctggtgggctacctcgccggcgtgctgtccgaccacggcgcgctccgcaggggctgggtcctctacgcctacgggttcgcgagcgccctgctgtacgggctgctgctcaacggctggtactgcctgggcttcgtgcgccccctcacctggcagggggtgctgctcgcctacggtgcgggactgccgctcgacgtggtccacggcgttgcgacggtcgcgtttctcgtcgcgatctgggtcccttggaggaggtccatacaaagggtcgtcgcaaagtacgggctcgacccgcgcgagcgcagggcgtcgcccgcggagggagagggataggtgagggggaacatggcacgtcacatgcgtcaaacgcatcagaatgcgtcggggagaggggacgggcgtcgccgccggtggctcgtcccgctggcagtggtcgcgattgctgcggtggcggtcgtcgtcgccctgcaggcgcgcgggtgcggcggaaacggcgcggctccggcatccgagggcggcacggaggcttcgtccaaggcgtcggcgcccgactcgcaggcgacccccgacagctcgccgacgtcgtcgctcgaccagagctcgcttgccggcatgatccaggcgggcaaggtgtcgtcgattcgccttgtgggcgactccatcaccgccggctacggctgcgacgggtacgaccaggcggcaaccacccaggtcgtggcatactccggctcgctcggcacctactacgagacgcccgagagcgtgcggtgctgggccaacgacttccgcgagtgggccactgctcacggtgtgggcaccttcgtgaacgcgggcgtgagcggctttcgcatgcagtacctggccgaggagcccgatgcctggctgggtgacggcgccgacgtgatcgtggtgatgctggggaccaacgacgccgccaaggagcccgtctcgtcgttccgcgagtacgccacccaggccctcgcggcggctgcgtccaagtgcaggcacctcgtggtggtctcgccgcccaacaaccagaggaccgacgccaccaacctgtatggcatggaccagattgacgaggccctcacccaggtctgcgaggagcaggggtacgagcacgtgtcgctctacgacgtcctgcaggtgggcaccagcgacttcaacgccgaccagtgccaccccaccacctcggggtcggacaggctgtgggcggcgctggaggagaggctcaacctcaccaaggtcgcggcctcgtagcgtcgggtttgcgggagacccgaaaagtaagtgcttgacttgaagagacgcggatgataggccttcttgcccagcgcgggcgcgtatagtaacatcattgcgtttgttccgtcactcgaaggagacatgcatgtccggacactctaagtgggctaccaccaagcataagaaggctgcgatcgacgcgaagcgctctgcgctcttctccaagatgtcgcgcaacatcaccgttgccgctcgcgttggcggggacccgctccccgagaacaacgcgacgcttgccgccgccatcgcccgcgcccgcatggtctccatgcccaacgccaagatcaaggcagccatcgacaaggcgtttggcgccggtgccgacgccgccgtgtacaaggaggtcacctacgagggctacggccccgcgggcgttgccctgtacgtggagtgcctgaccgacaacctcaaccgcactgcggccgacgtccgctccgcgttcacgcacgcgggtggcaacctgggcacctccggctccgtcgcgttccagtttgagcgcaagggctccatcgcagtggagaaggtcatccacagcgacgacaagaaggttcccgacaaggacaacgccaccgacgaggacgagttcatgatggccgtcgccgaggccgagggcgaggactacgaggatgccggcgaccagtggatcgtctacaccgcgtacgacaagatgaacgacgtggtgaagggcctggaggaccagggcatcgaggtcaagggctccgagctcacgatggtccccaccacccccacgcagctcgagctcaacgacgccaagaaggtccagcgtctcatcgaccgcctggaggagctggacgacgtccagaacgtctacagcaccatgagcgtgtccgacgaggtcgccgagcagctcgacgaggactagggttcatcgggcgcgactttgtgcgcacgaaattgaggtagatcagggcggtggccttcgggtcgccgccctgtcacaaggagggaccgtttgaggcaggacatgacccaggcagaggcggaggaggtcctcggcctccccgagcgctacgaccagggggagctccgcaggcacctcacgcagctagcccgtcgcttccaccccgacaacgcggagcgcaacggcatccccgcgagcgaggcgcaggagcagatgacgcgggtcaacaaggcctatgccacgctcaagcccctgttcgatagtggcgtcaaagtcgtgcaccgcgacctcgtgggagctgacccctcgcgcggggacggcgttcacttctcgcccacgggggagagggtcgctcgcacccaggtcgacgacagcctcttctgggaccaggacggcaacgcgcgcggcagctccgccgtggggagggccgacgccgccgccgacgcgcaggggcacgatctgaggcgcgtccttctcggcccggtcctcctacgccttgtcctggtggcgctgttcgccctgctgtggtggaggacattcccgctcctggggtccgggacgcccgggcaccaggagattcccggcttggaccccctggcgtgggcgcacctctccgccgccgcgatctatcccacctacctgctcgcctacgaggtgctgaccggcaacgtgtcctccgccctgcgcgaggccatcaacggactcgtgagctaccagaccagggttcacgtggacatccggcgcaagggcgcgtaccgctcagcgctctcgacccttgtcgagacgcagctgtacggcatcctggtgctgccgcttgcgctctggctggtggggacggggctctcccagccggacggccccgctcgcgtcgtgctcctggtcgcgggggcggtcgtcgcggtggacgtgctcctgtccacgctgggaagcggcatcgcctcgtctctctcccatgccctgggtgccgcgatcgagcgccgctacgtggtggcgcgcatggcgctgctcaagcgctgtgggcaatgggagacggacccggacgatccggcagccagcggtcccgccgggaggcacgccgcccggtagtggatgcggcgacgacgaagttgcccgtggctggagtccgtctgtcgccaagggggcttgccctggcagcaaactcccgaaatgagcactcacatcgggcttccgttgccgtccgggtgggaatccccggtcgtttcccctgttggcaggatagcgattcggtcgccctggcaaatggctcccgatatgagctctcatatcgggaagccgccgccaaacgaccctggaaaagggcccagttggcagtaaactcccgatatgagcactcacatcaggcttccgctgccactcgctggggcccaaggggtcacctggtcctcccaactgcgcaaacgtaagctcatataggttaccgggaggagactcctccagcaaaagcgctcacatcgggctcctgttgccatgatacgaatccttatgccagaccgatgcccctcaacagaacccggagaattggtacggccgcagccacgggagattcgcctctggggatgagcgctcgcggcatgccaacgctgcagcccacggttctcctggtcggggggcgtacgcaaaaggactcagggaagagggaattcatcggcgctgggcgggaagtacgcgcgacttcgttcggcttccgggcccgcggctccgcgttccagctgctctcgtaccgcaatggttggacccatgccagagattacgtccaacgtgtacacgcgggatgcactttctgacggctggcgaccgtcagcgggtggctcgggtcgagcgaatgggccccggggcaggcctacccagaggactgccccgttcaacctggctcctccctctcccattctttgacctcagatggctcgccggttggcgtcggcatgggcctgtagagggttggctccgttctcacgatggaggtcatttccaccattcgccctgaccctgcggcttggcagacgcgggaggacgccacgcggcgcacatggcagaagtcgtggcggtggagttggtgactccccataggggtatcctctatgggtgtggacgcgaacggttcaatcggtccgcgcgtgcatgaggttgtcccaggcggatccggaggtcgagggtatgggtgtcttcaagcgtctctgcctgctcgtgtttggcattgcgggtctggcggtgctcgccgcgctctgcctgccgtgggttggcccatggacgacggaggcggcttctctcatctacgaagactggtacttccaggtgctccaggttctggtcctgatcacgggcgtgggcctgctcgtgtgcctgctccgcgcgctcttcacgcgcaaccgcaagacggtcatggtctcgcgcgagggcggcgaccagatcacggtcacgcgcgatgccattgcgtctcaggctcgccacgtggtggaggacgacggcaggttcgttgccaagagggtgcgcgtgaaggccaagaagcgcggtcacgtgcgcgtgtcggtgcgcgtccagcccacccgcacggtcgacgtggtcgcggcgggcagcgagctgcacgacaggctcctctctggcctgatgaccgtgtgcggcgacaacgtggactccgtgggcatagagttcctggaggcggacgagtacgagggcgaggaggtcgagcccctggccgacgcctcgttccagcccgcggcggacatcccggcgcccaccgtcgggcaggggtccggcgcgtcggaggaggagcccacgcaggttcgcccggaaccagcttcggagccgacgggggagatcgtggtccccatgggcagggcggatcgcggcggtgacgaggaccagatgggaggggagcagtgatgtcagagactggtcccaggctcagcgttgaggagacccgaccggacgaggaggcaccccgcacggagccctcgccgggcgtcggggagccgcggcaggagtcgacgggcgagacgaacgccgccacgggggaggacgcgcccaagtcgtccccccgcgacttcgcggtcgcggcccgcagctggctcaggcggagcttcccgggacacgagcacgcggtgttcgggggcatctgcggcctggtggtggccatcctggtgttcgccatcgggttttggaagacgctcttcgtcgtgatctgcgtgctcgtcggcgtcgcaatcggccagtacgccgacggcgacaccacggtggtcagggcaattagcaggtttttctcagataacaggtagtgcgcctgcgggcgccgcacacacccacgggaggggtccacatggctgaagaaaagaacacggtcgccgcgatgggcgatgcggccgaggaggtccttcgcgacgaggcgctgcccaccgacgcgaccgcgtcggacgggacggcaggcgagtcgggggagcacggcgttgacatcgtctcgcgcgaccccgagggcgacgaggaccttgactcggaggactcgctcaccttctccaacggcgtcatcgagaagatcgtcgccatcgcgatgcgcgacgtccccggcgtcatcggcatgaagggcggctggctcaaccgcgtgcaggacgccttcggcgccaccgacccgcgcaagggcgtcacggtggaggttacgccggactccgcggtcaaggtcaacatctcggtcctcatggagtacggcgcctacgcgcccaaggtcttcgaggacgtcaagcgcaccgtggtcaagcaggtcacgggcatgacggggctggaggtcgcgggcgtcaacctcaggatcgaggacgtcctcacgcccgaggagtacgagcaaggcaagcacgaggagcagggcgtctcggccgcggacgacgaggctggcgccaagtcgcaggcagacggggagtagcatggggctgagaagcgccgtcgccaccggggcgggaaggctcacccactgggcgctcgggagcgtgctgcaccgcagcgcctcgcagctcccggggagggtcgccctcgcgattgaccccggcctcatgggcgagctcgccggcaagctccggcgtggctcgatcgtggtgtgcggcaccaacggcaagaccaccaccaacaacgtgctggcctccgcggtggaggcggcgggcaactccgtgctctgcaaccgcgtgggcgccaacatggccccgggggtcacctcggcgctccttcccgggtcgtcggctgactgggcggtgatggaggcggacgagctctccaccatcgacatcctccccgcgctcaagcccacgtacctggtccttctcaacctcttccgcgaccagctggatcgtgcgggcgagatcgaccgcgtgcaggacaccatcgtgcgcgcgctggccgcctcgccccagaccacgctcgtggtcgacggcgacgacccgctgtgcgtgggcgtagcctaccgtgcggccgccgcggggaccaaggtcctcgccttcggcataggggaggacctgcaccagcggcccgaccgcgtgcccgaggcccgcttctgccagcgctgcggcgctgagctggagtacgactaccgcagctacgcgcagcttgggtcgttccgttgccccaacggcgacttccagcgcccggagctcgacttcgtggcaacgggcgtcaaggccgaccgcacgggcgtctcgtttgacgtcacgcgcaggggagaggggacgcccgtccgggtcggcgccaacttcggcggcatctacatggtctacaacctgctcgccgcctatgcggcggcgtcgcttgccggcgtggacgcgcagatgttccagcgagcgctcgacgactaccacccgcagaacggccgactgcagcacttccatataggcggcagggaggtcgtgctcaacctggccaagaaccccaccggcctcaaccagaacatcagcctgatggaggaggacccgcgcgagaagggcgtcttcatcctggtgaacgaccaccccaacgacggcacggacgtctcgtggatctgggacgtggacttcgagaggctcgtgggccgtcccgggctcagggtctttgcgggcggaacgcgcgccggcgacgtccaggtgcgcctgaagtacgccggcatcgacgcgtccatcgcgcgctccgtggcagaggcactgggcaggatgggcgacatccccacctcgcacccgctgtacgtgctcacaaactactcggcgctcttcccgaccaaggcggagctcgagagactggggggcaaagatgcctagcgcggaggtcaccagggcagacgccacgaggggggcgtccggcgggcgcagggtccgcatcgcgcacctgtatcccgagctcctcaacctctacggcgactcgggcaacatcctggtgctgcgcaagcgcctggagtggcgtggcctcggagccgacgtgatggaggtccacgtggacgacaccccgtccttctccaacgtggacctggtgttcatcgggggaggtactgaccgcgagcagaggatcgtgtgcgagaagctcctgggggtgcgcagcgagcttgccgcgttcgtggaggatggcggggtgctcgccgcggtgtgcggtggctaccagctgctgggtgagagctatgcgatgggcgacgagaagctccccggcctctcgctcgtcgacctccgcaccgagcgggggacgccgcgcctgatcggcaacgtcgcggtcaagagccgcatctgcccccacgtcatcgtcggctacgagaaccacggcgggcgcacctacctgggcgacggcgtggagccgcttggccgcgtcgcgtacggaaacgggaacgacggcacctcggggttcgagggctgcctgtacaagaacgtcgtgggcacctacgtgcacggcccgctgctccccaagaacccgggtgtggcggactacctgctctcgcgcgcattggagcgcaggtacggggacggatcgctcgagcccctcgacgacacggaggagcttgcggccaaccaggcgatgtacgatcggatgatgagcggggacatcgagacgcagtagggcaaggaggaccaggatggcaaaggttatcgttttcggcagcctcaacatggacatctcagtcgagtgcgacgacttccccaagaggggggagaccatcacgggagggggccttctcatgacccccggcggcaagggcacctgccaggccgtcgcgtgcgcccgcatgggtgccgacaccttcatggtgggcaaggtgggagacgaccagtacggccgccagatcgtcgccgcgctcacgaagcacggcgtctctcccatgaacgtcagcatcacgcgccgcgccgcgacgggcgtcgccctgatcacgcgcgccaagggtgacaagaccatcgtcaccgaccccggcgccaactacaagatgacctacgccgaggtccgcgccgccatccacggcctgggccagcgcgggaacatcttcctcacgcagctgggctgcgaccccgacgcaacgtacgagtccatcaagtgcgccaagcgcaacggactgtacacggtgctcaacgcgtcccccgtgcagtcgctgccgctcgacctgtacccctcgctcgacctcctgtgcgtcaacgcgaccgaatgccgcgccatctgcggcatcgcccccatggacgacgcctcgaccaaggaggcgatcgactggttcgccgagcgcggcgttgccagcaccgttatcacgctgggctcccagggttccgcgaccgtgatcgacggcaagctggtcaaggtccccgcctaccacgtctcggtggtcgacaccaccgcggcgggtgacgcctacgtgggcgagctggtcgcccaccttgccttcgacggcaccctcgaggaggccatgaagtacggctccgctgcggccgccatctgcatcacccgcgttggcgcccaggagaccatgcctcgctgggacgaggtcgaggagttcgtcaagatgcgcgagcaggcatagcgcccagtctcgtggcatcgtcgcaggggaagatagggtacttcgagtgggccagggcgcttggcgccctggccatcgttgcgttgcacgtgcaggtcgcatgcgcgctgtcccagcccctctcggacgcgcacgccacgtccctgctcgtggaggcggaggtcttcgtccccctcacgcgctgggcggtcccggtgttcttcatgatctcgggtgccctgctgctcgatccggagcggcagatggggtggcgcaaggtcgggaggcacgtgtggcgcctcgtcctcgtgctcctcacctttggcctggccttctgcctcatggagcaggttttcaacgaccatgccctgggcctcgcccagctgggtgccgccgtggacgcgctcctctcgggcgacacctggggtcacctgtggtttctgtacgcgctcatcgacctctacctcctgaccccgctggtgaggccgttcgtcgcgggtgcctccaggagggagctcggctgggtgatcgtggggctgtgggccatgcactgcgtggtccacaccgtgaacgtgctgaccgtgaacgacttcgtgtacctctcctcgctgccctacgcgctcgtctactacctggcgggatactggcttcaccgctatggcaggctgagccgtggcgtcgtggtggcgggcctcgcctccgtcgtcgcctgcatggcgctctacgcgctgcccgacgacgcgggcgccggggtcgtgctgcccgagcacgccttcatgctgccctatgcggcgatggtgtttctcgccctcaagcgctggctcgaccgtcccgtggaggggcacccggtcgtggcgctgctggcggactacagctttggcatctacgtgatccatccgttgttcgggcacgtgatcatactgctggggcatcccatggagtggccgttcccgctggtgcaggtggcgatcttcgtgaccggcgtcctgggctcaatcgcgatcacgtgggtcgtacgccgcatcccgctcttcaggggaaagatctagcgggcttgacccctcgttccttacgagcgcggtcggtcccagcttggtgggctcgggcaagccgtgcgggcaacgcccccctgacgccccaccgaggcgagggtcccgagccgatcgccagcaggagggtcgtcaaaggcccggagggggagaggagcatccccgacgagacgggcagatctcgcatgcatcggtggccccgtcatgccagaaagcccattccgcgtgtacacacggtgggagattttcggcatgggatatgcctcagcggcgcgttacccctgacggagtcgcatcgggacttcgctcctgtcagaaagcgcaccccatgtgtacacgcgccgcggggttttaggcagggttgtccctcccgaccctcttgatgccagatagctcgtcccgtgtgtacacacaccacgaggtttctgacgggggtccttccttccgttgcgttttcctgttggtgagacgtcgggggctgacgctgtcagaaagtctctcctgcgtgtacacacggcatgcggtttccgacaaggggtcatgccgttgcgggtctccgacggcagcagctcggaatcgctgtccgcgagacgccctggatgtcccagcacgtgcggcttgccctcgcatcggagcgccggaatccctgtcgtcgattgcgggggcgtgtcatcctgccctgccccctcctcatcccctccatgagcccttttgcggacgttcacccttccaagagaacatcggattctggtctcggcacagagcggggggctccgaggccaaagggaggaaaggaacatgttcccgcagccgaggccaatgggttgcgaccactgccctctttcgagttctccggggtggccttggcctggtgtcaaggcgcgaaccatggcggcgaaatcccgatgtgagtggtttcgccgttgggctcccatccggagatgcagccgttcacggcacaaccgtaggaagaagggtcagtctgggatccaaccagcagtgggtggcagcgggagcccgatatgagcggtttggccattgggtcttcgcgggggagccaagtcgttcatggcatttctgcaggtaagtggttcagcctgaaacccagaacccggcggggtggcagcgggagcccgatatgagcactcacatcaggagtctgttgccaagtggaccctatttccccttcgattgtcagcggaagcccgatgcgtgtgctcacttcgggagtttgctgtcatggattggagggacagcatcctccgcctgcctcccaactggggaaacgtcaatcagccctgattcctggggagctgtctccctgcgggaaggtactcacaacgggagtctgctgccaggcaaacccgcttggggcaaggttggcagagaacggctcaccacctgagcacttctctaggacggctgggacgggagggtcgttgctgccaacgtccaaggaaggacgtcctgccagctgcgggagcgcggaaacgcccgtcatatcgcccgtggggagaatgcttacgcgggcattctcctgcaaggggagcgagacgacaggacgagcagtgcccctcagctctccaattcggacgtgagcttgatcgagccccgatttgccaggccggcaaagtcgccctcgagccaacgctgcgactctccccgtcccagcacgagcggcatgcggtcgtgcaccgggaacaccgtggagttgggcaccgtggtgaccaccgagaaccggtcctccgccctcacgcacgccagcaggaacacggggtgtccgtccaggcgaaagaggacctgcctcctgcccttgcgacccctcccgccgggggcgtcgccctcccgtgccggtgcgttgggctgggtccacgactcgtagaacccgtggacggggacgaggcaccgtccctcggccatcggccccgcccacatgccccgaccggtgcgcgtctgctccagggccgtctcgagacgcgtgttgaacacgagtccgtctcgccccggaagagagaagccccaggtcagaagtgccggctccagctccccgccctcgcccggcaccaggaggggcagctgcgtgcccggaaaggcatcgggggttcgtgctggctgacggggtgcgctcgccctgccgccctcccgcagctcctccgagatcctgcgcacctcgtccatggtgagggggttcatgcggtggcacatgcgcgtctcccttcgctcgtcgccaccatcgtacgacgtcgcggcacagggcgtcgcaacggcttcgagttcctggccagcgtccgcgacggcaaccaggtcgaggtgcgcgaggacggcacggtcgtggtcagggggtagcgcctttccgctggcattcagttgacatgttcctctcgcctccgtatcctcttgcgagcaatcatacgaactcgtatcaacggagcgtgagatgggcgtgggcgccaacggcagtcgcgcgggttgcaccgtgcgtgacctcgactgcatctatcgggagacggacaagctctactatcggttcgcgcgcagctgtgggctctcggagtccgcgtactgggtgctgtacggcgtggtggtgggagggggcagcgcctcggtccgcagcctcgtggaggacctgtcaatctggccccagaccgccaactcggccctgcgctcgctcgaggcgaagggcctcgtgagccttgactttgagccgggaagcaggaagaacaaggtcgcccgtctcaccgatgcgggccaggcattctccgctgcgcgcgtggagcccgccctcgcggcggagcagcgcgcgttcgagcgtctctccgcgcgcgaccgctctgagctcgtgcgcctggtgggcgagttctcggcggccgtgtcagacgagttcgacgccctcggggaggtcgatgcacgatgagcgcggaggagagggacgtggaggcggaggccgcaaccgcctccgtcggccgcgagggcaggcgggcggcgctggcgctgttccgcgagctcgtcgccccgtacaagtggctcgtcgtcggcatggtggccacgctgctctgcgacatcgtgggcatgctgtacatccccaccgagctcgcggcgctcgtgaacaccgccatcgcgacgcgtgacgccgacgccctggtggggcatggggtctccatgctcgtcgccgccgtcgtggggtcgggcggctgcatcacctcctactacctggcatccaagtttgccgccaacgtgggtagggacctgcgcgtgagggtgtacgagaagtcgctcgacctcgcccactctgacttcgagcagtttggcacggggtccatgatcacgcgcacgctctcggatgccaacgtggtgcagcagatgctgctcatggggttcatcatgatgggaccggtccccgtcacgtgcgtggttgcgatcctgctcgcctttggcgtcgaccccgtgatgggccgcctcctggtggcggttaccctcgtgatcctggtgatctttgggcttgcggtgtggaagtccgcccccatcttcgtgatgctgcagtcgttcatcgaccgcatgaacgtgcgccttcgcgagtacatcacgggcgtgcgcgtcatccgcgcgtttgggagggagtcgcgcgagcgcgagcggctcgactccaccttcgagtcgtacgcggaccgcgccatccgggtgaacctggtcttctccacctgcgactgcgccacgttcttcctcatgaacgtggtcgagtccaccatcctgtgggtgggtgcaaacagggtgggcgcgcacgccatgcagataggctccatctcggcgctcatcgagtacgccatgctcatcatgttcttcatgatgatggcgcagttcgcgatcctgcagatgccacgcggccttgcctgcctgtcccgtgccgcccaggtcctctcggcaacgcccatgatccttgacccggaagtcccggcagagctgccctcgggtgacgacgcgccggcggaggtcgcccgctttgaccacgtcagcttccgctttggcgacgcggacgaggacaccctgcacaacctggacttcgcgctccggaggggcgaggtcaccgcggtcatcggcaacaccggctccggcaagtcgaccatcgccaagatgctcctgcgcttccacgacgtcacgggcggcaggctgctgttcctgggcagggacgtgcgagacgtgtcgcagcacgagctgaggggccgcatctcgtacgttccgcagcgcgcgtggctgttctcgggtactatcgcccagaacctgcgcgacggcgacacgggggcgacggacgagcggttgcggcatgccctggacgtggcgcaggcgtcgtttgtgcgggagctcccggatggcctggacgcccgcgtgtcacagggaggcaccaacttctcgggcggccagcggcagcgcctggcgatcgcccgcgcgctggtgcgcgaggcggacctgtacgtgttcgacgactcgttctcggcgctcgacttcaagacggacgccgcgctcaggcacgcgctctcgggcgagctggacggggcggcgacgctgctcatcgcccagcgcgtgagcacgatccgcgacgccgaccagatcgtggtcctggacgagggccgcctggcgggcgtgggcaagcacgacgagctggtcaggacgtgcccgacgtaccgggcaatcgtggagtcgcaacagatggaggggggcgaggcagatggcgagtgacgagagggacaagacgaccgtgctggggaaggcacccgacggcatcgagggcgagcgggtcgatgccgcccccgccggcagtggcgcggagggcgactccgaggtcccctcggacgccatgggaacggcgcgccgcctgtgggagagcgcacggggcatccgctggaggctcgtggtgtccgccatcgcgacggtgctgtacgttgcgttcagccttgcggcgcccgcctacagcgcctacgtggtcgacctggtgtgggggaacgtgcaggagtcctttgcccagggcagggactacgtggtgaccatggagaacggtggcaggcagatcctgacgttcctctccctctggaccgtgtcgtgggccttctatagcgtgcagtcctatgtgatgtcgagctttgcggagaggctcaacctccgccttcgcgggctcatctcggctaagctggggtgcctgccgcttgcgtactacgaccagcaccagcccggcgacaccatcagccgcgccaccaacgacctggacaaggtgtccgaggtgctgcagcgcggcgtgatgcagctgatcatctcggccgtcacgctcgtgggcgccgtcgtgatgatggcaaggtacagcgtggtgctcaccctggtgttctgctgcttcgcggcggcgtccgccctcctcaccaaggtcgttgcggcgcgcacgctctccatcgcgtcacgccgccaggaggcgctggggaccctcacgggcaaggtggaggaggcgtacagcggccgtgcggtgatcaaggcgtttggccgggagggcgacagcctggacgacatccgcgcctgctcggaggaccttgcccaaacgagcgcccgggcggacttcgtgaccaacgccatcagccccgcgatccgcttcctcacgcggctgtgccaggtggtcgtgggcatcatggcggggtccatgctcatagccggaaggctctcggtcggcgtgttccaggcgttcttccagtacgtggcccaggcgaccgagccgctcacgcagctctcgctcacggtgaacatgctgcagggggcactcgccgccgcggagcgcgtgtttgccctgctggacgaggacgaggtcgagcccgacccggcagagcccgagcttcccgcaagccccgtccgcggcagggtcgccttcgagcacgtgcgctttggctactcgtccgaccgcccgctcatgcgcgacgtctcgtttgtggcagagcctgggcagaaggtcgcgatcgtgggcgccacgggcgccggcaagaccaccctcgtcaacctcctcatgcggttctacgaggtggatggcggccgaatcaccatcgacggcgtggacacccggcgcatgacccgctccgacctgcgcgcccggtttggcatggtcctgcaggacagctggctcttcgaggggaccatagagcagaacatcgcgtacggcaggcccggcgccacgcacgacgaggtcgtggcggcggcaagggcggcgcacgtggacttcttcgtgcacacgctgcccaagggctaccagaccatgctctccaacgaggcggaggagataagccagggccagcgccagctgctcaccattgcgcgcgccatgctcgtggacccggcgatcctcatcctggacgaggcgacctcgagcgtggacacccgcacggagcaggcgatcgtccacgccatggaggcggcgatggagggccgcaccagctttgtcatcgcccacaggctctcgaccatcgtggacgccgacctcatcctggtgatggaccacggcaccatcgtggagcaggggagccacgcccagctcctggcggcaggcggtgcctacgcggagctgtacaagagccagtttgcgtaagggcgctgccgtgtttggatggtgttgcccacaccgccaagacagattggccaagaagtcctaagctgaagagctgtggaaggctggcgggggattcgtcccccgccattttgtcgtattcgcgcaacacgattggctggtcatgggcaagcacttttcaaatgcaggggagagccgcgaggacgagggcaggcacggcttcgcctccggtggctccgagcgaggcgatgctcgtgtcgatgcccccgtcgcgggaatgggggacgacggcgcgggcgagaggcccccggcaagctggttccttcccaaccccaccggcagctctgaggcgccgaggggaaaggggcgcgaccaccgctcccacgggcaccaccgccgtcgcgtggtggcgatcgtggtgtgcgcgatcgtcgcgctcgtcgtcgcccttggcgcgtcgctggcgctcaccgccaggacggcgaaggcggacgccgagcaggtggtcacggcgcttgagcaggccaaggatgcggtctccaacggcgactcgtccgccctcaaggaggcggcctccacggcgagcgactccgcccacggcgtgcagtcggcgctctccggcccgcaatggacgatcgtctccctcgtgccctcgtacggccaggacgtgaccaccgcgaggagcctggcgggcgtccttgtggacctctcggacaacgtgctgtctcccctcgcctccaacgcggagtcgaccgacctcaaggcgctcgtctccgacggctcggtcaacgtcgacgccgtcaagacgctggtgggcgtcctcgaccaggctgcgcccgcgctccagaggtcggcccagaccgtcgatggccttccccaggcgcacgtgagccagctcgcctccgccatcgacaaggccaaggacaagatcgacacggccaactcggtggcgtccaggctgagcgacctggccccgtacctgcccacgatgctgggtgacggcggccagaccaagacctacctcctcgtggcgcagaacaactccgagatccgcgcaacgggcgggttcccgggctcgatggggatcatcaccgtgaccgacggccagatcagcgtgggcgacttcaccacgatcgtgggccagcgcggcaaggagttccagctcaccgaggacgaggcggtcacgtttggcgccgccatgggcgtgagtcccggcaacctcaactccacccccaacttcgagcgtgccggcgaccttctcgcccaggcctacgaggcctacgtgggaacccacgtggacggcaccatcgcggttgacccggtgttcctccagagcctgctcaagctcacgggcggggtcaccgccagcgacggaacggtggtggacggctccaacgccgccgaggagctgctgagcaaggtgtactggcgctacggcaacgacaacgcctccgaggacgcgttctttgccgaggttgccggtgccgccttcaagcaggtgatgggcaacctggacaaggcgggcgcgagcaacctcgccgaggtcatcgactcctccgcctccgagcgccgcctgcaggtgtggatggccgactcggaccaggagaaggcgatcgagaatgcgggccttgccggcgaggtctcggatgacaccgcaaagcccgtgctgggcgtctacttcaacgacgacacctgggcaaagatggactggtacctctcgaccaagaccgaggttggccaggcgaccaccaactccgacggcaccgtgagctaccgcgtgaccactacggtaggcaacaccatcaccgaggaccaggccaagtccgcgcccgcctacatctcgggcggaaaccccgccaagaccgacgtcagcaccatgatcatcaactgcttcctgctggcgcccgcgggcggcaacatcacggacgtgacgctcaacggcgccacctcgggcgacgccatcatgctgtatgggcacgcaggcgtgcggcagtccctgagcctcaacgcgcagcagtccgcgaccctccagtacacggtcacggtgccaaaggaggccaccggcgacctcaccgtggaccagacgccgctgggcaacgtgagcctgcagcagtaggggagaggggcgggccaccaggcccgatacaaagagcgcctgcgagggtcgtgggacggcgtcgggaggcgtcagtctcgcgcccctctgccgtgcgcgaaggcggtcccggggctgcgtgcggcccctgggggcggatgcctgtgcaatgaggcgtcgttcccgtctccagcttgcccagtggttccccaagggcgatgattgcgacaggcacggacgcttcgtcggcgtcggcggcctggtgccgccgcatcctcgtgatgggaggctctcgcatggacggtaggacatcgcgggggagagtggcgctcttcctcgtcctcgcgttcgccatcgactgggcgtgctgggtctgggcggggtcgcagaccggctggagcgtggcggaggggtctggcccgtggccggcggtgctgccgctctcgatgttcgtcccgctcgttgccgcgctcgtggtgagggccgtccccggagccgacgtgctccggggctggaggccgcgcgtcaggggcaacgtccgctggtacgtggtggcccttctcaccccgtccgtcctcacgctgctgggcgccctcgtgtacttggccctcgtgccgggagccttcgaccccaccgcgaagtcctacgcccagttggcaagggcgcagctcggtcccgatgtatcccaggtccccgcgctgatggccgcgcagtttgcgtcggcggcgcttctcgccccgttcttcaacatgatcttcgccattggcgaggaggcgggctggcgcggcttcctgtaccccgccctcagggactggctgtcccgtcccgtggcgatgctcgcaaccggcgccatctgggggctgtggcacgccccgctcatcgcgatgggatacaactacggaacgtcctacccggggttcccggtggtgggcatcctcgcgatggtgctgttctgcacggggtttggcaccttgctctgcctgctgagggacgtaaccaacagtgtgtggccctgcgcgctcgcgcacggggcgctcaatgccgtggcggggcttcccgtgtggctctccaccagtgggatcggcatcctcggtccagcgccgctgggacttctcgcctgcatccccacgctgctgctgtgcgtctggatcctcgtgggcgcgcgcaggtccgccccgagcgggatggagtaggggagaggggtcgtcgcctttccccccgcggagtccccaccgtccgtcacgtccgtggggcttgttttgcccggctccccgccatgacgcaacccttccagccgccgccctgaccagccttccgtctgccccgttgcgtgcctctcccacaagtggtgaatgtttttgcattcttggttgaacccgacgttcctaaagtgttactattgccaagcgctgtgagggagaccgagcagaagcaaacgggtggtggcgcagtttggtagcgcacttgactgggggtcaaggggtcgctggttcgaatccagtccacccgaccacgaaaccgcaggccagaggcttaagcctctggcctttttctttaggtatcccattgatgtaccgtatgtaccgtagccgttcctcatgctcttgcggtgcaaggcgagcattattctggttcaatgtgttgcatttgtagggaaataatctacaaatgcaacatgagcaattcaaatcacatagaggccatagcggagctctacgagtcggagggcgtcttcaccacggcacaggcggctcgcatgtgcatcccacgcgacgcccttcacgatgcggtcgagtccggccacctcgtacgtgtcgtgtggggcgcctaccgaatggtgggatccggctcctccttcgctgacgagctggcggcgatatggaagctcgccaccctggcgaagttctctcacgagaggatgcgtgtcgcagactgggacggcatcgccgtcggtggctccaccgcatcagtcctcctcgggatcggcggcctgcagctctcgccctacagactctacgcacccaggagggtgaacgcgaggaatccctcggcgagcttcgccaggcgtgcggtgtgccgcgacgaggtgacgttcgagtcggggctccccgtgacacgcccagaacgcactgtcttcgacctcgtcgcggacgacgaggacctctcgctcgtggcggacgtcctggccgacgcctcgaggaagtaccacggcttcgactgcgggaagctccaggggctgctcgaaggctattacggtgagaggcggggcgcgggatcttcgatggcctgatggaagactctgggcttctcgggaggggcgcacgggaatgaggtacaagagcgctgccgcgctcgagatggcgatcaagtctgccgcggcggcgtcgccgatggataccgggcgtgtcgtatcggcattctacttccaccggctgctgtgccgtgtgttcgtcggcggcaacgactcgatcgtgctcaagggtggtcgggcgatgttcgctcgtaccgttgatgcccgcgcgacgtgcgacattgacccgctctccacggggccgagcctggacgaagcgctcggggagcttatccggctcgccaggaccaacctgggcgacttcgtgacgttcgagttcgcggggtcgcgcccgataaaggctgaggacgagtacaggagcgggctgtctgtcgggttcgtccccatggttagtgcgaagcgcctccagcccgtctccgtcgaccttgtcgtcgacgagttatcgctcgaaggcgccgagtgcatctctctggcggacaggatagaggtagacgggctcgaaacctgcgattacctcgtctagcccattgaggccaccctcgcggacaagctctgtggcatcgtcgagacgcacagcgggagagcgtcctccagggtaaaggacctcgtggacgttaccctgatcgtgtcggaaatgttggtgtaagcgcaagagcgcgcaggcttgatcgatagccaaagcagagcggccatcgtcctagaatctgagatcgcgacaagtcggattcgtggaagggaacgatgaccgcatggaaagcatagcagaggcgccgttaacggcgcaggtgactccggggctccttccgaggttccaggatggggcggtgaacctgcaagagctgctcaggcagctcgcggagtccatcgtgaacgagatcatggacgcggaggccgaccagatgtgcggggagggcaactgagtattgcgccccatcagtagcaccagtttcacggtttccgtaccaccctcgcacctaaccgtttcgcaccatccgaaccgcccgttccgcggcttccgtatcgccctgctctgcccgtagcattgaatcgccatgttaccgaccaagaaaggagagaagcatggcgagaaagatacgggcgaagctcatcatggagctgcgcgagcagggcatgtcgaggaggtcgatagccaagaccaggcgcatgtcgatggaatccgtctgcgaggtgttcggcatcgcggaagagcgtggcatcagctgggcggacgtcgagcccctgaccgacgaggaggcctaccggctgttctaccctgacaggggcgtccgcgagagcgtcttcgaggacccggactggggctacatgcacaaggagatggccaaggtcggcgtgaaccttcgcctcctgcacgacgagtacagggagaggtgccggcgcgagggcaaggtcgcgatgggctacacgaagttctgcggcgattacggaatctggacggcggcgaacaacctcacgaagcgcatcgagcacaaggccggcgtctcctgcgaggtcgactggtccgggcccacgctgggcaggggcctcgtgaaccccgtaaccggcgaggtgtcgaagatttacctcttcgtcggggtgctcccgttcagccagatggcctacttcgagccaacgctcgacatgaaagagcgcacctggctcaggtgccacgtgcacatgtacgagtactggggcggcgtgcccgagcgaacggtgtgcgacaacctcaagaccggcgtcgtgaagcacccacgcgagggcgagatcgtgctcaacgacgcctacgaggcgctcggcgagcactacatgacggccatcatgccggcgcaggtcaggaagcccaagcagaaggcgtccgccgagggcaccgtgcgcgacgcggccacctgggtgatagccgatctcaggaacgaggcgttcgcgaccatcgaggacgcgcgcgcagccgtgcggcggtgcctcgacgagtacaacgcgcacccgttccagaagcgcgagggaagccgcgagtcggtgttccgcgaggccgaggccgccgagctcagaccccttcccgatgtccgctacgacgtcgccgaatgggtctacaaccgctcggtgaacctcgacttccacgtcgtctacgccaggaaccgctactccgttccccaccgctacgtcgggcggaaggtggacctgcgcgtgggcgaatcaacgctgtcaatctaccacgccggcgagcgcatcgccacgcacccgctcttcccctcctacgtgaggaacgcctactcgaccgatgggtcccacatgccggaggcgttcctcaggcccgagtgggacgatgtgcgcataagggactgggcgcgcaaaatcggcccctcgtgcgcagaggtcgtcgagcgcatcttcgcgcgcgtcaaggtcagggagcaggcgtacaaccccgcgctgtcggtgctcaggctctcgaagaagtacggcgacaagaggctcgaggccgcctgcgcgcacgcgctgcccaggctcacctcgccccggtacaggcacatcaaggcgatactcgactccaacctggaggaggggccgtcgcagcgcggcgccgccgcgtctggcggcgccaggccctcgggccacgtccgcggcgctgactactacagggacctggggtgatcacaatgatcgacgaggagaccaggcgcaagctgcgcgagatgaacatgggcgagatggtggagacgctcgatctgcaggaggccgaccgcacctgcatgggcatgcccttcgacgagcgcgtgcgcatgatggtggaccacgcctgcgaggccaagcgctcgtccagcgtgaagcgactcacccagcgggcgcggctccgcttcccggccgccgagcccggcgagatgatctacgagggacgaggaatcgacggcgtgctcgtgcgcgaggcgctcacgtgtcagttcatggaccgcgcggccaacgtgatcgtggagggctgcaccggcacgggcaagagctacctggcgtgctgcatggccaagcaggcatgcaggatgcgcaggagcgcgcgctacataaggctgcccgacctgctgatggagcgcgacgagctagcggcgaccgagcgctccgacgccaagatcctgaggaagtacgcgcgctacgagctgctagtcatcgacgagtggcttaccgaggacgtcgaagacgtggccatacggtttctgctcgagctcgtggagaggcgctacatggatcgctccaccgtcctctgcacgcagtactcgcctgccgactggcacggccgtctcggcggcggcgtgcaggccgacgcgatgatcgacaggctggtgcacggcgcagtgagaatcgacctcggagacgtcaacgtccgcaagctgctcgccgaaaagaaagggtgatgcgcatctcgcgaaacgggtgatacggaaacggcgtgggcaccggtgcggagaccgcgtaacgggtggtgctcacgccgcaaaatactcagggcaacagccgaaacggctaccgcgagcgcaagcttctgacctgcgtgggcaccctcacgctcagggtccccaagctcaggcagggaagcttcttccccgaggacgtgctgacgcgctaccagagggtggacagggcgctcgtggcggcggtcgccgagatgtacgccaccggcaccagcaccaggaaggtgcagaagatcgcccagaagatgggcatcgacaggctttccagggaccaggtgagcgcgatggccaaagacctggatgccgacgtcgaggagctgctcgcgagggatctcggaagcgccaggatgccctacctgtggcttgacgccacttacgtgaagtgcaggagggaaggacgcgtggcctcgacggcggtcgtcaccgccataggtgccgacgagcacggatggcgccacgtgctcggcatatccgtcgtggacaccgagtcgtatgactcatggctcgcgttcctcaaggagatctgggcccgcggcatggagggcgtccagctcttcacctcagacgcccacgaggggctcaggcgggccatccgggaggtctttcagggagccgcctggcagaggtgcgtcgtgcacctgatgcgcgactgcgcgcgcgaggcctcctcccaggcgctcaggaagcgcgttgccaggatcgtggcgcccgtcttccgcgcaaaggaccccaaccaggtgagggcgatgtaccacctggcatgcgagatgcccgggggtgctgccccaaggccgcccgcgtcctcgaggaggccgagcccgacgccctcgcctacctcgacttcccgaagtcgcactggaagcgcctgcgcaccaacaatgtccaggaaaggaccaacagggagaccaggcgccgctccagggtcgtgcaggtatttccctcggtcgagtccctcacgcggctcgtgggtgccgtgatgttcgagcaggacgatgagtggtcagagtcacgctacttctcagagaagaagatttccgagctctacgaggagacacccaaaaccgcaccgctgacaaaggaagaggaagaggagctcatgctcgtatcagagaaagccatcagggcgagcctcgagcttgcggacaggatggaggcagcataggatacaggacaaggtctcagatcctgcaggcgattcgctcgctcggccggggcaagcccagcgccgctcacggatttacaccaacattcacgacgctaccgttaccctggcgcctatgtagaagtcatcaaccttcgccgcgccggtcgagaggacatcggacgcactccgatcttgccatgacgcacccgatgcgagcgaggaccgtggaagcggccccatggccgcagcccacgaagcgctggagcttcgctgcgctgaccccgcgccagtcgttcgccacgagccacttcgtgaggtggatgtgcgtctccctccatcatcgtgctcttggtcacgccggactggtgcaagcatctggagcgctgccacttattggcgcggcctaccaccttggtgtaccgcgtgttctcgcaggcggggcaggcaagaccctacgggtatgtctgtgtttgatagcgtcttatttgcgggtttgagcgtcggaaagtttcgggtctgagcacgaaaaaattactggttcgtgcatgggcacgccgaccatcccgcgattggcccaacatgtcgttgcttcggtttccgacgtgaggagggccagaggggaaatgatcggcgtggacaagatagaggatatacagcaggggggcggcggcgtggcgagcgattgcggcgatcgcgagggcagtcgggcgtgtcggagcccactgcgaggaagtacgccaggatggacgacctgtcgcccgagccccgaggaggaggaggaagcccgagagcgaggtgctcgccccctacgaggggacgatagactcctggctgacgacgacgagctgcaggaactggcgcaagcagcgccacacggccgtggggtgtatgtgaggcttcgggacgagctgggctacgacggctcctactcaaccgtgcagcgctacgtcagggccgccgcgaggagatggccagggggcgtgacgcagggacgccgagggcttccttacgctgagctggctgcccggcgaggtcaggtcgacttcggggaggcggacttcagggtgcgtggcgtccctcaccaggggcaagtacctgaccgtcaccttcccgcatccaacgtggggctcacccaggtgttctggggcgagacgtccgagtgcgtctgccggggctccgcaacgtgttcgagttcgccggcggcgtgccgaggagggccgtcttgacaacgccaccgaggtcggcaggcgcgtcgggggcgaggtcaggctctcggagctcccggcgcttcgcggcgcactacgggctcgactacacttcaccacaaccccgctcgggcaacgagaagggcaacgtcgagaacaaggtcgggttgccacaggaggaacactcttgtgcccgtcccgtcgttccacgacgtctccgcgttcaaccgcaggctgctcggggactgcctcgacctcagcgcgggcaagcgccactacaggctcggcacgcccgagctcgagctgttcggggaggacaaagacgcgctctcgccgctgccgccggccgcgtttcgtgcgtgaggtgggagaccaggacgtgcaacaagcagggccattcaccgtaggcggccccaccgctactcggccgggcccgcctacgcgcgccgccgggtcgacgtcgccctgggcgccttcgacgtcacggtctgcgacgcctcgaccggggaggtggtcgccacctacgagcgcgagtggggcgaggccccgaccgacagctccgatccgatgcagctcaggctgctgtgcggaggcccgcgggttggagggactcgagcgtcagggcgtcgctgccggcggagctcgtgtcgttcctggactccgaagcgcccggcagacctcgccgccgacctgagggtgtgcgcgacgagagcgcgagcgcggctgggccgccgccgtggagggcatgtcgcgctcgctcgcgtcgacgggcggcctcgatcgcgcgagcgtcgcgctgtcggctgccagggccgccgcgggcgacgagcgcgtcgagtacgacgaggaggtcgacctgggcgtctacgacggggcgctgaggtgctcgagggaggcgaccgccatagccgcagacgagctcggagcgtgaggccgcgcaggcggccttccgcgacgccgccagggcgctcttcatatccggcgacaccatcgccgccttctcggctccgcgagcccggccaggtcgcggcgtgcacggcgatgctcgagtcggagatcgcccaccgcgacagggcgaagcgggcggcctgctcaggcaggcgagttccccgtgccgaagtcgatcgaggggttcgactggtcgaatgtggcgttccccgacgactggggtcgcgaggacatgtgctcgctcgcgttcgtgcgcgacgcggaggacctcgtgttcacgccagacggggcgcggaagacccacatggcaccgcgctcgggatcgccgcgacgtccgcgggctaccccgtgaggttctggcagacggcccagctggtttctgcactgggcaaggccaagcgcgaggggcgctcgacagggtgctcgccgacgtggccaaggcgaggctcctggtcctggaagaattcggctacgtgcccttcgacgtggacgggcgaggtgctctaccaggtgatatccgagagctacgagaggaggagagtcatattcaccaccaacgtcgagttcagcaggtggggcaccgtcttcgcggacgacaagctcgcggcggcgatcgtcgaccgcgtcgtgcaccacggcaggctcgtggagttcgggggcccgagccacaggctggaggagagcctgatgctcgggaagtcggggggaaggtagggaggcgccggcgggcccgtgacgaaacccgaaaaactttcgtgcacggacccgaaagaaatccatgctcaaagtcgaaagtcaggcttgactaaacacaggtatgtctcctcgaggagccgtctctcgcagggctcctcatgcaggtacctcaccacgaggtccgcaaacatccccaccccgacgcacttcctcatgctcctgccgcccgtatgcttcttcgccatcattgtccctccccgttgccaccgcagtcttttctcgggcaatatggtgcgacgggatgcggatagaagcatgtgctcctatgcccgaagtggcgagccacaaagtgattacgttttatggctttccatagaaatgtcctttatagttgccttctaggaatttaataacgtcaggtgaggtctttaggaagctatcattaactggttctgcgatgtatagattcttaaccttcgtgaggcgcgacaaggccgtatacaactgtccatagtcccaacactccggaaacactgttgccgaatcgaaagtttggccttgtgatttatggattgtaatggcccaggcaagttttagtggtacctgcgtgtatgtgccgacagtctcactttttgtcttcccgtcggctattgtcggctttgtgatgttccacgtatgcaaaggcacgaactcagtttggcctccatcgaacgtaacagcgacaccgtctttattgcatttaattactgttccgagggttccgttcatataagtatcctcgcggtcgttaattagtgacatgacgcgggcacctggcttaagtattagacgctctgctgttggcatatccttctcttccacttctccggtctttttgccgatgtacgtggtagatgaggagtctaacatcccaagtcgcttgttgttttcgctgttcgcctttgagttgcggccacagagtactattgcgttctctatcgggtgtttggaagagtgttctgaaatccagtgcacacctcttgtatctcccaccctgcaggcgttgagtgcggcgacaaagtctgaatccctttgtcttattgcctcagtaagctcaacaggtttgaaggtccatctgtcccaatatttgcccataaacgcgtatgcgccgccaacatcaaatccgtacttcttctcgagtatcggacgctcgtttttttgtactactggtgggagctggcagaaatctccgacaacgacgagctgacagcggggctttccttccttctccctcatgcgggcggccttgaaaagaacgctagagaggtagtcaaagaggtccaatctgcacattgagatttcatcgacaatcatcaggtcacacttgggtattggagagccgtcttttattatcggatatgggttcatctgaagtgttttatttgggcttatgtctagcgccctgtgtattgtcgagcccccgatgttgagagcagctataccggttggggcacaaacaatcacattcttgcccgctttgctcgcccactcgattattttattaagtacataagactttcccgtcccgccaaggcccgtcaggtagacgttatgtccatcttttactaggtcaaatactttttgttggccattagtgagtccggaaaagttgtttgagacgacttttgcggaattccattgggcattgaaccttgcttcttggctatgtagaacgtccattgcgtcttgactgtttcgcctgaaataggcgagtagcgcgttctcagaaacaatcttaatttgtgccttaccggttagattaagagtcagagctttctcaatctttgttccaaagttcccgaatgaccacgcctcgctgcccttgttaccacgtactacgtactgaacctttttcgacgtgccacccttgacggtgccaccggcagcagaaatcattttctcgacggtctgcttaccaccctgtatgtcgaaatcccccgtgagaacgaagtttttgcccgatacctctgtgactggttcgttagatataggctctttgagcgtcttctcaaaggacaggagcagatccttctccgagctgtccactcttccatctttgacgatgtcccttaacacagtggcaagtgagcttacaaatacgtcatcttgtatgtcagcgtattgtgtctccatcagctcgataaggtttcgtacgtcatctatgtcggccttttgcccctggcccagctcagtgatttttcctatcaactcagcaacgcgctttgtctcttcgctaatttttccgaattgcatctacgtccccttatatagctgatgacttaagccacgttccgcgcatggtccctgaattaaacatattggtagtatcaacctccattgattcgagcctttggactgccttatcatttaccagcgcaaacgcaggggaatttgaaaacatcgaggcagcatacttaagggcgtccatatcccatttgagcatgtcgacgactcgtagtgacatacaaccaaagaacatcccgctcatgctcgtcacgttcgatatgtcgagggatccaatatcaagcagagttttgatggaagagcaccctctgaacatatttgccatcgaggtcgtctttgacgtgtcgagcttctgtaggtcgaactcagcacagtattggaggccgtcgaacaagtatgcgcaagattcgggggcgtaggtgtcggatataacaactttaccgataaggtctctatagtcgagttcttcgttagtcgccggaacgcgacccatgtcctttttatttggcctcgaataccatggctgcgaactaaactcgggaaacccgctttcatcgagcggcccgcaatcgatgatgttccatccgccgtcagtggtcgactttatggtcgtgtgttgtatgaacagtttgtacggagctttgtggccgtcccatgctggctcattactgacgtcgacctttccaccgacgagctcgtcgtccacgatgacccacctgtcggcaaccccatcatctccgactctcagtccgactaagtgccaaaactcgtcctcactgatgacattgatgtctgaatcaagggcattttttacgtaaatggggacgtcatcactcgaattcaaagatgccataacgttgttgccgactacgaaaatctcagtcgacttaacgacgcttttctgtggggtaccaccacacagttcaacaacctttagtccctcgactgggtccatcgtgtccagcttcttgccgaaggctattctcttcccggcaagcttgaactggctgagatccttcgacacgaacgagcgttggctagcgaaagcccatgcctgatggtgtccctatcgtagtccttctcatctaggctgccctctggttgatgcctgtgtagtaccagtcgttgtattaccatcgggctggggtgtcgtagagccgcgcgcctggtgcatgcgtgcggttgtttggtaagtagttcaacaaacgtcggcgatgagccttaagccggcagagtcgagtactcgttgctccttagattctcctcattgagtgtgcggaaccacctttccatgagcacgttgtccccctcctcggccacgcccgtccatgctctggggcgacgtggctgtcgtctaggaagcctcacgtaggcatcgacccgaaaccgaccctggtcggatttcatgatcgaggcgtgccatgtgccttgacagcctgctcggcgcacgtgacgacctcctctatgccccatggttcagagagcctcctcccaacgatgtagcgcgcgccccgtcgatcaggccgtgaggtacatatggtgtcccccagcgtgcacatagtgatgtcggtcgaccagacctggtgggaagcggatgaccttgcagtggagcagttaggaaactcctggagttcttggaaggcgcagacagcgagggcagagggcagcagggcctcacgttcatctcgtgcatgagcctggtcacatcccagcgggtgacgtcctcaccgtcattctcagctgccttgcgatcttgcgtgcccgtaggcagggttaccgcgtgtgatctccatctatctcggctgaggcgctcgtcgtcctccgaaggtccctgccttctccttgtgctcgtaataggtgcttgagcgggcagcccagaatctgaggcacctctttgcgttgatgccgtcatgctcacctgcggctgcccggcacctgtccggggtcgtagccttggctgtcgcaaaacctttggaggagtcgcgccgacgggagctgtgccgatcgtcttcagcagccatcgtgctccttcctcgcggcttcctccctggccttcctctcgcgctccttctgggtgtcttgccgaaccgtcggcggcacccttcctcgaggagctggtccctcccactgggcggcgacagactgctctacgccgttctcgcttgccacctgactcaaggtcgttctcgcccttgtagacctcgagggcgaccctcatcttgaacttgggtcgtacttccttctcgtcgtcttgctcatggcaatagcccttccgtgccttcggcccacctagggctttcgttagctcggcttcaaacgtgtctgaattgggtccgccatatcagctcaatcccctcaacattcgtattgaccgttcatattctcttccttgatatcggcatgccgctgttaagtccgctctggtatttgtctgggccccactgacccttcggttcgccaggggtgaggagcattaggtccagagggtagcagcatacagcggaggcgctttcgctgccacgtaacggcacgaaccgcccgatggaccgaagggctgcttttcgcgagagggaccagggagttgctagcggtcgtagattcacttcatcaatccagcctcaccctcttctccatcgagttggtgttgatgatttgactgcatgcgcgaacacagcagcaagcggggtaaaaataaggggaggctctcgtcccgccacataaaaccctctcgggtttttgcgatctgcgtccattactagacaccgggattggcggtcaatcggttcgtggtctggacgtcgccgtgctaacgggggccactgtgttgtcgcattctgagtcctacgacggcattgaaggacggggagcggcaatcgcgactctcccgctaccgtggggcatcgatgcgagcgacgagccacttggcccacttgatggcttccgcgaggtccggcagcacgccgagccccttcgccgggggtgcgtagagctcgccccagccctgctcggcgacgaccggcggtcccaattcctttgcttccggtaggcgaagagcctcacgcagaaccgtctcgtgccgccaggtccaacgtcggcgttgcccatgatgagctggaggtcgacgaggtcgcgccgcggtcgccgccgcccgtgagccgtgagcttctggggcaacctggtagcaaggtccatgagggccacgtcccgcggcggggaacgccgagtctcccgagggcgtccgaggcctcgtgcctggctggtcgcgtctgccgctcggcgtcgccgactcgtccgaaaaaccccacctcgagtgcaccgtgcacgcagaactttcccaggtaggagaagcttcacgtcagaagggacgcacacgtaactcgccgggatgtccggtgggcgtgggcggcgcggggcgacgacggcctgaatccctccatccggcggcgagcgcatcggagagcctcgcacgtgtactcgtccggtcgctcgccggggcgtgtcggaggtcgtgtagtacgcgttggccccggacccgaagcgctcctggacgcgcttccgcccttcccgacccccctctgtcatcacgttccactatggccgctggccaacgaaggtgccatgcgcactgtagccgtcggcggtgccgccggaggccctccggatggcgtcgtccaggtgcctcatgctgttcgggcgcttaggcatgggcgcccacctccccctcgatctccgcaagctcggccggcgtgacgtagcccatccgctccgcctcgcgcgccgcgtcgacggcgcgggcgggccccagggtccgggcggactcgcgaattgcctccgccgcctcctggcaggcgatgccctcgtacagcgtgaccctgtccgggtgcctccgccagacgagcctcacgccctcgccgaggctgcgcctggtcctcctgggcgtcgccacccggattgcgcgcgggtcggtggggcagagcccgaggagcgccaccacggactcgccgtagaggtaggcgccctcgcccgcggccctcacggcgatcgcgtagggggcttgctcctggtagggccacacgggcacgcggtagacgcccctggccacgcgctcgagtttgccgcgcgccgcgtactgcaccacctccgcgtcggaggcgccgagcgccttcgcgtccgcggacgtcacgaggccgtagtcgtcggccgccccgtatatgtcatctatcttagccatggcaatagtatagcgaagacactctacatttgacacatcctcaatcgtacgctccataatgcaatcctccaaagtcgccatcggcgttccgttcgccccagagtgtgcgtccgcacgcgctgcggcaaccggactctcttccgccccgaatccgcttcagatgcttcgatgggtgccgtctgcaccccgttcctacgagagtcccgcggacatgatcctgcccatgaggtccatgccggccttcttgctgtctgcgagcgcgtcggcgtagacgttcaaggtcatcgcggcgttggagtggccgaggatggcgctcacggtcttcacgtccacgccggagccgatcgccatcgtcgcgaaggtgtgcctcaggtcgtgaaacctcggcggcttgccctgggagcccacgagcctcgccaccctcacgaaagcccgccactcctgtcccagcgccatggggctcttccaggcgccggtgacggcgctgcccacgacgaagagcccctcgtcccagtcgaggcccatcgcctcgcgctcgccgtgcatggcgcgcgcccgcgcctcaagcacgcgggcgagctcgtcgccgtaggggatggtcctggccgagctcctggtcttgggcgtggagagcgcgaaggtgccgttcgccctcgtgagcgcgtgcgagacccggatcttgcgcgacacgcggtcgacgtcctgccacctgagggcgcatatctcgccctgcctcatccccgtcatgagcgcgaggagcacggccgtggagaacgggtcggcgacgcttccgagcgtctggttgagctgccggacgcttgcggcgtcgagggagtttatcggcttcgtgggcctctttggcgcgtcgacgaggtcgaaggggttcgacgggatgtcgcccagcctgcgcgccctgatgaaggcggtcttgagcagcacgtgggtgtgggagacggtgttgccgccgtatccgtcctgcaccatgtcgcgctcgaactcctggatctgccttgcggtgacctgccccacgggggtcttgccgagctccgtgcccagcaggtgcttcgcgtaccagcggtagccgtccgccgtggaggcgaggatgttgccggtggactccttcatgtctatgtagtcgaggacgtagcggtagacaggcgtctcgcaggagacggtgccggagagctcctcgtcctttcggacctcctcgtcgcgccactccctgaggaagtcctcggcggcgcccttcccgcggttgtccctggtgaccttcccggtcttcctgctcaccctgtcgggatagcaggcgacgggggtgtttcgcgtcatcctcctctgcctgccgtcctcgtcctgccagctgatcgcggccctccagtggccggacctctcgtccttgaagacgaacccgttgctcagtttcctcggcaccgtgccagcaacaacgattgaactcatttgcgtcaaggggccactggttcgaattcagtccacaagaccacgagagatcaggtcaaatacctaatcctctgacctatttctttacaacagtgacacaatcgccatgccttcacagctggctattagtacacgacgtggctggcatgggaaagatcgcactgcgatggagattgcaatggtgaataacggcttaataggctctcatgaaggcggctctcgatgagctctgcgcgctcgaggaatacctcgaggctgaagtaaccagagtcttctgcccagagcttcccctccgcatagaggcggagggtcggagccgagaggattccggcctgtgccgcaagcttcggatttttttcgagcgggatgtagatggcatccaggggaatgttgtctctccttccgcctctctcctcgagccaccgttccgtctttatcttcaaggtttgacacggagcgcagcatgccgttccaaaaagcaggaggaccagaggagcgcctgcacaggcgacggcaagcgtctcctccggtccaatcgcgcgaaggtggcagctgtccttgctccccatcagagatgtgagtcgatacggcttgtgagcatggacttcggcatcgcgccgaccatttgatcgacgaccttgccgtccttcaggatgaagaaggcggggatgctcatgacattgaaggcccgggcgagttcgggttccttgtcggagttgaccttgccgaccttgaggcgacctttgtactcgtttgcaacctcttcgacgaccggcatcatcgaacggcaggggccgcaccagtccgcatagaagtcgacgagaacaggctctttactgtcaagggcttccttctggaagttgtcactcgtgaactggtattccatggcttcactcctctttctggagacgcacgcctcagtgcgtcttcggctttacgatgttttcatcctatgttggtataaaatgcggagcaagtacgcagtttgtatatacgtgataaggaaaaaatgagcattgacggaaacgacaggaagctcggtccctgcttcgcgagcgccgatccgagtatcacgggatcgggctgtgcactcaggagagtgctcgatgcgattggcggaaaatggaagattctgctgcttgtggcgctctcgcaggcagaggagctccgctacggagagctcaggcgcctggtctttggcatcacgaacacgatgctcgcatcctcgctcaaggaactcgaggaggatggccttgtgaataggacccagtatcccgagatgccggttcgtgtcgagtacagcctgaccgagcttggcaggtcgctcgtccccctactgatggagctcaaggcctggggcgagcgggcatatccggcggtgggggactaggcacagctgtgaacgcctctgatgccgttcctttagtccattccgagccacgagttcgtcccgcgcctctcgaaagggaaaatcgttcggcaggcgcgtggggccgtgaccttgcctcgcgtcgaatctctcgcatgcgaggctgtcgggcgtcctgatgtagacatgatgtgccgcctccctcgtgccacaacgggatgaccgctcctattagtatcagcaacagatacaagtacgtacggaacaggagccactatgccatccgtcgccaccatagagaggcgcgtgagcgttaggacgtatcgtcccgaagtcccagagaaggacgtgctcggtgagttttcatcacgcctctctgctatcatcacggaccctttcggggtacctgtcaccttccgcctgctcgacgcggaagccagtcacgtctcaagtcccgtaatagtcggtgccaccacctatctcgccgcaaaagcgtccaggtgctccgggatggaggaggcctttggctacgccttcgagcaggcggtgctcgacgcgacggatatgggcctttccaccgtctggctcgtcgcaaccatcgaccgtcccgccttcgagcgggccattgatcttggccccgacgaagccatgcctgcggtgagtcccctgggatatgcggcggacaagcgctcccttcgtgagagtgtcatgcgtcgcagcatgaagtcggacgaacgcctacccttcgagtgcctcttcttttccggcgacttcggccatcccctctccgagagcgaggcaggcacctggaagacgccgctcgagatggtgcgcaaggcaccctctgcgaccaacaagcagccttggcgtgccgttgtcaaggacgggacgtccatttcttcgagcagaagactcgcggatacgagaaggatggtgtggacatccagaaggtcgaccttggcatcgcgctctgccactttgaggttgccgccacggaggtgggatgcgccgggcatatcgtccgggaggatgcggggttagcgacgccggaagactgcgagtatatcgccacctggaagcgggagggctgattcaaaggcgccaggccgctccctgcggcagcgtgcctatcaagttaccaggtcggtgggaccgatgacatcaggagaaattgcaacgagcatcggcatcagcccgaaaatatgtaccggctcgccgtcgtttctagcgggtagcggaatgggcggcggacctctgccgtccctctcgattggtgcggggaggacgaacgcatggcacttggacgggcgtcaactcaggaagtcatgagagacggtgacgtcaagcgcgccgcgacggatgcgcgtgcgcgcgaaaggcagggtctcgtttccgcggtgaggcgcttctcgcccacatgcgagcaggaggagagggacaaggcgctcattcttcgctggcttgattgccgcgactgtcctgacgtcagcacgcgcgagaacgacgtggcgcacctgacggcatccgcgtgggtggtcgacacggaccgcgaacgcgcgctcatggcgtaccacaggatctacgacacgtgggcgtggctgggcggacacgcggacggagacttcgacctggcgcgcgtggcacttcgcgaggtgggggaggagtccggcctcgcccacgcgcgtcttgcgtcaccgtcgcccgtctcgctcgagacactctgcgtgaacggtcacgtcaagcgtggtgcgtacgtgtgcagccacctgcaccttaacctgacgtacctgatcgaggcggacccctccgaacccatccgcccaaagccggacgagaacaaggcagtccgttggttcgagaaggacgaggtccttgcgaacgtgaccgagccttggatggccagatgggtgtaccccaagctgctgcgcctgatgtgagcatcgcggcgcgatcgcgctcgcaggacgcctcaaaaaggctggcttggtgaggcgcgaggactcgcgcaatgctggtacctagggggggttcttaggcgtcgttggatgtgttgccgcatgggtgccttgcagaacacatctcgcctcacttcgatggttatcggcaagtgcgttggttgcccagaaggtcggtattgtcgccatcgcatccccatccccctacactgcccctcatcccctcgcgtctgcagtggggattacagccggaagacaggattcagattgcatgttccgcggggtgtgaggcgaagtaccatgagacagatttatgaacttggatggattgggtgggaagagcatgtccgcggcggagacgaatgtaccagggcaggataatcgcatccagaggcagtgccagcaatactttgacctggtagagggtggcatctgtatcgtcctcgcagatggttcggagcggatcgtcttcgccaacggcaagatgacgtccctctacgagtgcgagggtgtggatgacttcctgctgctgtgctcctccaactttcgaaacctggtggaagaggaggactacaggtccctgtcggagattgccgccaatcacccggagcacttctccctctcgttccactaccagacgaaggggaggcacttccggaaggccgagggggtgggctccctgaaggagacccccttcgggcaggcgtacgtgcttctgctcttctcggcggagcagctctccagtgacctgaagggcgaggacaagactggcgtgctgggcatgcacgacttcttcaaggaggcgctccggcaggcggagcagcggatgtcgcaccccgaggtccgtgccttctgcccggtctgcttcgacctgaccagcttcaaggaatacaaccggcttcatggcatgcacaagggcgaccagtgtctgaggagaatcgccgagaccatcacgggatgctttccaggggcgctggtcggtcatcttaccggggaccactttgtcgcgctcctgccgtcaaagggcctggaagagaggctcgagcatgtctgcagcgaggtgaacctcttcatcgatgatgatggtatccagctcaaagccggagtctacaagccctcggagaaggacaccctcgatgacctgaggcatgcctttgacgcggcgaaaatagcctgtgacagcatcaaggcggacggaaaccggagcgtcgccctctacacgcgcgcgatgggggagaccatcgccaacaagacctacatcctgcgccacttcagcgaggcgttggagaagcactacatcaaggtgtactaccagccggtgattcggacgctgacggggaaggtgagcgggttcgaggcgctggcacgctgggaggaccctgcactcggcatgatactcccgggggtcttcgtcccggtgctcgaggaggcccagctcatcaaccgtctggatcggtatgtcctggaccaggtggcccggctgatccgtgaccgactggacaacggcctgcccctgattcctgtctcaatgaacctctcggcctatgacttcgatgtgtcgagtccgctggataccatcgagaaggcggtgaggcgctaccagattccgaagaccgttctctgcttcgaaatcaccgagcgggtcatgatacgaaaccacatcagcatggttaagacggtccgcgagttccaacaggcgggctaccaggtgtggatggacgacttcgggagcgaatactcgtcgctgagcctgcttcacaactaccactttgacgtgatcaagatcgacatgggattcttcagccatttcgacgaccggagcaggcagatcatcacctcggttgtgacgatggccaggatgctgggggtgcagaccctggcagagggcgtggagacgcaggagcaggttgccttcctgcggaagattgggtgcggtcggatccaggggtactactacggacgcccgatgatgtacgaggactcgctgtccttcctgcacagcaagagccttcagcttgaaaagccggaagaggcctatttgatgggcgccgcggagagcgtcaacgtggtctccgactccccgacggccgtctttttcttcgacggaaagaacgtagagctcctcatcgagaacgacgcctacaagagagagctgaggagcaccggaacgctggacatggcagaggccaattccaacctcctggattcggggtacccgttccgcggaagattccagcagcttatggcgagggccctgcggtcaaggtcggaagagaccctgacctatgcagacaacgggcagtacatgagggtcaatgtccgctggatcgcaggggacgagcacaactgggttggcgaggcgcatctctacaacatcagcaacaacgcggcaatccggcaggccaagacgctggaccagttgctgcgaaacctgttccagctctatgaggggttttacctgttcgaccgcgggagaggggaggtccgggtcattcgctccagtcatccggagctgagcctggaggagaccccccagggggtcaaggcgttcaccggctacttctcggagcgcctggtatacccggacgacagagaccgctttgccgccttcgccaaccccgaggcagtggaggccagaatggaggcgggggagggcaccccccaggccgagatcgtgcgcattcggagggaggacggcgcgtaccggtggacggtgctcgaggcgctgatgatctacaagagcgcgaccaagaacatcctgctctgcgagcgcgaggacatctgggagagaaagggagacagggacgagctcctgccggtgttctcccgatccttcgggatttcggaagccgggaccgttcggccagaaacgattgccgaaagcagcctcttccgtacgctctgcagtgattccccctacccgttcttctgggaggacagggcgggacggattctcggtgcgagcaggaacctcctgaagaaggggaacttccgcgatccggaggaggtcctgggaaagaccgaggaggagattggcaaccacatagaacggccggaagtggattcttccgcagtgagtgcaccgaacgatggagggggcgccctcgggacggaggagctgacggtttcggacggcaggctccgagaggtcaaggtcacgcgtgttccctggtatcaggagaaagagatcgcgggaacgctgggcatggtttacggggccgaacggggggacgaggatgtggagtcgcacctggggcttgtcgaccacgagacgggatttctcagcttcaggggggcgatagaggcggggttgctctatgcggaccggtatcgctcgaggaagctggatttcgtcggactcctgatcgatgtccccgccttcacggaggtgatgcaagacagcgccgataacgcgaagacggttctcaaggaactctcggatgcgcttcgcaagtcgctgaccccggggtgggctgtcgcgcggattggactctgccgcttcctctgcttctgcaagagggagagtgccgggaagatagatgagaagcttgctggggtctctggcgtccttccgcccctgtggaggcggctgggaatccggacggctcccgtgctgacgcatgcggttgcgtatggctctgaggtgatgagcctggacgagatgctccagctcatgaccaggcgcctgagcagtgccgagaaggaggccttcggagacaagccttacaccgaggaccgcatcttcgtcagaagggaggtgctggacaacctgcgggaacgggtcatcatcagcgacccgaagacgtatgagctcgtgtacctgaatcctcctgcccgcaaggacgtcgggattggcctggacagcagcctgaaggggcgtctctgctacaaggctcttgagggctttgacgccccgtgcagaaactgcccaaacatgatgctgcggatggaccgcgccctctccgcatcccacatgagcaacaagaccgggaagaacctgttggtccgctccttcctgatcacgtgggagaagcgcacgctcaagctcacgattgcctccaacatggatgagtacatcgacacgctggcgaaggaccacgagctggtctaccaggagatgcgggcgaacgaggcgatatctcgtgggatgcaggaggccgaccccgagaaggggatcgagaggacgatctcgtgcatcgccgagaacatgaagcccgagcggttcctgacgtttgaggagagggacgacaacacggtcagcgccacctacgaatggacggccccgggcgtggtcccgctgagggaggagctgcagagcattcccaggacggaattacgggccctgtacgcgaagttcgtctccgagcggctggtaatggtccgcgacatggaggcgttccagaaggagtatccgggcttctcgttcaggatccatggggtaaggagctttgtgtccggacagctgctgctccagaaccagagggagggcttcaccctggtcgtcaacccgtcggaggagagcttccagaccagcagcgttctgtacgcgacgctgacggacttcatcgcagtgatgattcgcaacaggaacagcattcgcgagctggagaggcagggcatgatcgaccagctgaccggtgccggtaaccggcgcgcgctggaacgccggatccgcgactggcggggagacggggtgctgggtgtgatatcgatcgacctgaacgggctgaagaacacgaacgatacgaagggccaccatgccggcgacatgctgatcagcgagacggcgcgggtcctgagggaatacgcgggggaggactgcgtgttccggaccggtggagacgagttcgtcgtcatcacggaggacctggaggagcgggacatcctcctgctgatccagcacatgcggaagagtgcggagaacaacggcatcagcatggcggttgggtttgcaagcatccgcgggaaggtgaccgacttcgacgcgctgctcacgaaggcggacttcaacatgtaccaggacaaggggcacagcttccgcaggaggaggggggaccggtagggctctgcttaactttacccggcctcgtgcggattcggtcgggccatgcttagaagtccccggccccgtgcggattgttgcaacaaaactcgcgtgagggctagggggattaagcatcaggcgctgaaatccgcacgagggctagggaggctaagcattcggtcacctaatccatgctaggcggggtaacccagaacaccggacacgtgagggcgctggaggaggagttggacgactacctcaacggcgactacgacgactatgcgagctgaggcttgacgtcaggccttgcgctgtctgctgcgctgcatctgccggtgagcggcgtgtgtgcgacgcatgcggagacgtcgtggccaacggaacgggtgacaggtaccatcggacgggctgcacctagtgccacaattgatgaagttacccttggtcgtcacgggagagggagcacatgccgctgcacatcgtcgaggaggcaaaccgctgcctccaatgccgccgtccgctttgccaggagggatgcccggtccatacctctatacccgaggtcatccgcctgttcaaggagcacgaccttgaggctgcgggtgccatcctcttcgagaacaaccccatgtccgccatctgctccatcgtctgcaaccacgggagccagtgcgaggggcattgcgtgcagggcaggaggggcaacccaatccacttctcgtccatcgaggcctacgtgtcggagtcctaccttgggcgagacatgcatcgcatcgtcgaggcgaaggcggcgccaaacggccatgctgccgccgtcgttggctcgggccccgcgggcatggtcgtcgcgataaagctggcgcttgccggctgcgaggtcaccatgttcgagcagaagcctaagatcggcggcgtcctggagtacggaatccccgagttccgcctgcccaagagctacgtggagaagttccgcgagctgctcgtctcgcttggcgtgcgaatccgcaccgccacgaccataggcggtgccctcaagatcgaggacctgctgagagacggatacgacgccgtcttcgttggcaccggggcgtggagggcgcgcaccctgggcatcaaggggcaggcgcggggcaacgtcttctttggcatcgactatttggtgaaccccgacgactgcgagaccggtcgcaacgtcgctgtgatcggtgtcggcaacgttgccatggacgtggcacggacggcgctgaggaagggtgcccgccacgtgaccctcttctcaaactggggcggggtctccgcctcgtccgacgaggtcgagttcgccgagctcgatggggcgcagatccagtacggcctctccgtggtggcggtggacgagaggggacccgtcttcaggcgctcgatgctggcggatgacggctcctgcgtgggcatgggcgacgagacggtccgctttgacgccgacacgaccatcttctgcgtgtcgcaggtcccaaagaacaagctcctgctgacgacgagggggctcgaggcaaccgacgaggggacgcttaaggtggacgagaatggcatgaccacggtgccaggcgtctttggggcgggtgacgtcgtcacggggcccaggaccgtcgtgcacgcggtcgccggcgccaagctggcggcggagggcatgctgcgctacatgggcgtctcgggggcagctgacggcccatcgacggatgccttgttcggaaatacagtatcccagaatttgggtgcgggacatgttggcgagtctcgttcgagagccatcagtgcgggaattaatgagacttagcttcaggaatagttagggggcaagtcatgggatcgaggacggaagaggttaaatcgtacgtggagccgcagataaaagcggagacctccgacatctacgcccacctgggcttgagcctcccggatgctgtgaatgtgttcctaatcaagtcgatagaggttgggggactgcccctcgacatgaggccagagccgaagcactgctatgcacaatcaagcgtgcgccccctgtcgggtgtcgtcatccgcccccacaagacggtcagcctcgaagagggttcgttcggttcgttcctgttggcttgtggcgaggcgctccgaccttagaagcaagttccgtccccactggtcgggtctcctcgacgggcgagtgcgaatggggtctgcaaggctcgcaggtgagagcccaaccctgctctaggggccttgccccaacagcgccgtttacggattaccaccagataccgtggttatgaaaaccttactcgggttaatctttctgtgcaggcaaaacaactcgcgaagggaaggccatggatctcaatctgaaggacaaagtcgttcttatcaccggctccaccggaggcattggctccgcaatagctcgcgcgttcgcggcagagggctctaagcttgcgctctcctcgacgcgccaggaaaagctcgacaggctcatcccacagctcggagtggacgacggtcatgcaaggggcttcgtctgcgacgccaccaaggaggagcaggtcaagaagctcgtcgacgacacggtcgccgcctacgggacgattgacatcgtggtctgcaacgccgggtacgagggcaaggtctgcccaatctcccagcaggcgacgggggagttcgagaaggtctacaccctcaacgtctactcgccgatgtggctcatgaagtacgcttcgccggttcttgtggagaagggcgccgggtcaatcgtggtcctcgcctccgccggctcctacacgcctaccgctacgatgcaggcatacgtgagctcaaagtacgccgtggctggtctcaccaagtgcgttgcgcaggagctgatgcctcagggcatccacgtgaactacgtctgcccgggccccgttgacaccgacatgatgcgtcgcatcgagttcgacacctttggcgatacgaagacccacgaggaggcggaaaagatcttcgcctccacggcgctagacaagcgttacgcgcgtcccgaggaggtggcaaacgccgtcctgttcctggcgtcggacgcaacggcgcacacgaccggaatgggattcaacctcgacgcaatcgttcccgcgcactaggcgcgatacgttgcgcgaggggtcgggagagacgaccccatcccgtttgtagaacaacgaggagaggggcgaggccaatcgggtcccgcccctctcctcgtttgtcagccaggtctcagagcacgatggcgagcatgatgcacagctgggagatcgcgttcaccatctgctccctccagttcgcccgcgcgtcacggccgtccaggtgacgggcgaaccaggacatcaggagcatgcccgcaatccccgcgacgaggaggggaagggagggcagggaggtcgcgtggcgcaggacggcggcgggcgaccaacgtgcgcggtccactgcgagcgaagcgagcgccagcgcgaagccgacgggcatcaggtaatgcatctgccgattgaggaagcggacgtccctcctcgccagcgcgatcacgagcttccaggacaccttgagcgctccggcgagcacgaccagcgcgatgccgactcggaacagggggctgtcgaagcgcgttgccagcacgctcgcgccaatgcagaagaatgccacgggcacgcagtcaagcagcgccatcgggagggtgaatccctcggggacggagtccccccgtccctccgcgcgggcgctcacgcgaccagccacttgtgatccttcacggagtagagcggcacgaacgggatcatgatcggcgtcctggacttgtagtcacggtactcggggtcgcccccgtagttcttgtcctgacgtatctccagacgccgcgctccgccaaacatgacgtagatgattcccaggtagccgaggatggggcagacccattcgacggcgttgccgtacacgctcagccctgatgcgaagacgccggtccagaagaccatctcgccaaggtagttggggcagcgcaccaggcggaagagcccggtgtccacgaagcgccctggcctttctcgcttcgcaaggttcttctggaggtctgccgtcgtctcgaggacgagtcccgccaccgagactaccagtccgatgacgcaaaggatatcggtgccgcggccatctgccagacggaacaggatcggggacgtctgcagcgcgtagaggagcgaggcggagacccagattcccacctttgccgccggggagacgccgtcgtccgacttgacctctcccttcattcggcggctgtaggcggtcttcacgtccctgtagatcagatagccggcaaggcggcatccatagacgacgagcagggcgcactgcaatgcggtcccgacggtgagggagtcccggaacagtgcgaggagaccaacgccgatgaggccgatggccgccccatagccgatggagatgaaccacacgtacttgcggaagccgcaggaactggcgacgagggccagcgccaggagaatcaggaagcttctcatgtatgcacctcagaatcgtgatcgacgcaggtaggggagacgaacaaacacgtgcgagtgcgttccctccacggccttgcgcgggccgaccatgcaaggccataccattgtaaggattgcggggggtggggacgttgatgccaacacgtccagaggcaggccaggggaatataccctctggccggcgttttttctggcgctcggttgggttagaaccgtcgagacccgcttaggagagaggaagcccgggattctcctcccggatgtagcgcagtgcctcgtcccactcgtcgcgaagcaccgcgtctctcgccttgccgcgctgcttctgcgcccaggcgtataccgctgctggcttctccccggcgtcgagcctgtcacacacctggaagtaggggtcctcgtcactgaagaacttgtcggccatcggagcctccttggattgggtgccacgttgaatctggtacccaagtgactggtagatgggtggcagaatgctcgtttggacatccctggtgccaggatgaccgagggggcttggtgagagactctgtcatcatgggttgcgaagaatcggcatggctggtggacggttccacctgtgacccatcctcattgggaggatgcccatggatgcactgagagaccgcttcgagacccattccgagcgccatcccggaatccgctgggacgacgtcgagcgagcgctgggctcctccggcttgcggtcgctctcgtatctggaggagacgggcggtgagcctgacgtgctcctctttcgggaacacctctacctggtggacttctcgtccgagtcgccccagcgtcggtccgtctgctatgaccgcgaggcacgcctagggaggaggcgcaacccgccctctggcagcgcctgcgagctggcggaggcgaacggcctggagcttgtgggcgaggacatgtaccttgcgatgcaggggctgtcgccgctcgacgaaaagacgagcagctggattgcgatgccagagacgattcgcgggcgcgggggcgccctctttggaagctggaggtacgaccgtgcgttcgtctactgcaacggcgcggactcgtactatgccgcccgcggctttagggcgtgcctcccacttggcttgtagctggacatgcaggggaggggcgaccacgtgccgctgctgaccccctccgacaagggcgccccgctcgtgctgctgtcgcttctcggcctgggcgtgggcatcggcctcctgatcctgcgctggatttttgtgcgcaggagggccaaggctcccggatacgccccgcgccacgcgcgcaggcaataggtggatgacacgagccgtctctcgtttgggggatggctcgtgttcttagaaccccggttccaggcacatcatcatgtaggttggcagatagcagatcgcgccgtctttctctacattcccttcgtgcagaacgatggcgcgctctatcccatagtttctcgtcttcaacgccttggtcagggcgctatgccgcttgtagccctttccagatttcacctcaatcgggacgactcggcttctcgtctgtacgacgaagtcgagttcgccaatctcgcggttcttgaagtacgagagggggaatccgtgacaagtgagctcctgagcaactgcgttttcgtacagggcgccgaaattgatgtcctcgcggtcgctcagaacgtctcgtaccacgtccatcccacattggaacgtcaggattcctacatcggaagagaacagcttgaacctagtcgactcaaggtttgttgccagcggatagcggggttcggtcacattgaatgctggcagtgcaacgttggcatcagagagccacatgaagtcattatcgtagcggtcaaagtgggagtctccctcgacgtctcgaatgatgaagcgcttgtcctgacggctgatttcgctcggcatgaggtcgaagatcctgcgtacaacgcgcgcacgatctcccgcatactttgagatatcaaagcgatattgtccaacgattgcctcttgcagcacgcgaacctgcctgatgttgtccgattgcgcgaacgcttggacggggtcgggcatgcctccgcagatcaggtatcggtgaaagaggtcggtaagtctctgatgaacgaactcgtcgaccggtcgcatctccctaaagcaacccctgacctcttcaagggtttctgaggcaatgccgtttgcccatgcaaactcctcgaagtccaatgggtacatcctcaccgttgacaagtacccaacgggcgctgaggtcaggcctttgagctcgactcccagcatggaacctgaaagaatgtagtcaaagtcctggcgttccatcaggaactttattgcagtgacggcctctttgcactcctgtacttcgtcgaggaatatgacggtctttcctggaatcatcggtacatccgcaaatgcggtcagtcgcatgaacagctctcgggagttttttgcagccgaaagtgcctctgctgccgcagaattctcgtagaggttgatttccgcgacgtgttcccaatgagcgcgggcgaactcccgcaccaaataggttttgcctacctgacgcgcgccggttaccaggagtgcctgttttgtgtgatagcgaagccagtcttccagctgattgagcgccttccttttcagcattcgaacaccccctggaaacattaggctgtacctcggagtataggcagttgttgtcaatttgcaaaccggctaaagggctgtttttgtcaatttgcaaaccaaatattgggacgaatttgtcaatttgtgagcaactgaagagtccttcttgtcaatttgcggacatctcgtctaggactcgcctctcgggggcattcccgtcagagtgtggtcctggagacagagcctcgcgcccttgtgggtacagtggtgccatcgggaaggagaggaagagctaggaatgcaacgcgcaaagatgatgacaccctgctcgagagctttgactctggcggggacagggaagcgtactttgacttcgagcatcccgagtttcccaatcgcgaggtaaagcgcgtgaacgtcgatctcccgatgtggatggttacggcgctcgattgtgaggcggctcgcatcggtgtcaaccgccaagcggtcaacaagatgtgggtctccgagcgtcttgacgatgagcgtacaaagcgggtcgtcacgtgctctgcagcggtctagcttgccgtcagatgcggtgtgacccctctgctcgccggttggcctcgggatgctcctggtagtagcgcctcttgtcctcgtacatcgcgcggtcgatggtctcgatgaactcctcgatcgaatggctcccgggagcaaggggatattgccccatcgaggcactcagctggtacggtcgcttcacgtccacattgaacagggaaaagctctggcgtatggccgtcatggtgcgcttgaccaccgctccgtcgcgcgtgttgaggaggatgacgaactcgtcgccggcgtagcgcacggtgactccgatgtcgcccaccgcccgcctgagggtgtgcgcgacgtcgacgagcgcctggtcgcccatcgcgtggccaaagcggtcgttgatcgacttgaagccattgaggtcgatcatgaccccagtcatctccacgcccgtctttcccccgtccttgttttttaggtactccaggaacgcgcggttgtagaggcccgtcaggcggtcgcggtagatgtcctcgttctgcaggctggtgatggtgccggcgatgcccacgctcaccgttgcccagaacagggggaggggcgggaagaggatctgcaccgatccgcccacggcgacggggaagatgagcgcccatccggggaagaagcggaggcccgccgtgctcttgcgtaggcgcgcctcgagtgcgaggccgtagaaaaagtagccgtagtcaattacggccaaaaggtcggagaagaggaggtgcgtataggcgttgtgggcatcgacgtgaaataccaggggtgtgaataggttcccaacgagcagcgcaaggcatacgagcgccggtgcagtcagaaggcgacgacgcaggggcgtcacgaggccgagcatgtggagcgtgatgaacagcgcccagcaggagcaggtaatggtggccgccgcgtacaggatggttcccgagcccaccaagagtccccgcgcgagtgccccaggcgcgttctcacacgtcgcgaagacggagtcgagcatgcatccgagcatcgcgcaggccacgagcatccgcaggagcctgctctcgtgggagctttccctcagccgccacacgttgcagatcagcatcgtcaccatgagcagctcgcccagcaggtctacgccatacactgtgagggtgcttggggacacgttcgctcacttgcctaccaattgaactgtatcgttgggaacggtaacagtatgtggccgactggtttatgtttgcaaccattctctcctagttgatatcgaattcagcgatagcgatatagcgaaaacaggaattattcagtgcctctccgtgttgctatgtttggatacgcgttcttctctcatgcatgaggtgggtggagatgcagtcgatcagtgcatatcacgggcgattattggattgccgagccaggaggggttatatgaataccagaatgacgactcgcagggggttcctgttccttctcgccggcaccatgatcgccggctgcacgcgggcgccggagggctcgtccagcgcggacagcgactcgtccgccactgccaccaagtactccgtgcagatccccgacctgtccggttcgctgtgcgccgccccgctgtgggtggccaagcagaggggctacttcgaggaggagcgcgttgacgttgaggaggtctctgccgacgtcgacacccagaagacgggcctcaacaacggcaccttccccgtgggcatgggcgacttctccaccttcgagtccatggagtcgggggtccagaccaccgtcgtggacgcggtgaacctgggatgcatcaaggtcgttgcccgatcggaagacgacagcgtctcgtcggccgccgacctcaagggcaagaccgtcgccgtgaacaagattggcggcaccccctaccaggtgcttgcgctgtggctccagagggaggcgggcctctccatcggaacgggcgacggtgacgtgaaggtgtccgtgtacgacgacggcaacctggagctgcaggcgctcaaggacggcaccgtggacgccgccgcggtgtgggacccctacggtcccaaggccgagaaggacggcagcgccaaggtcatcctggacaactccaagagcggggacttctcgggcagggcgtgctgctttctggtggcgtccaacaaggtgcttcaggaggacgagggagagatcgccgccatcatcagggccatccacaaggctgacaagtggatttcggacaaccccgaagagaccgttgagctggtggccaagaacaagtacgcaaccatcgacgacgaggacctggcggtcgagatgatcaaggcgtacggctacggggacctctccacgggcgaccacgacgtcaagggagacgtgcgctactacgccgacctcctgaacggcctgggcatgatcaagtcctcgccggacgacttcgtgagcaagtactacaagagcgtcagcctggactagggggcctcgtcgcatgaggaggattggatacccggcagccgtggccctctccgtggggggatttgtgctggcgattgcgggaaacgtgctggtgccacaggttgccgcggtcgagatcacgcccgttcgcgtgggggactggctcgtcaacttcaacgggctctatcgcatggtgctgggcgcggtgatactggggtacctgcttgacgcgctgataagcaggggcaacgagaagaaccgctgtgccttcgtccatggggcgccgctgcggtttgccgtgggcatcgcgcttttggcctgggacatcctggggaccaagacccaggtgttcgtgcagccgttcttccccggccccgcccagatcgtgggcgccttcctcgaggagggtgacttcatcctccagaacacgctctactcgctgcgcctgtacctgtggggctatctgctgggggcggcctttggggtgggcacgggcatcctcatcggctggttcccgcgtgcgtactattggataagcccggtgctcaggttctcgggcatcatcccggcggtcgcgtggatgccctttgcgatgacgctgctgcccacgccgttcgccgccgccgtgttcctcatcgtgatctgcgtgtggttcccggtggcgtcggtcaccgcgcagggcgtgcagagcactcccaaggtgctgttcgaggcggcgcgcacgctgggcggcgatacccgctacctgctgctccacgtggcggtgcccaacgcgctgccgcaggtgttccagggcctctccaccgccaacgccttcgcgttcaccacgctggtcatggccgagatgatgggccagccgggaggcctgggctactacatcaacatggcaaagatctggagcgcgtactacaaggtgttcgccgcgatcctggtcatggcgatcctgttcagcgcaatcaccaaggtgctcaacatcatcgaggcccgtgcgctgcggtggcaggaggggcttctcagcaagcagggggaggtggcctgatggccgcaagcaacacggcgggcgagcaggcgagaggggacgcgggtctcgcccagggggacgtcgcgctgagcctgagggacgtgagccgcacctacgccacggcggcgggcggcaccgtggaggccctctcccacgtgagcctggacgtgcataggggcgagttcgtctcgctcctgggcccctccggctgcggcaagaccacgaccctgcgcctgatcgccggcctcgaccagccccagggcggcgagctcacgctggacggcgagcccatccgcggggcgtcccaccgtcgcggcttcgtgtttcagcagggagcgctgttcaactggctcaccatccgcgagaacatcgcggccgggctccgcgcccgccacgtgtaccgcgagaacgcgggccgcgtggacgagctgatccacgcggtggggcttgacggctttggcgacgcctacccgcaccagatcagcggcggcatggcccagcgcgtcgccatcgcccgcgcgctcatcaacgaccccgaggtcctgctgctggacgaacccatgggcgcgctcgacaacttcacgcgcgcgaccctgcaggacctgctgatagacctgcagcgcgccaaccacaccaccatggtgctggtgacccacgacgtggacgaggccatctacctgtccgaccgcatcgtgatcatgacaccgcgccccggcagggtgagcgaggtcgtgagcgtggactttcccaggccgcggcaccgtggcggctcggagttccttgagctgcgcgccacgctgctggagaagttcaacttggcgagcgccgagccgcagccggagtactacatctagccggcgcgggccctgggggagacggacggcggcacgtccttgccacttcccgcgatgggctcgggcgaggtttggggatggggtgcgggtcgttctcgccccgcgtgacggaaggcccgggcggggcccgggggagtagagacgaggagggggacgccatgaccgagctgggtccgattggccagggggaatgggaccgctttgctgagcggtatcgcgtgccggagaacgtgcggcagtacatggcgaggctcttctcgcccctacaggtgcgctttgcgctcgcggcgcccgaccgcttcggggtgggggagacgggccgcgtcctcgccagcctgggggaggattccgccggcgcccccgaatttctccgcgagcagtacaaggtcggttttctcaacctggtggacgaggtgcagacgtcctgggagcttgcgggctacgccacgttcctggacgtgtggccggtgtgggagaacgaggagtaccgctcccgctttaccccggaggagctccacgacatcgactggaagtacttccacgcgagctttgacccccgcgagcggcaggcccgcgagcagggggtagcgcccaccgaggacgaggtctacaccctgcaggagaccctggactggatcgaccgaaacggcaggcccgcccacctcagctactgcgactgccggagcctcgccggagactgcggcaagccgcgcgagacctgcatctcgtaccgcgacggcatcaacacgtatgcgcatcgcggatggtcgcgcaggctcagcgtggagcagaccaaggaggccgtgcgcaagttcgatcgcgcggggctcatgcacaccctgaacggcaccaccatctgcaactgctgtggtgactgctgctacctctcgcgagggcgcgagcagctgggcagcgggcccaactggccgctggcgcaccacgtggtggagtacgaccgggagcgctgcgtgggctgcgggctctgcgtgcggcgctgctggcgcgacgtgttcgaacgcacgccggaccgcaaggtgagcgtggacgccacccgctgcgtgggctgcggcctctgcgccaacacctgccccgccggcgcgctgaccatggcccaggcgagctacccggggctgcgtccggaggagccggactccagtcgcgtccacagccattaggggtggttggggacaaggtcgcaccgcccctctcgcctgctgacaaacccaaggaacacgagggagagacatgccctacacggcatatgacaaccgcagccttggcttcaccacgcgccagctgcacgccggctacaacccggccgagaaccactacgccaagaacgtgcccatctaccagaccgcggcgtttgagtttggcgactttgaccgctgcctgcgcgtgtgctcgcacgaggagcccggtgcggtgtcgtactcccgctgcgccaaccccaccaaccaggtgctggaggagcgcatggcctcgctggacggcggcgtcgcgggcctgagcttctcgtccggcatggcggcgatcacgggggccatcctcaacctggcgcaggagggcgaccagatcgtggcggcgcccaccatgtacggcgagagcgtgacgctgctgaccaaggtcctgcccgacctgggcatcacggggcgcatcgtgggcaacccggacaacctggacgagttcgaggcgctcatcaccccgcgcaccaaggcggtctacatcgagagcctgggcaacccatgcatcaacatcatcgacttcgagggcctggcatctctcgcccacgcccacggcatcccgttggtggtggacaacacctttgccacgccctacctgttcaggccgtttgagcacggggcggacatcgacgtgtactccgccaccaagtacctgggcgggcacggcaccaccgtcgcgggcgtggtggtggagcggggcggcttcgactgggcgaacgggcggttcccccagatggaggcgttcctgcgcgagtcgggccgcgcggacgacccccatcccttcacgagccgcctctacaaccggtcgctctcgtactttggcgcgcacctggcggcgcagtcggccttccagatcctgcaggggatcgagaccctgtcgctccgcatggagcgccacgcctccaacgcgcagtgcgtggcggagttcctctcggcccaccccgccgtgtcgcacgtggactacccggggcttcccgacaacccctatcacgagcttgcgcagcgctacttcccgcgtgggctcacggggatgatggcgttcagggtgcgcggcggcagggaggcggcgatccgctttctcgacgcggtggaggtctttgaccagatggtcaacgtgggggatgccaagtcgtacgtggtgtacccggcggtggcaacgcactttgggctctcggagcaggagcaggccaaggcgggcatctatcccgacacgatccgcgtgtcggtgggcatcgaggacgtggaggacctgcttgccgacctggaccaggcgctgggcaaggccgcccgggcgtagggcgagaggggcgtggcgtcccgggtcgcgtgactgaccacagatggcgagttctggcgtccgtcacgcttcggcgcggcgggtgccttccgttgcgcgggggagaggagcgtggcgcgttggtcgcaccccgtgcggttggggcataggggcacgccgttcgtctcgccatcacctgggtgtgggtgagacggacgggcattcaggtatccttgggcaaagccaaccggaaggagcgcccatgatgccctccgtcacccgtcggaccgcccttctcgccctcgccgcgctctcggcggcacccatcctccatgggtgcgaggcgctcgcgccgacctctcccgggtccgctaagtcgtcgcctgcgcgcgagctcacggcagatgttgcggaagactcctcgccgtcgggcgcgtatgacctgacgacggtgctcacggacgatgccaacagggaggctgcctacaggtttgccgtggggctgttaagggagagcctcgccgcgtctgacggcgacgtgttgacgtcgcccctctccgcgctgtatgccctcgcactcgcggcaaacggtgcgtctggccagacccgctcccagatggagggcgcctttgggatgaccacggacgtgctgaccgactaccttgccgcctattcgcggagacttgccggcaagccgctcgcgagcgggctggaagccggcgaccctctcaacctcaagagcgcgaactcggtctgggtacgcgacgtggagggactccaagtctcgaaggactggctcggaacgtgcaggggcaggctcgacgcgcaggcgtttgcggcaccctttgactcatcgacggtggaggacgtcaactcctgggtgttggacaagaccgacgggatgattccccggctcatggaccaggtctcccccgacgccatggtctacttggtgaacgccctcgccttcaacgacgcgtgggacgagccctttgagagggacgcaaccaagaccgcggacttcaactgcgaggacgggaccgtcctgagcgtgcccatgatgcgctcgcacgaagatatctacctggcaaacgaggtggcggagggcttcgtcaagcgatacgagaacggcgacttcgcctttgtgggcgtcctgccgcgggaggggcacgcggtgggcgatgtggtcgcgtctctcgacggcgcgtcgctcgcgtcgctggcgctcacgggcgtggcgaacacggaggtcgacatcggccttccccgcttcacgatcaactgggaggcggggctcgaggagcagctgaaggcgctgggggtcaccgacgccttcgacgcggaccgtgccgacttcacgccgatggggaccacgggcgacgggagcctcttcatcggcggcgtgatccagaagacctacgtggacgtgagcgaggagggcactcgcgcggctgccgcgacctccgttggcgtgtcgggctcctccgcgccgggttccgaggagcccgaggtcaagacggtgatcctgaaccgtccgttcatctacctcatcgtggactggcagtacgggacgccgctcttcgccggcgtcgcccagcgggtgggggagtagggcgcgtctcgcccaatcgggtgatgggagcccggcttgcggcggtgcggactggggccaggggctccctacctcacttctgcagaacggggtgctgagaaaagtcgacctttggcaatttggacgcgcgttccgctgagaaaaacgggctattggcaggcaaaggggcgttttctgtcctcgaacgttgccaatactcgactttcctcagcgaaacaccccctccatttgccaatactcgactttcctcagcaccctcgggatcgctgccttggcgcgcggctttcgggcatcctctcatgccaaaccgggtgacggcgattcgcatggcgcctccctacaggtagacgtccgcctcctcgcggccaaacttgtgcagcagctcgtggcagggcttgcaggcggcgcagtcgcagaacttggcaccggcctccttgcgcgcctgggagtgtgccagcatcttggcggcgccctcctcgccaaagatcttcttgcccctgtcagagcccacgaacgcaatcaagttgtcgatggtggtctggtgctcgctgatggcgtcgagaagggtgttagtcgcggcgtccgcgtcattgcctgcggcaatggcatccttccatgcctgggcggcccgctttgtctcctccgatgccgacggcgcggccagcatctcgtccaccttggtcgatgcgtagtccagcagctccttgtccatgcgattcctttcttttggcgtgtagccgagaacagcttttctgctgggcttatacccgattgcctggtgggatgggttccgcttcttcgtggcttgtctcgcctgatgggtcgcgggatgctggtgcagtccgggatgccccttggcgcccagccgtccgagcctcaggccgttcgagccccaagccgcgacgatagtggtgggggttgatcgtctaagaatggggcgggtcgttcacgccggatgcttggtcgcagtcatcgcctgcccgcctcctgctcaggaaacccacaggcatgtgccacttctgtgccaagtgttatgtagttagtaacatatagttagccccgagcatagggcaaacctcaaccattacacgtcttaggtagaggagaacatacctatgtactttgaccaccacgatcaccacgagcatcacgacttccacgggcaccaccatggttacgggcatggtcaccacggccaccacggtgagtttggccgccagcacgaggacggagctgagcagcagggggagacgaactccgcctccgccgtcatctgcccctgcatgggcgtgaccgagtccgacatccagcgtgccgtcacgaacggagcacggaccctcgaggatgttgaggacgccaccggcgccggtaccaggtgcggtcggtgcgtcggcgcaatcgaggcctgcctgcaaagggagctggctgccctcgcgtcgtaggcgcgacgaaggcggacggcacttctcgcctgcctggagtcccggactttcgccgacgacccccaactgacccgcctcgtaagattccgcgcgtttacggtgccgtaaacgcgtctattgttacggaatcgcgagtctcgtaagattccgcgcgtttacgagtcgctaaacgcgtcaaaccttacgtgacgcccggcagacggcacctcacacaacgccctgccctgggggagggccgcaccccccgaggcaccgcccgtctcgcctagcccagcacgtccctgatcgcggcctccgcgtcctcccgagagctcgcccagctgccctgcaccatctgcggcttgccgccgccgcgcccgttcagcctgcggttgagctccttgcacgcgggcctgaggtccgccccgcccgcggcgatcacgtaggcgatgcggtcggcgtcgccctccacgtccgagagcgccgcgcacgtcgccacgtcgtcccgctccagagcacgctcgcacaggtagcgcagctcctcgacgtcgaggcccggctcaaaccgcacgagcagctcgccctccggctcaaacgttgcgacctcgcggtcgatccgctgccgcacggactgcttgagctgccgcttgagctcgtccctctcgcccgagagccgctggaccgcctcgggaacctcctcgtcggcaaccgagaggaagttgctcacctcgcgcagctgccccatgcgctcctcgcacagctccagcgcgcgccgaccgcacagcagctccagccgggtcttcttcttttttgtccccacgcgcaggatcttgatcaggcccacctgccccgtggttgcaacgtgggtgccgcagcacgcgcacgagtcgacgcccgcgatcctcaccacgcgaatcttgccctcgtggtccttcttgctgcggtaatccattgcctcgagctgttcgggggaggggagaagcgcctcgacctccacgtcctcgcgaaccgccgcgttggcgcgacgctcaacctcgagtgcctggtctgccgtgaggatgccgttaaagtcgacctcgatgcacctctcgcccatgtggaagcccacgttgtcgtagccaaagagcgcgtggacgatgcccgacaccatgtgctctccggtgtgtgcctccatgttgtcgcggcgccatatccagtcaagcacgccgtggacgtgggcgccaacggggagcggcgcgtccgagaggtaagccacgccctcgccgctctcgcctgggacggcctcgcgaacgtgagcgatgacctggtcctccccgtcgccaagagtaagcgtgccgcgatcgccgggctggccgccacctgtgggatagaacgccgtctggtccagctcgatggcaaagccgtcgtcgcgcggcgaacacgacgtgacggttgcgtcgaacacgcgcgtgtagggctcccggtagtacagctcgtcaaaggtctccatgttcccgtgcctccaatgtgccggctcgcggcgcttcgtcttctcactgcggcacatgataggtccgttctcgactgcctgggggagaggggcgatggcgtgggttgccgcgaggtgccgcgctggcattgcagaggggttttcacaagcggtcgaccccccgaagggcctgttgctggatcgcccacgctgttgggcgcatggggctgctgaggaaatgtgagttgtggcaatccggaagcggtagtgcgcatagacgtggtgtaagagctggcggggagcggggcctcgtgcccccgacccgacagcttgtggccaagggcagatgagggacatcgcctacaatccgtcgttgcttcaggtaacgtgaaaggaatacgatgtccctcgatatagtgtaaatgccgatgggccctcgaggggccctatactttccacggcctatggaacgagtgcgacgactccccgcgagttcgcagtgcagggtcctgtcgctggtcatgacgcggtgatggacgagcaggccgcactcgcctgcgggggcggcatgggcgagcgcacgcaggccgcaccacagcaggaacggtacaggccgcgcaaaccctgaggaaccgccacgggggacgtcgaggctgaggatccccaagctgagggagggctccctactttccccgaggagatgctcacccgctggtcgaggtggacgtttttggcggtgcctcgctcgtgtcaggagatgtacgtctcggggttccctcgtaccaggaaaggtgagagggtagccgagaagctcggcatctcctccctgtcgagctctgagttcctagaggctgttgccaggagctggacctcgaggtgggagccctgatgagcgcgacctccgtcccccggatgccctgctggctacctctcgcttgacgccacctacatgagctgcagggaggaactccgtcgtcctcctcccacgcgccgtggtgacgccatcgggctgggcgcgacggggcgcaagcacgtcctgggcgtcgaggccatggacaaaccgatagcgaggagggctggaacggcttccttggcgggcctcaaggcgcggggactctgcggggggcgtcaggctcttacatctcgaccccatgcggggctcgtgcggccatagcgcgcccgtcgcagggatgctcctggcacagctgcatcaccgcgcctcagaggaacctcctgtccgccatggcggggaggccccgaggcctcaggggtgcgtgagactaggctcgtgcaccggggcctgctactaggggacccggagctctcagggccatcctgggaggaggccgagggcccctgggtccaggagggcccatccccaaaggccgcggagaaatcttctccgcggcccgaggacctcggccctcgcctttccaggcgttccccccgaggccccccctgggcgaagctcagtaccaacaacgtcctccgataatcgaataggcccttggcgacgagccgttcgtccccttgtctatggttcgtttccggcggcggcgtggtgaccccacattgattgacgtcccgtccggggactgtcctcctcttgatatgtccccgcccgcgccggcgtgcccccgcggctgccgtacctgagagaagcgctgggcgcggcggctcttgtgcgggagggcgccgctcacccatcggagccctgtccggcggccgaggtgcattcgaatctaccgtttcctatacgtatgtggatgtattggcatgtattttcatctgttacgtgctgcgtccctcgggacgccgtgtgggccggagtcgacacgcacgccgacacgaactggctggagcggttgtccgaccgccatcggggcggggccgagctcttctccggcgagttccccaccgcgcggaggatacgcaggctatcgcgagcgacgcgcgctccgggacgctcgtggcggccggcgtcgagtgccacggtcacctttcgggcgggggctcgcgaggatatggcctccgatggccgtccgcgctaacgaggtcgtgggtcccgagaggagccgcattaggcgcagcgccgggcaggacgacgcgcggaccgctcagggccgccggcaggtctctcgggcaatgacctggcgccgagtcccatgacggctagggtcgagacggtgaggccctctacgtcgccatggagggcctcgtgaggtcgtgcacttcgctcgccaacatcgccctggcgaccgtggaggaaggcccctgacgacctgagggcccgccttgagcgcgctctggactacctgcagtcatgcgcgcgtgctgcgtgctgggaggacgatggctcgtgccgcctcgtcgataggcggccatggttcgcgctcagggcgctggggaaggcctgggtcgcccagcgctcgtccgcccgggacctcgaaggggcgattcgccgacgggtgcgtccgttcagaaagtgaaccgtctcttcttccgcgatgtacagttttgcggcgctgctcctcttcctcttcgctctctctttcctccgctcccgccccgtccttttcttcattcgctcgtcttctgctttctcctccctcttcttctccaattcactctccttccgggagggaatcgtatcgccgctccctttcatggacttctccctctgtgctccaacgctcatcttctggtctcgctttgtctgattcgtccggccttttcgagccgttagcacgtgatcgcgatgcacagatgcgcaccgaccccaggaccatcgcctacgtggagaggcgaagggcgcgagggctctccgcgagagatacgccgcttccctcgcgctacaatcgcggtcgcgcgcgaggcgtaaccgggcttcctgacgatcccgaaggacgtgccccgccgaggaacgggccccgggctgagggaggccaggatcggcgcgggcgtctcgcagaggacgcggcgaaggcgccggggggtcaacggccgtcgaccctctgcgacaggctgagcttggcaccaccagtttagagacctcggcgctccgtacaacagaaagtggggtggcacgatgggcttcccgatggatcggaagaccccgccgacggccttgacaccaatagaagcatcaggagagggcgaaccgggagatcaagcgtcgctacaggtcgtgccggcaagtccttgctttcctcggtcgaggtcgatggtgcgccctgagcgtggcctccatacgtctcgaggaggggcgcttggtgccacccagctcgtctgtcagcgagagtccgccgccctcggctcagggacccacgacccagggagtcccctcgaggggaggaggggaggcactcgaaggagggccgcacagatagtctcggatataggccgtagctgcggcctcgaggagtagattcctggccagcgtcggcagaggtgatgtgccttcgttacaaccacgctcgtgcgcgcgatcccggaagcctcgaaaggcaccgtgtcaccccttacacccctgctaggaaatgcgagtgttggcaatctgagaggccggattctgccgaggaaaaccgggcatcccggcggtcgacgagggcacatcggggctccctcgctgcacgctcgcatgttcctcagcggatcccctgccaattgccaccaacttctcgacttttcctcagcaggggtggtctcgcagggacgtcagcgcctccacccttacgggacccaccgattgccacaggtcgactatttcctgccagcgagcttgagtatgcgtttcgcatcatcgatcgcccaaaaagagagcggcccgcccgggacgagggatcccctaccgtcccggccctgctccgtgccacccgaataccgcgcgccctacaagctgcaccctcgcggagatctctcgacctctcggtcgtgagcttttggtagccgccgcccaggatgaagtcgccttcaaggcgtcggggatgttcctcctcggtcaggccccagctcgcgggcgctcttcaaccactccaactggtccatccaggggcgctcattgcctcgagccatcctccgcgaccctctctctctccggactttccgcctgtattcgtatgtccacgtcccacaccacaacgggcaaagcgccggcgaacttctcaaaactgtctccaccctaggggccatgaccagaggcgatagtatggcaggctcacggctgagagggtcatgccgtagcgtggcgtttggtcaccgcgccgatggctggcccagcatgtggacccccccttcggtcgacttgccacacgcgatgacgtgttgaggcgcccaggtgcaaaaaaacccaactgaatgttggaagcgcgcctcgtaggttgtgggtcctttacgggcgatgcggctggcgtgcaaccaggctgcgctggaaccctcggcgatgtaagtcgctgtgttgtccgggcggtcgccccggagaagtactgctctcagatgtggtttgaaggcgtcgtagatccggcgcgcatctggtattcggcacggtgaaggtgatcctccgtgggttcacgatgcgaagcgcgggatcactttcgggccgacacggtgtgtccgatctttaggccctcctcgtggttggtgatcacggagccggcgttcatctatcccgagccggtgccgctcatggtcagcacgctcacccacgggatgacctttggcaggtcggcgcctcatccatgtgcaggtaccaggtgctcccaggggtcgcctcgtccgacgcggacaccgaactcccttggcgtagtcgatggtggatccgcgcccaccgccagatcaggttccacgtcgtttctcgcgtgcgacctttgcgcctcgcgcagcttgtccgcggtgggttggaaacatgacgccggggaccgccctcgaactgtcttgccggcggcctcaagcgcggcgatgaccttgtcgtagacaccgtttccgctataattgagccgccgccataggtcagaggaaattggggccaaactccggcgagctcgccggggagtctcgtcgacgcgttgggcgcaaagtggacgcggcaggggttgtgataggggaagtcctccgagcatggcgtttcctttcgggtcgctgaccgttccccttagtttgaaatctcacaacctagctttaggtctagatacgaatttgaggtgcacattacgtaacacaattggccaaggtgtcccggatgtcgttcgccctacaggtgtcgaccatccctactacggacaagatgggactcccctccccttacttagcgcactctcgggcacccgccgttcttttggagacggaaaccagattgaggggccctgccgccgtgatccgagtgcctcaagcggtcggggctcgagatccgcgacagatcacgctttcatgatggtgccatgagggtccgagcactaacgggcgagcgctgtagctttccgcgagcagcggaacgcaaggtcgacgagaagatcgccgagtggagcgacccgccgagcgatgatcgactggaagtgatggtactacgggcaggcgtgcgagtgggggagcgagggggttcgcggcagaccttgccgcgactgtctctcttatctgcggacggcagctgcctctgggggaggctgcacacagaacccgtcgatgccaaagccggaggatgcccctactcgagctgtggccttgtgcgggccctcacggtgaagcctggggtgtgacgagcgtccgagcccccttcagaaagggtggagggggcactccagcggttgggctgcttagaacactttgacctttggcaattggtatcgaatctactgagaaacaaatcgacctttgggcagagtcggagaggctccagcgctgccgaagggcgcttttctaagcatttggagccctccgattgccaatagttcgagttttcctcgcaccccacctgccgggaccgggccgccccctccctgctatccgaacgtccactatggtgtggcggaaacgctctcctcgctcaccgacgccagcagccttatccgcgcagtcacgctcgtgaagcggcccttctcgggactttgcagtccagcagcccaccaccccgcggctcccgtccgacctggcggtggaggggcacccacctccgacttgatatgcgctgtcaactgcatgtggccggggaacgcatgacgtccgacgagcttgcgctgcgcgagtcctcccctcgcgcgctgcggtcccgcacacgcccgctcccaaaggggaacatggacgtgcacgcgcccgcccctgggaacggccccagaacgagcgactgatcatccgacccatccagccaggtagaagcccacccagttgatgtccgatacctggtcccagatcagcgccgcgcgttggagagggcgggaagccaagcgctgtcaccctcgcagctccttgagctggctccgccaccagcgaactatcgacttctccgcctcccaacgacccccttgcaatcgtcaaacgttcccagtcgcctcgcgaagcctcccaagcgagcccgcgttgtcgtgatggtaacccattcgcctaaccgcctaccgttttggcaccagttttggaatctgccaggggagatacatgctgcgactgtccccgagacccattcccaccgccccagtggacttcgtcggaatcctcgagtggtttgctcccgtgaaagtacccccatgggtcgatgctcctaagctcgggcatgtggaggcgcgaaggtggagggcggtccgtccccttgcccttgggaccgtcgcgcgcgttacttctcctccctcgcatgagcgggccgtcccccaacggtttccttccgcgtagtcggagcgtttgctcagggggagagccgcttccctgacacgaagaggtcataagttcaaatctttaaacgcccaccacaacattcgccggtcataggctatgttctctggcctgttttcttttgccccgcaaagtgcgccgcaaatctggccgcaaaaaacctgagtagtcggcttaaacaaaaggtgaggagacccgcttttctttcgctagcctcctcacgatttggctaacttaaccatcgccgttgttgagttctcctcgacgcctccaacgggcgaccctcagcggtgaccccagcgctggcccatgttagcgttcgagctccgacacctcgcgggcggcgttggaacacgcaccacccggtctccgaaagcttggcgtacgccccgctctcggtcttcaactcgagggcgcacgtcctccgcgagggtggtgtaggggtttcctcgcaccgcccgatgtagcccgcacatcgtcgtggcatgtcgaatgcccttcctgttagcgtttgctaacatgcgtgcgagcgtgtagttgccgtccttctgcttggctatttccctcacgagctcggcggcgcctcgccctgcgtgaggtctatgagggagagtaactgcatcgtctccggactcacgcacgggggcggggcacgaaggccgcgtcccgctgcctgccatacctcgtccatcgccttcctgcacgcgttccttgatgccgccccgcccccccccttggcgtccgcaatctgcctcgtaggcgatcgttgagcctgacccctcctctccccacgatcggtcaccaggttctttcgttccctccttgaatttgcgttcctcgtcaatcttcgcctgatcgcccgtcgcagcgttgctgatggttgtcatagctgtgttgaccgaatccgtgcccatggtgttctccttaattcgtcgctgttactaccctgtaacggtaggtgtctccgagcattgcccctgcgccttgcgttcaggcgtccccgtccaatgcgctccaccctcgcccgtgagtcgaacgcagtttttggatgatggagttggcccgccgagcctacgtattgggggcacgtccccgtcgtgcatgatttcgcagatggtctccacgcctccgagaaccgctcctgcatggatttccatccccgcgtcgatgattcgtgcctcgccgccttgtatactccacgaactctggtctgacttgtaggcactgaggtggattccccgatgccagccgccttggcggcctccttggccgtgggcaccgcaatcagggcgcctcacggccttctcgtagttcctctttggccataaccttccttctctcatgacgcgccagaaagagccgataacgctgccttctcagaacggacatccggacggcgggttcctctaggggcttccgttcctccagcacgcgagtgcctccgctccttgcccagttcctctcaagagccttcagtgtgtgatgggggagccgttcctcttccagccgacgcctcgtagtatgtcgtgaaacctctcgggtcgattcgcagccctgctcctcggcgtactccctgacctcttccagggacggcgtggtgtgcgacggccctcacctcactcttgctattactcgtgctcttatctattactattgtctccgacccacgtgggggtctgggtggtacccgggatttctgtttttcctgcaggtaagcgctgtgtgtgctatcaactttcgaggaattccgaggccgcttttttcaacaagtttgacggcttttggcaaaaccgcatcacttctcatgcactttccctctgctttccgagaccgttcttcatgcctttgaggaccgaggtgcgtaccttcgaggtttgcccctctgcgagaagtcgaaaagctgccgcagcttccccgtgaggtcgcactcgcccgtgaagaaatagcccacgcatgcgtagagcaacttccgagcctgagcctctgggagcgcattcgcccctcgtagaactctcggctcccttcatgtacctgatttcgcccatttcatagcccttcgttgcggcgagtaatcctgcccatactcgcgtctggccttcttcctctcgccgccatgtgccgctgcctagccaatcatgctggtcgtatcgcccgtcggcgctcgatgagctggcggcacgttggcacacctccgccatgagcagacgcgctaacgcagcgactgtggttgttgttcacctgtggtgcgtcccgttgctgtcggtcggtgagtcccgcctgcgaacgcactgctccgcaagttcttgcaatcccgaacctgcgcccctgggaggcgtagacctcgcgccgttctgaccatgtaagaccaagcgccatcgttctcggagaccccactcggtgcctctcggcgcgaatctctcgcgcctctcgttaccatctgctttgaggtggcggccacccctcgttggccctcgtggcggttgcagccgtcgcggggggcccctccctagccttcagagaactcgcctctccgaggccgagcattttcgaggatgacggcggtgttgaagcggtacggttgccacccgtacgcaggggagcttgcccgtgctcgccatgcgctggagggtggcgcacggtcacccctgcgagcgcccgcgacggtagtccgcgtcgatagggcgggaagtccgctggctccgacctttacttgctcgacgggtgaatcggggagttgtggctctgcgactgtcgcgtcctggttcctcctattggttagttaacgaatctgctgtaccgcactgcaccaatgtaagtggaacgaacagacggactagctgccagttttttcgtaaatcgcgccttctaactggaactggggatttacgcctatgaacagaagccgggcgcgaaagcccaggattcccagtgccttcgtgcccgataatataaactaaattcccctcttgcagtgagttggtgttccattgacctgctacccgtcctgagcttgcgtttgtcggtagaagtccctgtatcgaagcgttttcggcggggaggccattgcccggtcgagcaccagcgcgaccttctccagctgtcctcgggtgggttcatcatcaccgagaagaggtctgagccacccggggaagttggcgcggtcgaagcccgtgtggccgtcgaggaagagcctgagcaggaagcagaggcgttgaccttccacagcgggttctcctcgtcgggaagcctcttgatccgcgcagtcatacgtctcgctcacgagcccgagctcccgcaccacggcgttgtgcgagttctctccctgtcgtggacgagccgaggccgcgggacaggtgcgggcagtacgccgccttggcgcgctccgcgctcggcttgccgagccccaggacgcggaagaccgccgagccgtgctccccctcctcgcaggcgatcgcgatgcacgtgttgttcctcgagtagccgccgccctcctgcccgccagcagggggtccctgtcggcagccgggaccgggtacatcatctcgtccgcctgcacgcggcccgagagcaccacgcgtcctggatgccgtcgagaaccatgaacagctggcgagctggtatgccggggtggtggggcgacctgcggtcgcgcctcgcgatgcccgcgaggctctcgaaggacatgatcgcgagcaggaactcccacccacgcggtcacgggagcttcctgtcctcgaagatcgtccccgtcgcaggggtgaaggtggtgccgcaggcagtgcagcgccagcggcgcacgcccctgcggtcgtggccgtacatcgctatcctcccggacccgcacctcgggcacgagtcgcgctcgcaggcgttgaggaacgccgcgtcgagctcgcccccgagcctgtggagccagccgtactgctccctctgccatcccatcacgagcgcctggccgggcgtcagggaggactcgtcgggcaccgtcccagggcgtggtggacgccgagggcgcgtgccatctctcgtgcatgggtgtggtagtcctcgccgcgttggtcggcgacggcgccagggactaccacatcacgagagcgccgccgcccaccatcgcgctctcgtgtgatggttgggccctcgcggcaattctactagatggaatgacgggaacccaaaacaccaactcactgcaagaggggattttatagatttatataccttacaattatggaagattctactttgcaattacggatttctcggtcatggttggagtttggatgattcccagaagcatggcgtcgagcgctcttcaactgtcgagctggtttcccgtcgtctctgttactgggccgcgacagagcggaaagaccactctggtaaaagaagtcttctctgattattcgtacgccaatctggagaatccccaaactcggcagcaagccctcaacgatcccgttggcttcatcagaaaccggcccaaccgtcttgtaatagacgaggcccagcttgctcccgagctgttctcgatgatacaggtcgtttccgacgagagtaacgagcctggccaatacgtactctcggggtcacagaacttcttgcttctcaaacagataacgcagtcattggctgggagggttggcctgctcaagctgctgcctctctcatatcccgaggcagcgtcggagaagggtgaccttactcctgactccttcatgctgaggggtggatacccccggctgtacgatgtggatattccgcccgagacctacttctcggcctacatcaagacgtatgtcgagcgcgatgtccaggattatcttggcgtgagagatctctcctcctacagggcgctgctggagctttgcgcacagtgcgccgggagtctgctgaacgtctcgcgccttgcaagcgacctcggcgtgtcgagggcgaccgtggacacttggctttccatgctcgagtcgagctacattgtctttcggcttaggccgtatcacgcgaaccttcgcaagcgccttatcaaaacccccaagctctacttctgcgacaccggcctgctgtgccatctgctgcgcatccaaaccattgagcagttgctcacaagcccgtacctggggatggtgtttgagaacttcgtgattgcagagcggatgaaggcgtacctcaacgcgggcagggaacccgacctctacttctatcgtgatgacaacaaggtcgaagttgacctggtcgatctgaccgattccagctgcgggctccttgcggaaatcaaatcctcccagacttatcggagcggcttctcaaagaacctccgactcgtgggagacgagattggcattccagccgagcgtcgcttcgtggtagagcgcgcagaggggaactttgaggtggatggcgcgcaggtgagagacgtcactacctggctccagacgagctaggggaatgggttaggggagagaggccctacaacgaagggcgggacgctcccatccgggacgtcccgcccttttgccgttcgcttgtctatcggttcttgcgcctagacgtagaggtccatgtccaggctggtggcggcatagaagccgtcgcggatggcgtcgccgatcttgccgaggcgacggacgtctcccaccacgcgggtcttctcgtggtagcgcccgtcgatggcatcggcgagcgtggtgtcgggacgcatgccgaacgcgtcgatcacgcagtccgcgtccaggtgctcgcgggagccgtcggcaagctcgaccgtgacgcccgtggcgtcgatggagacgaccttgttggagctcctgagctccacgccgccctcctggaggcgccgcatgagcgtgatcttgttgatgaagaagacgtccttgccgcactccggcagcatctcgacaacggtcaccctcttgccgaggtccgccgagagctcgagtgcgcagtcgagccctgaggcgccgccgccgcagacgacgacgcgctcgccggttgcacggctcgtgtcacgctcgaagtccagaacgggcacaacgttggtcccgtcgaggccggggatcttgggtgcgacgggcttggcgccggttcctacgacgattgcgtcggcggaccccagcagcgggtcgtccgcgctgaccgcgtggttgagcctgacatccaccttgtacttgtcgagttggaccttgtaccactcgaccagcttgcggatgttcagcttgaaggaggcgctgctgatgtccccggcggtacctcccaggtggtcgcgtgcctcgagaagcgtgacgcgatgcccctcgatggcggcaacgcgtgcggcctccatccccgcgacgcctccgcccaccaccacgacgtccttgggcgagtcggtgcgggtgatcttgaagcggacctcctccatcgcggaggggttcacggcgcagctgagcttggtgtggctgttccagatgcggccgatgcagtactcgttgcagcgcaggcagggtcgcacgtcctcgggatggcccttctgcagcttgacgggtaggtaggggtcggcgatcaacgcgcggccaaagttgacgaagtcgaccgtgccgctctcgatgagcttcgtcgcatcgtccgggttgagggtgcccgccgtgaagagagggacgtccacggccttgcgcgcggcgtcgcagacgtagctcatgcagctctcgcccaggtagctgggcgggaagatgtagtcgagggactcgtagcagccggcgtccacgtcaaaggcgtccacgccctcgcgctccaggatcttgagaagctccacggagtcctcgatggcgcgcccgcccgggaagcggtggtcgagggagatgcggaagatcacgggcagggcgtctcccacagcgtccttgatcgcgtggacgatctcgaccgggaagcgcgcaaagccctccggcgtgactccgtactcgtcggtgcggtggttccacaccgggctcatgaactggtcgatgaggtagccggcgtgtgcgtgaatctcgatcgcgtcgtagcccgcgtcgcgcgcgacgccggcggcaaagcggaagccgtccatgatgccggcgatctcgtccttggtgagggcgtggcacttgacgctcgggtcgaagaccgagggcgtgtcggacgaggagatcggcgggttgccaaaggtgtccgggaacgcgttgcggcctgtgcctgggcttatctggcacacgatcttggcgccatagcgatggaccccgtcgcagaccgacgtgagcgagggcaggacggtgaaagagtcgaggtacccctccatcgagccctgggcgaccctctcgttgagcatctggcagcccatgaagatgatgccggtgccgcccttggcgcgctcgatgaagtagtcgacctcctgctcgtccttcctgccgttggtgaaggccgagttggtgcccatcgggctcatgccgatgcggttcttgacccgcatcctgccgacggaaaacggagtgaacagtgcgctgtggtccatgccttcccctctccttgggatcttgtggccttgtggtgccaaagctggcgtcgatgcgacgacgaccccgttcctctccttgggcgaatgggccttgggctgccgtagcgcgttccgtcgggccccgctcgtcgtctcttgtcgaggcatcgatgcattcccatagtaaggcaaactttactcgagtaagaccagagtgcagtcattctccctctcgaggaaccctggcgccgtttcccgattgccttcaggcataatcgaagcgaccgaatggtcgagatacccgcaagctgttggcaccactggtgcgccatgccttcgcatgtcgtcgcgacgctgacgtaaggtggccatcgaacctttggaggggcattggacaggcagcacatccaggagacggcgctcgcactcttcaaggagcggggcttcgccaacgtcacggtccaggacatctgcgacgcctgcgggataagcaagcccaccttctacagccgcttccactccaaggacgacatcatcgtcaacctgtacgacggcgtgtcagaacgccttggcgaccggctcggcgagctcatgggaactacaagcgcctgggagcagctgctcatctgctatgacaccattgcggacgagaccgagggagcgggccaggagctcatgcggcgcatgctcatcaccaacctgcgcgaggaccaccacagcctggacgagcggccatacctcagtcgcaccatggcctcgatcatcgagcgcgggcaggcgagtggagagtttcgcaacgcctccgacgccgagcgactccgcgaggcggcagaccgcatgttcacgggctacttctgctattggtgcatcagccatggcgcgctcgactggcgtgtctccttccggaagagccttgccgcggtcctcgatctgcgtgggtagggaatcctgggcatgcgtggctaacggtccgtactttgcatttgtggagcctgccactttgcaattacggagcccattaccttgcagacctgggaagtgctgcgcctcgcatgggacgcaagccgtcccatgcccctcacttggcctcgtgcctgccgagggcgaggttgttctgcacggtgaagctcaccacgtagaggaagcactccacgaggaccttcatcactagcgcagggccgcccatcacgtcgacgagcaggtgcatgagcaggctgttggcagagatgatcgctacggagagggcaaggtatcgggcgacggtgtaatggctgcccgggttccggaacgcccagtgccggttcatgaggtagttgaacgtggcactgatggcgcgcgcggagagcgttgcggcgaccgtcgagagccccacggaaaggtagaagcctgagaagagcgagtagtcgagcgcgaacgaggcgagcgacacgatgaggaacctcggcatgctgccgaagaggaccctgtagacgcgcgcaccatccctgatcgcgtcgaagtggctgccggagttgccctcgaagtagaccgtcggtatgggcacctcccggatgccgtcgaacagcgcgtcggagtgcacgagcatgttcatctcgtactcgtagcggtctccggcaagcgaaaccagccggtcgacgtgggcgagcgggattccgcgcagcccggtctgcgtatccgacaggcgcacgttgtagagcatgccaaacagggtgcgggtgagcgtgttacccaggcgagacctgcgcggcatcttccttacgtcgcgcacgccgagcaccagggagccggggttgtcctgggcgcacttcgcaacgtcgaggatggcctgcctcgtgtgctgtccgtccgagtcggcggtcacggcatgcgagaagcccctgcgcgccgcccacgagagcccctccttcagggcggcacccttgcctcggttgtgctcaaagtggatgacggggatgtcgcgtgcctccacctgcgagaagacctcctcgcatccctcgctcccgtcgtctaccaccacgacgggcagggggtggctcctctcaccctctgccgaagtacgttccaagcccgttccacgaagctggtccacgagcccgacgagcttgtcgtccgggtcgtaggcggggatgaccacgcagaaggagggaggtttgcgatcaggggcgcccatcggctggctccttcgaacgacggtagcggcgagagaacaccacgaggcaggcgacgccgagggaggacatggcgactccctgccagaggtagggataggagaggggcagcgtcgtggttcccttgtcgaccacggtcaggtggaagtcgtcacgcacgccctccgtgccgtcgaacaggtcatggtaggcgagcgtggtgttgacgttgtcctctggggaggtcacggtgatcgccctgggggcgtagtcgacggagatggggacgagctcgcgttctggcagctccgtggagtcgaggtccatcgcgttggagaggagcttcccaactccctcgtcctgcgtgagggagtagtagtaggtgaggttgaaccccacaaagacgatgttgtcgtcgcgggcggtccccatgaagttgacgcgggtgttgtcatcgagctccgcgtagccccaggagtcgtccagaccatcgaggtagaccgtgttccaggtgtccacgtccgaggggaacaggtcgggatccaagattccgtccttggtgtggaggtccgggtacccgttgttgaacttgatggtgttgcagcgaacccccaggaagattcggtcgtgcgagctcctgttctcggggatgccgtccgcggatatcacgacgcgcacgccgtgccttgcaagcctgagcacgaggtcctccgccgccctctggtcgtcgtaggtgaaccccgtcaggaagacgacgcgatagcgcgagagctcatcgtaggtgtagtggttgaggttggggtcggaggtctgcttgaaggcgggataggtgagggccaccgtgtcggagttcttgccaatcgcgatggcggggtactgggtcttgaccccaaacgtcgatggcgccgaggacaggtggtagaggcggaagatccccgacgtgttcaccagctcgtagccgacccgcttggcgcactcgtcgagctgctcgatcgtgtcgggcttgggatgctccaccacatcggttctcatgagaacggtgtccgcgcccagctccttggcgcggtcgaacatgtagaggaagtcgccctcgttcgaggcgcggttgagcaggaggatgttccttgaggtggtgcttgcctcccagcctgcgccaaagacctggttggtggcgccccccaggtccgtcagcacgtaggcgtcgacgacggactccgttccctcctgcagcacgcacatgcgctgcgtggtgatgcgctttgcctcctccaccagcgtgcccttctgctgccgggtcatgcgctcgacgggctgctcgcccgtctggttgccgtagacgaggctcagggatgggatgcagtcgagcacgacgagcgcgcagaacgcaacgaggatgggcgtcttgagacgcttccactgcaggagcgagatgagggtgaggcagagcgcgatggagacgaacctcatcatccacagcatccctcccccggggagcgcggcgagaaacggcatggccgccgacgaggtgaggacgcaggtgagggcggcggtgatgaagcctggggctgcgtcgcggttgctgaagaaggcgccgatgacggcaagcacgaatccggggagcccgatgtaggggagtcggttgctctgaaggcgggcgagggggttcagcgtcacgcccaggctccggaagaaggtcctcatgctcgtggaactgtcgacgtttgagatgccgccaaagagcgaggggacgagccacacgcccaccagaaggaagcctatgagcatggcgaggaccgcccgcaggacgacgcggacgcgtcggttgacgaggcagtagacaagcgcgaacagcagcgttgccagcgcgagcatgccagcgtacccaaggtgacagagcaccatgagcgcaaaggtgacggagattcccacgaagttgggtcgcctctcacccttgaggaacgccgccacgttgtaggcgaacagcgggaggaagcacatgctcagcgcgcgcgggatgttgccctctgcaaagagctggtagaggttgttgggaaggaagaaccagaccaagccgatgaaggcacccagccaggggcgcctcatcctgaagccgacgtacagccagggcaggccgcttcccacgacgaggactcccacaaagatgaggtaacccatccagatgtcgcccgatgcgatcgcctggcatgcggccatgaggtagggggcaagcggtggccagtagcgcatgatctcgaccccattgtaccaggtggggtcatagcccggccaccagttgccggcgcggatgccgttgtagaccagctccgtgcgatggatgtggtacatggtgtccgagccggcgggataggtgccgctacgagagacgagccagaccaccacgattgccgcgacaacgtaggcgaccatggacgccacgcccagggcgacccactttgccttgcgatgctgggagtcggcgccctcgtgcgtctcctccgtcttggatgtcctctcctgctgctccatggcctatgcgtgttcctcgtccgtgccaagcatctcgtccacgacgccgtccacgatgcggtcgatgtccaagtccgtcgggccgtcgtccccctcccgtggcctgatgtccaccgcataggtgcgcgccgggctctcgctgccctccacgcgcacgagggtgccgccctccttctggacgacggcgtagaagttccgcgcaaactcctcgacgaggttctccaacgtgggggagacaacgtcgaacggcggctcgtcgttcaggaccttgttgcgatagggctccaggtacgcgtcgatgccctcctcaaagacgttgaaccgcacgaagcgcatgcccgagaccctgatggtgagcgtgaactcccaggtgtgtgggtgggtctctcccacgtagctgccatcggtgaggtagtggcgcgcgttgaggtagaacttgaggatgtacgagcgctcaaattccaggctgtcagtcttcatcgtgagggtcctctcccgaattgccttcgttggccaggatgtcgtcgagcgacattgttgagacgatatgggcgtccccctggacgaggggccccatggcagaggcggcatcctcgggcgtcccatgggcgaagagcagcgtgaccatgcactcgcccgcgtcgtggaacctcaggacgtcgctcccgagggatgtggcgcagcgctcgagcagaccgagcgtctctcccggcgtcccgcagtcgattcgcacggcggcaccgccgtccacgccgcgctcgagcagctttcgggcgaagggcggcacgagcctttggctccacgacctctccagtgcgtcgtagagccccatcctgctcatgcgctcctccgagagcctcattttctcggtgagctggacgacacgggcgtgctcgtcgtcgcgctccctgcgacggcggtcgacgttgttggcaatcagcagcgtgcccacgcagaaggtgacgattccggcggcccacagggtgcccatgcgggcgcgtgcacccatgtactcgttgcttgcgaggaggacgtcgacgttggtgatgaggcagagccggtagtcgctgccgccgtatgcaaactggattccgctggcaaggcagtccttgtcccccaggcgaatccgtcgatgggtgacccggtccgtagcgaggccgttgagaaagtcccccgcctcgctcgagtcaaagtaggtgctggcgcttacctccttgtagcggttagtctccgccacgtccttgacgtagagcatggtctgaccgcgcgagagcgcccagtagccgtcggtgctgccctcgagcgcccccaggacgtcgcttacgatctcgtcggcgctgcgatcgtcgctgagcttgatctcgttgagcacgatgccgacgtaggagtcctgctgcctggcgtacgcctcgacgatgccgttgtccaggtcgcacatctggagccagcccagcactgccaggacgaggcacagcggcacgacgacgagcgtggctcgtctcagagtggcatgcggtcccagagccttcttgccttgtgatgtggaggacatgctcacgactcgtctccctttggttgcgatgtctgtgcgtctgcggcgttggcgttgaggaccccaaagacccgccaataggctgccttggccgagtcgagggactcccttagcgcgcgacggaagtccgcccactcctcggagaggttgcgcgtgtgccatgccgccgacgtgtcgaccgagttgatgatgccggcgaccctgaagaagaacacgagcgtgttatagaagggaagcagcgctaccacccaccattggcgcaggtagaatcggcgcaggggagggtccatgcgcaggagcgccagcgcgcaggcgaagtagaggtaggactcgatgacgtagagcgcgaagatcagcagtacggagaacaggatgacccgcaccgacacgttcatcgccatgaggaacagaagcgccacgtaccagatcaggcgcgggaacgcgaaggtgtggtcaaagacgagcgtgtagacgttgatgtccgagaagaccctcctcagcctgagcttgctctgggggaacaggcgagcgacctcgagcgtgccgcgctgccagcgctgccgctgggtgtagagctcgttcatgcccgagatgggggagaccaggaaaatggcgtcgtcgcacatggcgacgcgctcgtgctggatgtagcgcatctggaaggtgaggtcggtgtcctcgctgaccgtgtcggtcgtgtacatgcgtgacttgagaatcgcggacttcctgaaggccgagaaggcgcccgagagcgtgtagatggcatttatctcggaggagtagctgcgtccggcgagaaaggcctgggcgtactcgacgaactcaattctccgcaggaggtgcaggccgtgcgttggggtctcctctacctgcgacgggttcgtgagcaccgcaccggtcatgcagttgacctcggggtggttctcgaacttccggacgaggttggtgagcgccttggggtcgaggatgccgtcgctgtcgatgttgacgatgtactttgcctcggtgttgtacagcgccatgttgagcgccttcgactttccctggtcggcgcggagccactgcatgcgcagggaggggaggctgtcttggcagcgtgcgaagacctcgaagctgccgtcgctgctcccgttgtcgaccaggaagacgcggagctgctcggtgggatacgtgcccccgtcaatcgaacccaggcaggcctcgagcgtcctctcggagttgtacaccggcacgatgaccgagacctcgggccagagggaggggtcgggtgccgccttgcggtcgcggatgcgccgccgcgccagcacgaagatcgagacgaaggaggggacgatctcgacgatgagcgggatgatgatccacgccgaccagaagacgaacgagctaagcacgctttgtgccgtcatagcgcagaccacccaccctcatctggataacgtccggcctggtgaacacgtagaagtacagcaggatggtgatggcgtagaagaagaagcggcctatgtaggtgtgcgccacggcgaacgcgtccgggccaaagaagtggacgatctcgcagatgatcacgatgcgaagggcgttgcacaccaggaggatggcggcgccgagcagccccaccgcgaccttctcgtagcgcgagtagaccggatagaagacgaggagcgacaggaacgccattgtctcgatgatgcccgagcactccatgttgatctgcatggtgatggacgtcgtcctgcaggggatgtagatgatgccgtagaagaagtaggcctggaacgtgtgcgtgagcgagcccaccaggccggcgatggcagtgaccccctgcgccatgggcagcgttgcccaggggcggacgaaggccatggccaggagaaagagcccgaccgccccgacgaggaagcgccagaacgcgagccctgcctttccgagcacgtgcacgacgaacgcccaggcggtgaccagaacggtaaaaagtacgatgctccctacttgcatgccgcccccgcatcggcgacgtcctgcttgcgacgcgtgcggcaacggttggcgaggagaccgcccgccacggcgacgcccgagagcgcgagcgcgccccacgggccggtcgacgcgcccgtggtggtgacgatcctgtcgcccaggcgaccgaacctcgcgctgatgaactggtagttgtccgggctgtcgtccgccgccttgccgtgctgcttgcgatagtagttgtgcatcttggcgacgttgtcgaggtcgatcttgtactccgcctggcacttgtcgccgttgacggtgatcatcacgtgaccgagaaccccgcccatctcttggaaggcctcgttgctcacgttggtcatgctgttggtgtcgtacgtcccgtgggtctcgacgatggcatactccctcgtggtgccatcgggctggttggtgaggtcggggttccagtcgatgttgccgttctcgtccaccgtgatgatgcgaggggagaggtcgtcctcgccgttgacgtcgatgtcctgcttgtcgcttgccttgcccgtgaggtcgatggtgatcgcctttgtgaaggcggtgccatccctcctctgctcgtcgatgtgtgcctgcatggaggtctcggcgtacatgtagagggtggagccgtcggcatagagcgcggcggaggcgtcctcgttcttgtcctgcgttcccgcggtggagtacgagatggtggtcatggggtacgggttccaatcgtcgtacttgccatcgtaggtgatgccctggaacttgcccgagttgttggggttgttctggaggtccgtgacgttcgtcacgaagggctcggactggtagaggccaaagttgaaggactgcccgtagtagttgagcgactcgcgggggatgcggatctcccactcggagccaacgtgcttggcctcggcgcccgggatgccgctcaccgtgccgtcctggttgagctggaacacgttctcgcgccccaggtcgctggtgatggagtactttccgttcccatgggtgcccgcaccggcggcgcttccgccctggccctccttgatgtagacgtagacgtcgccgtcaaacaccattgcaacctgggcgaggtcgttcggtgcggcagggttggggttcttggcgtccgtcttctggacgtacttccagtccttgaacttgccgtcgatggtgatgccgttgtacttgccggggtcgtcctccggggtcggtgcgacgtaggcggggatgtcggcgacgttgacggtggtgccgccaaaggcgaacgtgtccgcgttcatcatgctggcgggaatcatgcactcaacgtactggggtccctcggtgttgccgttgccgttgttgaccgagacgtaggagccaccgctgtacttgaggttgccgaacgcgtaccactggctgccaacctggaactggtcccagtcgtggcccacgtaggcgttcgccatgccccaggcggcaaggtagtagttgccgtccgcgcccctggcaatcttccagttggtgaggccattctggttgccattcgccttcgaggccgtgttggaggtggtggtgtcccagtcgtccaggttgccgtcgaccgtggggttgctcgttgcggcggaggtgctcgcgtcggtcgccgaccccgcggtggagcctgaggagccggcatcggtgctggtgtcggtcccgttgtcggtgttcgcgcttatgtcggcgccggtgtcggagtcctgcccctgccccgagtccgtcgcctgcccagcgtcggagccgtcaccaaactggatggtcttggttgctccgttgtacgagaccgtcgcggaggagccgcccagcgagctcagggggatggaggcctcgaacacgtagttgccggacgtgtcgcccgtgaccgcagagcttgccccggcgatggcgttccagttgagggcgaacgtgttgaccgtgttggagctgggaaccacctggatgttgagcgtgccgttgaggttggcgctggcaagcgagacgcccgaggcatccgcgtagctcccgttgccggagttgccctcgaggaccaggtacaggttggcgccgtcggtcgtggctccccacgtcgagacggtgccgctgcctgaggcaaggtccgacccgtcccagtcacccgcgctgccatccacggagatcgtggccgcataggcgaggccggagggcttctcgcccggcatcgaaagcggggcattgaaggcaagggcaaaggcgagccccgtggtgacggtcctggagaaaaccctccgcaaattggtccgatttgaacgccgtgactcggacccccctgcgggtgcgtgatttgttgacttcatgttcaagcctctgagtaactatcgtgggttcccgaacccgcgcgcgtctcttcccaacctgattatatgcccttagtcaggtaacttaagctatccaaaggcgccactcagacacgcgctctggcgcaggaagaagtttcggtcatcgcgtgccgacggcgaggggcttgcggctatggagtcgtctttcctcgcgcccggctctttccagcgccctgtggccgaagtgccgcgcctcctaaaatagtggcgctcggcgccctgcagcgcgcgtagcatggggcccatcaggtcatggcgcgctgcgccgaaaagagggggatgccatgtcagttacctttccaaagggcttttactggggaggggcgacggcggcaaaccagtttgagggcgcatgggacgcggacggtcgcggcccctcggtggacgaccacttcctgggcggcagcgtcacgacgccacgcatgatcacccgcgacatcaatcccgcgcgcctctaccccaaccatgacggcatcgacttctaccaccgctacaaggaggacatcgccctgttcgccgagatgggcttcaacatgttccgcatgtccatctcgtggtcgcgcatcttccccaacggggacgacgaccggcccaacgaggcgggtctcgccttctacgaccacgttttcgacgagcttgccaggtacggcatcgagccgctggtcacgctctcgcactacgagatgccgtaccacctcgtggagcggtacaacggctgggagagccgcgagctcatcggcctgttcgagcggtactgccaaaccgtgttcgagcgctacaaggacaaggtgcgctactggctcacgttcaacgagatcaactgcggcaccatggacatgggcaacctcttcgagacgagcatgattcggggctttgagggtcccgcgtcggagtcgcacaccaccatgcagcagcgctaccaggcgctccaccaccagtttgtggcgtccgcccgcgtggtgcgctatgcccacgagcactacccgcagttcaggattggcaacatggactgcttcgtcctcacctacccgggcacgtgcgaccctgccgaccagatgatgaacctggccgagatgcgccgcatgaactggtactgctcggacgtgcaggttaggggcgcctaccccgcgtacgccaggcgcttctggagggagaacggtatctgcctgcaggtggaggacggcgacctggacgacatcgccgccggcaccgtggacttctacacgttcagctactacatgagtggtgtcgttggcacgcacgacgtcgagcaggcggcgggcaacatgagcatgggcgggcgcaacccctacctcaagagtacggactggggctggcagattgacccagagggtctgcgcatcgccctcaaccagatctatgaccgctaccagatccccctgatggtggtggagaacggcatgggcgcgatggacgaggtctcgcccgacggtgccatccacgaccagtaccgcatcgactacctcaagagtcatgtgagggccatgggggaggccgtggacgacggcgtcgacctcatgggctacacgtggtgggggcccatcgacttggtctcggcggggacgggcgagatgcgcaagcgctacggcttcatctacgtggacaagcacgacgacgggaccggcacctaccggcgccttcgcaaggactcgttctttgcgtatcagaggatcatccagtcgaacggctccgagggcctggattagcctcggcgtaggcacttggagtggggaccctgctgaggaaagtcgagttgtggcaatgccaggtgggcttggtgctgaggaaagtcgagtactggcaatcgggaggacacgggagggccggttcgctgccaatactcgacattcctcagcttgaacgccccccaaattgccacaactcgatttttctcagcacccttgccggttcggaccccgtcggggaccctcccgattgccacaactcgatatttctcagcaccctcggcctccgggaacgctggcgagccctcttgcccggtacgagacgcccgtgatgccatcgcgcgtccaggccacgaggcgacgcgctcgcggaacgcctctctcgccttgcccggtcgtattggataattccatctggcggaacgcccccgacctggtgcctgccaagcgccggcctcggtctgcggcgtgggctcgtccctctcgtctgggccttccgccaagccgtggtaccgtccgtgaaggggaggcctgtcatgtcagacaacgtccgcgtggtcgacagggtgttcgacatcctcgagacgctctcgtccagtcgcgaggcgctgtccctggccgaggtctcgaaggcgactggcctcagcaagagcacggcgtaccgcatcctctcgtccatggcggatcgcaagtacgtggagcgggacgaggacggcggatatcgcctgggctacaagttcatcgagaccgccagcagccgcatcaacagcctggagctcctgaccgaggcaaagccctgcctgtcgcgcatgctgtgggacctcaacctcaccacccacctgggcgtcctggagggggcggaggtcgtgtacatggagaagatggacgtgtaccccaacaccaggctgtacacgcaggtgggttaccgctcgccggcgttctgctcgtcgatgggcaagtgcatgctgtcctgcctttccggcgaagagctgtcccgcgtgctggactactgcgacttcaagcgttacacccccaacaccatctgcgaccgaggcgccttcgtgcggcacctccgcaaggtccgcgccgacggctgggcgatggacaacgaggagtaccagctcggacatcgttgcgtgggggcgccggtgttcgactaccgtggcaccgcggtcgccgcgatcagcgcctcgggcaccatcaccgagctcaccgacgaccggatcgatatggtcgccaccgaggtcatgagcgccgcccgccacctctcgcgccgcatgggctaccaggcggcgtagcggcagttgccgggcctcgtcacgacggcgggggagagaggcgcgccccgcgctcgtggcgtggggcgcgctggcagcctctcgtcccaacccccaacgggcgggtcctcccgtggcctacaccaggttcttcagcacgacggtcttggtgtgcgtgacctcgtcgaacgtggacgagacgccctccgtcccgatgccggagtacttgtagccgccaaacggcatctcgaagctgcggaagaagctcgcgccgttgatgacggctccgccgcactccagccgccgggccacgtcgctcgccgtggccatgtcgcgcgtgaacacgcagccgcacaggccgaacttggaggcgttggcgatctggacggcctcgtccaccgtgtcgaaggcgatgatcggcaccacgggggcaaagatctccatgtccttggcaacgtccgccgttgcgggcacgtccgcgatgaccgtgggctccaggaacgcgccgttgcgatggcctcccaggacgatgcgcccgccctgctccacggtcagctcgatctgcttctccgccttgatggcggccttctccgagatcaggcagccgatctgggtggactcgtccgcggggtcaccctgcttcagggagctgatgcgctctatcgccttgctggtgaactcgtccagccgactgcggtggatcaggaagcgcttggaggcgcagcacacctgaccggtgttgtacatgcggccccacaccagctcgttcaccgccaggtcaacgtcgccgtcctctaggacgatgaacgcgtcgttgccgcccagctccagcgcggtgtgtgcaaggtggtcggcggcgtggcgggcggtctcgatgcccacctcggtcgagccggtcagcgtgatggcgtcgacgccggggttggtgcacagccagttgcccaccgtggagccgcggccggtcacgatctgcgccgcgccaggtgtcacgcctgcctcgcccaggagctcggtcaggcggcacagggtcagcgggttgtcggtggacggcttcacgatgacggcgtttcccgccagcagtgcgggggcgaccttctggtcgtacaggtcgcacgggaagttgaacgggatcacggcagcgatcacgcccaggggctcgcgacgcgtgatgagcaggttgtgctcctgccctgcctccatgcccgccgggatggtctcgccgtacaggtgctttgcccgctcgctgaacgccctgaacgcgatggggatgttcgagatctcggcgcgcgcctcgacgatgggcttgccggtctcggcgcacagggtctgggccagcgattcgtggttcttctcgaccaggccgacgaacttcatcaggatgtcgaccttctggtgcacggggatggccgcccaggtgggctgggccgcgtgcgcggcgtcgaccgcgctctggatgtctgcctcggtcgccgcggggaccgtgtcaacgagcttgccgtttgcggggttggtgacgtcgatggtcgcgccgtcggaggcgggcgttggctttccgttgatgaacatcagcataagggaccactctccattccttgttggttgggtgcaacgtgaccgggtcacgaccctctcccgtgtctcggacaatccctgtcgttcctgagaccgggggagaggggcgatcccccttacttgccgagtgtcgtgaacgagagcatcaggccgccgcaggtgttggcgccgtcgtccacctggccgtactcgccaaacgtgaactcgcacaggaacggcacgccattggctgcggacttgagctggtccgcaacctcgccgatgcggtctccgatgcccgcgcgcctgccgccgcagtggaccagcaggtaggcgccggggtcctcgaccttttctcccagctcgcccagcgtcttgcccgtggagtcgatgagctcgtccaccgttgcctccatgcggatgacggcggtgttcttggcgaccttgttgcccaggccgatggtgtcgtcgtcgttgccggccatggggtgacggatggccacgaggtcgcccaggcggtccttcacgcccagcggcgacaccacggacgccgacaggagcgcgctgccgcgcagggagtcgatgtccatgccgcgccactcggcgtacttctccagcgcggggacgccgtctatctcagcgagcgtgcggttgccgatgaccttggtgaccacgcccacgtcacccgtctcgtggtaggcgccggtgtacacgttggccatgggcttgtccgtgtagaagaacgcgaccgccacgccgtcggcaaagtccccggacgaggtgtacagcttccagtcccccgcgatggcgttgtcggcagcgctgccgccaaagaacggcacgcgaccaatcacgtgcgtgatgcccttgacgtagtactcctcctcggccgggctcgccgccatgtagtagtaggagggggcgcagtccttgccggcggccttcatcgcgagcctggcgaccttctctcccagctccacggcgtcctggctcgcgtcagtcttgggctcggcagccacgcccacggccatgtcggggtcgttcagcgccatggcgcccagaaagccgtccccgcccacaaagcccttgggggtaatgacgccggtgaacgaggtgttgccgatcacgggcacgtctggcagctgtgccgagaactcgtccagcatcgacgggatgttgtacgcgcagctggagtaggcaaacaccaccttggcctgcgcaacgtccggatcctgcgccttcagcccctggacaacctcgcgaacagcctcacgtgcatccagcttgtcgctctgatagacactagcctttaacatgacgccctccttacgagccttgccctaccaactggcatcgatggtacggggctgccagagacttgtttgaccaaccgtttcggtctgtggaatggcgattccaccaggtgggaatgagcaggtgagaggggcaaaaactgctgatctttgccgccgttcgctggcgcggggctacctctcgcgggcgacgttgctcaggggaagaggagcgcggcgcctcgctcggagcccatcccgccggctttgggggcgccggcttccagccggtctcagccgctgggatctgcgcccgcgcgcccgcggggggtctaagaagggagggaccgtcacctctccttcctttggaccctcatttgggtgaaccccgtgcggacctggctcctgtcatcagcaatcgaaccatggcggcaggccgcccgcgtaagtgcccgcgcgaggagtttgctgccatcagacgaggacgggggtctcccgccggcccacctacctgcccaaacgtcggaacgcccctctcgcccgacggccgcatggcctccggggtgcacaagcgggcagttccctgccagctggggtccaagaatggggccggtcggccgcatcacgtacgtgcgagcgcttcattgggcaactcgctgccacgagaggccggaagaagtgactgaccgtgactcctggcatcaacggtcaaatcatggcagccggagcccgatatgagcactttcgatatcgttcgagccatgggttcccggcgtcggccccgttggcgggccgccggagccctgaccctggcaagaggcgcccgatgtgagtgctcacatcgggctttcgctgccaatttggttcgagacggtggtgggatggcagaggactcccggcgtgtgtgcacacatcgggagtcctctgccatggatgtcgcggctacggcgaccgtcaggcttgccacctgcgcaaacgtcggggacgcctcgacctgtcgccgatggcctgccccccagatcgctcacatcgggcccccgccgtcaccccgcccgccgcgcccggggcgtgacccgcacccgtcttcactctttggccttgtgccgcccgcgtctccgtcggaaaccgcgccccgcgtgtacacgcgggatggactttctgctggcggagaagcgtcgatgccctgccaacaggcgaaacgtttcggcggagagggcagatgtcgggaacctcccgacgtgtgtacacgcgagatgggctttctggcatccgcggagctgtactgggacttcctgcctaagatcgcgtcccgcgtgtacacacgggacgcgatttccgacaaggggaaggtcctggcctccagtcaacaggggagacgcgccgacggggcaagaccatgtcaggagcctcgtcttgtgtgtacacgcgggacgaggtttctgccggtgggaggagcggcacccagcacccttgagcttctctccttcgtggatattctccgcgagctgagcagggtcgggtcgcctcccccttgtagtctctcaaattgtatgattacgagtagtatgaacgtaatcatacaaagaactccaagctgggaggggaagcgcatgtttgttggtcgcgagcacgagcttgctgagctcgagcgcctgtacaaaaggggcgggtttcagatggttgttctctacggccggcgaagggttggcaagaccgctcttacattgcggtttgcccaaggaaagccaacgctctcctttaccgcgaaggtccagagtgacgcaatgaacctcgcggatttctcgcttgcgatatacgggtacttcggactcccgcgtggcgtgggctcgtttcgcacgtgggaggatgccctgaggttcgtggcaagcgaagcgggagaccagcatctggtggtggtgttcgacgagttcccctacgccgcccagaggaatgcgagtctcgtctccacgcttcagattgcctgtgacaggtacctttccgatacgaacgtgttcctgatccttactgggagcaatcaaggattcatggaagaggaggtcctggggttgcaggggaacaaggagagcctgggcgagaagaacccgctgtttggtcgtcgcacggcgcagattcacctttcgccctttgggtatcgcgaggcggcgctcatgctcccaggggtgagttgcgaggacctggttcggtactacgcagcgtttggcggaacgccgtactacctgtcaatggttgactctgaggaaagctttgccaccaatgtcgaggagctcttctttcgcaaggaaggcctgctctacgaggagccactcatgcttctgaggcaggagctgcgagagcctgcaatctacagctccattctggacgcaatcgcctccggggcaaacaggccacagctaattgcggaccgaataggggaggagcggtcttccctgacaaaatatctgaggacgctcgtctcgatgcgacttgtggagaagcgtgtcccgtttggggagagtagggagaggtcacgaagaggcatctaccgaatcagtgagcctgcgttttccttctggtatcgctttgtgcaaccggagcttgactccatcgagatggatgcgggggagctggttgcccgcgaccttctgggaagtagcgacattcccacctacgttgggcactggtttgaggagatatgcctgcaatgggtggtcgcagaggcaagagcgggtgctctgccgttgcaacccgtgcattttgggtcttggtgggggaccgacccctcggcccatgaacagaccgacattgatgttgttgccggcaacgaccgcaggagtgagctgttggtgggggagtgcaagtggcgcaatcggttcgatgcccgacaagtggcaagagatctcgttcaccgtgcggagttgctgggggcgtatgactccacgacctatgtcattttctcgcgcaagcagttgaataacgagttcaagaaggaggtgggagagggctggtcattcgttgatgctgagaggctgtatgattgatgctcgccgagcggtggctgccgttacgcttctctgccactcttgttgtttgaaatccgtgacgtcaattgtgtctgcgtaggaagttcattgttggtcgcggtctaagaagagggaaagacagtaggtcctccgctctctggggtcctgccgggtctagcggtggggtggagtagtatcagctatcggaccatggcggcagctcgctcgcgcgccctctagaacagttactgtctgccgcgcccctgtcgaccatggcctgccccccagatcgctcacatcgggcccccgccgtcaccccgcccgccgcgcccggggcgtgacccgcacccgtcttcactctttggccttgtgccgcccgcgtctccgtcggaaaccgcgccccgcgtgtacacgcgggatggactttctgctggcggagaagcgtcgatgccctgccaacaggcgaaacgtttcggcggagagggcagatgtcgggaacctcccgacgtgtgtacacgcgagatgggctttctggcatccgcggagctgtactgggacttcctgcctaagatcgcgtcccgcgtgtacacacgggactcactttctggcaaggactggccccagcttccaatcaacaggggaaacgcgccagcggaacatggcccatgtcagaaatctcgccccgcgtgtacacgcggggcgcacttcctgccggtgggaggggttgggaggaggttggacggcccttctcccctgcgggcaggcaccgcgagtcaaggacgaccgtaggatgctccctccaacccccgctacacgtcgttgaccacgaactgcggccgtcgcccgtcgagcacgtcctggaagctctcccaaaccatgcggtgcgcgcggcggaagcaccccgcggagttgcccccgatgtgcggcgacagcaccacgtggcgcatcgcctggggagagaggagcagcacggggttgtcgcaggtcaccggctcgggcgccagggtgtcgatccctgcaccggcgagatgccccgactccagggcagccgccaacgcccggttgtccaccagttcccctcgggcggtgttcaccaggatggagcccctgggcatgagggagaggaacctctcgcctgccatgccgcgcgtctggtcggtgacggccacgtgcagggagacgacgtcgctttgcgagagcagctcgtccagcggcaggtagcggaccccgagctcccgctccgtcccctcgttgcgccggtgccgcgaccagtaggcgacctcgcagccaaacggctgcaggcgtcgcgccacctgggtcccgatgtcgcccaggcccacgagtcccacgcggcagtcagcgagctcgcggtagcctcgcagcatcatctgctccttcacctgcatctgccggccgtccctcacagcggagtcgctgtacgcggcatcgcgcaacgcggcgagcatgagcatcacggtctgctccgcaaccgctcccgcgttagcccccttgcagttgcagacgggaatcccgcgccgcgccgcggcctcgatgtcaattgcgttgtaggccacgccctcggagtggatcaggcgcagcccggcgtccgccagcgcgtcgatgaccgacgcccgcacgggaactatcgcgtccacggacatgaactcgcagccgcgcccccgctccacgacttcgtcctcgggcgtgtcgcgtgcgacaaagaccttctcgctctccatggcaactggaacgtccgtcggcagatagcgcaggtagcgctcccgtccgcccacaagcagcaccctcgtcggcacgcgtcctcccatcgccgtcgcctgaggggattctagcctctcgcacgcgttgaccggttcgcgcaagcccgccgccaccttctagaaacaggggagaggagccgcgcgacggggcagcggcagggatgccatgggtgcgacgagacctcgggtggatgccgtgcgggttgctccgtctgactcaccgctgcgtcaacgccccgcgcctgatcgaagtgggccccacgacgaatgaacggttaccccatcgggcagcggcggggctaccatgggtgcatccgacggcattggagaaaggggactcaccatgcgcaacgacatcgacggcgaggtggcgctggtcacgggcgcgggttcgggcattgggcgggcgatcgcggtgcgactcgcggagctgggctgtgacgtcgtgctcgtggggaggaacgccgcgaggttgcaggagactgccgcgatggtcgccgagaagggaagggccgcccatgccatggcctgcgacctcacggacgcggacgcgatcgtctccctcgtccaggaggtgcgggagaaggtcggccgcctggacgtcctggtgaacgacgcgggggtcatggtccgcaagagcctggaggagaccacgaccgccgagctcgacgccatcctggcgaccaacgtgcgcgcaccctacatcctgtgccgcgagtgtctccccctgctgcgcgagtcggccgcggccgagatcgtgaacgtgtgctcggtggtcgcccacgagggctaccccatgcagtcggcctacgccgcgagcaagcacgcactcctgggtatgagcaagtcgctggcaaacgaggtgtacgagcagggcattcgcgttcacgtggtctcgcccggaggcgtgcggacggccatggtgggggaggcccgccccgacctggcgagcgtcccgatgatcgagcctgacgacatggcggacgcggtggagtacctgctcacgcaccggaccgacgccgtggtggacgagatccgcatccaccgttccaccaaggcgccgttctagcggcaagggcgtcgcgcggggcgacggcacgccccgaccccgccggcggtctcggtggcggcgggggagaggggcgtgggcgccgtcgtcgcgtccggctcgcgtcggcagccagcggcaccaccgcagcgagcccggtgccactggcggccatggtgatggggtcgcgagtccgtcgccacgcttctctcccccggttgtggactcttctcgcccgaagtatcggaatacggacacatgcaataatgagtgtcgcattcagataccgagggagaggcacatggcagactacatcctcgtcaccgagtcggggtcggacatccaccaggagacggcgctccgccacggcatcgtcgtggttcccatgcacgtgaactttggctcccagtcgcgcgacgacgacacgtttgcccccgaggagctgtacgagtgctacaagaccacgggcaagctgccgcagaccgccggctgctccccgcaggacttcgtcaccgccttcgaccgcatccatgaggagtaccccacggccaagatcctgtacctggcctactccgcggcgactaccatctcgtaccgcagcgcgcaccttgccgccgagggaagggactacgtcacgatgatggacaccaagtccgtctcgtccgccctgcggctggtggtcaccaacgtcgcgcgcatgcttgaggttgaccctgacgcctccgagcaggccgtcgccgacttcgtggacgaccaggtgcggcgcatccgctttgccttcgtgcccggcgaccttgactacctgcgcgcgggcgggcgcctctccaacgttgccttcctgggagccacgctgctgcgcatcaagcccacggtcgaggtcctggacggccagctgatagcaacgcgcaagcgccgcgggaccatggtcaagtgcgtcgggcagctggttgaggacttcgtgacccgcgagcccatggacctctcgcgcgtcagcctcacgtacacctcgggcgacggccccgaccccctcctccgtgcggtggtggagaagatcctggtcaaccatggtgcgcgcgagatcgagtgggtcaagtccggctgcgtcatcgcgagccactctggcccgggctcgtttggcatagcggcgctggcggccaagtagcgggggcgctggcagccgatttgcgggggcgccaacgcccgtcccccggcgtgtgggtgggcgtgtcggccacgtgggggcgcgcacggtcgtgactcctgtcggctcctcccgcgatccctgccgccgacgctgcggggtccgtctcccctccgcgcgttggggaacaaggacgggtgagagggtctctccccagcgcgtcgcatcgcaagccaggcgagagggtccctctccgggcttgaggggggacggcatggcgcaaggttcgggcaaggcagacggcagcgcgggacggcgggtgcgccccgtcgcccatgcgctcgcgacgctgaggcgccgcctgaggaacctcctcaacatccgtgagggacgtgcctcgtacctggtcatacgccgtcgctttgtgaacggcgcccgactggacggcacccacctgtgcatcttggtggtggccatgctcatcgcttgcatcgggctcaacaccaactcgaccgaggcgatcgtgggcgccatgctcatctgcccgctcatgaactcggttctggccatctcgtacggggtggcgaccgcggaccgcaaggtctttcgcaccgcgctcgagggcctgctggtgcagatggcgttctgcctgctcacgtccaccatctacttcaggctcacgccgctggtggtcgagacgagccagatcctggacaagtccacgcccacggtgtgggacctcatgatcgccctcgccggcggctttgcgggcgggctcggcaactcccgccgccaggagccggcgaccatcatctccggcgtggcggtggcgaccgcgctgatgccgccgctctgcgccgcgggctacggaatcgcggtgggcagcctggcgcgcttcctgggcgccacctacgagttcgccatcaacgtggtgttcatcgcgctcgcctgcgagctcgtgctgctcctcctgcgcgtgccgctcgcccgcgacctgggcgaggacggcgagccggtgcaggcggcgaccacggtagcccgcgagcgcgcgcgtcgggtccgctggagggtcgtggcggcgaccgtggtgtttgccatcccctgcgtgctgctcacgcgcaacgtggtgagcgcccaggcaacacagggcaggtccgcctcgcccaccgaggagcgctacgaggcgtccctcacggcagacgagatcaaggccatctgccccagcctgcagggctacagcgtgggggaggagtacgcggggcattcgggccgcgacgcacgggtggtggcgcacgtgaggacgtccgaggcgctctcggcggaggaccgcacgcgcgtggagcggttgattcgcgtccacgtccccgacctggaccacgtggagtacgcgaccagcgggtgaggccgcaggggagaggtacggcgcgtctctcccccaaatcccttcgccggcgagaggggtggcgtctggggatgggagcgggatggtgcaaggaggtcgaggctcttacctgcttgcctggcgattgtccaaggggggacaaacgcgtagacatcctggcccaaggattctccccatgggctttagggcgtgggggtcgatcgcggcggccggatggttccttgggaatagtggtcgtgcccgcatgagaggcgccttggtctcggtctcgaccaattggtgctgccgggggcgtgcacgggcagtaggtgccgcccgggtgccttgccatttcggcgctcgcctggcgctacccctggcgggaagaagccgactgctttgtgtgggcggtgcgcgttcgggtggtgaggggccgctgcttagaaagttcggtgcgtgctcgggtggtgagagtccgctgcttagaaagttcggtgcgtgcattgatttggaggacaaatgcttaatcccgtcggtgctcgtacgggtcaggcacgctgaaatccgttcgggcaccggcattcctaagcgatcgcaccccacaactcgtgcgggcaccgatttttctaagcattcaccgttggggggccgcgtggatccgggcgagccacccatcctacgaggatgccggcgcgcgatgcttggcgatgctagccctcgtgtggatttggatgccaggtgcttagccgtactaggcctcatggggattttggtgcccggtgcctagcatctggcactcaaagtgagctgtgccggcgaaatccccacgaggcctaacaacgttaagtatgcggttgcagaaaccgcaagaggtctaggaagtccaagcatttcagcgtggaatccggacgagggctaaggacattaagcatgcgggtccccagatcacacgagcccggggcaggtgaagcatggcgaggctcaacccatgcggcggggagagaaccccggggcatcttggtcgtgaccgcgtgcggctgggcttgctgtgaccgtcgcccccgaccgctcgcgcatggcgcgaagcgtatcgtgaccgtcgcccccgaccgccctcacggatccctgcccttcttcgagctcctttccttctcctggctactcctgattctgcgtccgtctctgtttccgctgccgccccgctgcgaatccacctctccagtcaccgcctacggcaggcggggccgccgctccccacccctgggttgcgacggccccgcctgggccggaccagcatgtgtgcggacgtgtgcccgcgacgccgcgcctatctcgcctgcgacgcccccttgccgtccgccttggcctcgacctcagcgtcagcggagtctgcggcgacgcccttgccttcgccagggtctgccggcatgggcaggatcaggttcatgagtatgcccaccagcgtggaggtcgccatgccgggcagcgcgtagtcgccgatggggatggagatccctgaggtctccatgcccacgcccaggatcacgaccaccgaggcgatcatgaggttgcggttgatgccaaagtcgaccttgttggtcacgtacatgcgcaggccgttggacgcgatgaggccaaacagcagcaggctcacgccacccatgaccggggaggggatggagcggatgagcgccgccagcttggggcacaggcctcccaccaccagcgcgaagccggcggcgtaccaaaagacctgggtagagtacacgcgggtcacgctcatgacgccgatgttctcggcgtatgtcgtggtcgggggcccgccgatgagacccgagatgaccgtggagatgccgtcaccggcaagggagcgcggcagcatggggcggtagtccttgcccacgatctcgcccacggcaagcaggtggccgatgtgctcgatcaccacgaccagggcgaccggcccgatgagcgcgacggcgccccagtcccactgcgggtggtgcagggtgggcaggccaatccaggcggcctggacaacgggggagaagtcgaccatgcccatggtcagggccaccagatagcccacgatgatggcgagaaggacgggcacggtgccgatgaggccgcccatgctggagaagaccacggccgcgagcagcgtgatcgccgcgacgatggcgcccgccgcgtagaagctgacggtgccgtcggcggccgtggtctggaacgccatcttcgccgcggtggcggagaggcccacgccgatcacgaccatgaccgaggcgaccagcacgggtgggagcagccggtcgagccagccggtccccaccaggcggatgatgcccgcaacggccaggaacaccaggcccgccaccacgacgcccgagagcgccgcgtcgaggcccttgctcgccccgatgatcacgatggggctgatgaacgcgaacgagctgcccaggtagctgggaatcttgttgcgcgtgaccagcaggtagcagatggtgccgatgcccgagcacatgatcgccaggttggggtccagcccggtgagcacgggaaccagcaccgtggagccgaacatgctcatcatatgctggattcccaacgggatggcgcgaccgaccgacacgcggtcgtccaccccaatgatctctcgcgtctctctcgccatgcgtctcctttcctcgttgccgccccgtcgtcgcgcgcgggacggtcgtacgcaagcctgcacaaatataggtgaatgcgttggcggggaacgccgttggccggcctttcgtttgccagccgcaacctgcgtgacccagcgggaacatatgcagtgtgcgagaacggccgggcgagacgtccgggctccagcgggggaggcgggctacatggacgagagggacctcatcctcaggcttgcgggtggagcgctggccacggccatcgtgctgggcgtcgcgttccaggtgtgcgagcttctcggccccgttgcaagggcggttgcctgtgccatcggcctcgtggcgatggtcgccttcccgctgggggagatgcgcgccatcctcgggcccaccgcgcggccagggcgcggctcgtgggggaccatggccgcgctgctcgtcacgttgggcatccccatggtcgtgctcgggatgcagggccagctcgacggcggcacggcggccgtgctggccctgctcccgggggtggcgtttctcgcctcgctcggtcgcgggctccgtggctgaccgtcagccttcgttcaggttgggccccaaggcattcgcgtggacgaacatgccctagagtctccaattgcgtacacggaaggttcgaaggggctggacaatggaatacgagcgaaggctggacgccaggctggtgctgtcggtggtggcggcgggcatcatgtcgttctcgggggtcgtggtcgagaccgccatgaacgtgacgtttcccaccctcatggcagagttccacgtgggcacctcgaccgtgcagtggatgaccacgtcctacctgctcgtgctcgcggcgatcgtgcccacctccgcctggatgtcgcgccgctttcccaccaggcgcgtgttcctggtcgccatggcgttctacatctcgggcatcacgtgcggggcgtgcgcgcagagcttccccatgctgctgtgcggccgcatcctcgagggctgcggcaccggcatcgcgctgccgctcatgttcaatatcatccaggagcaggccccgctccagaacatgggcaccatgatgggcgtcggcagcttcgtcaccgccatggcgcccgccatcgggccgtcgcttggcgggtgggtcgccgagaacctgggctggcgctggatcttcatcgggctgctgcccatcctcgccgtcgcgctcgtgatgggggcaacgaccatccgccagagccaccaggccggtccctccccgttcgacgttgccggctgggtcacgctcgtggcgtcgttcgcctccctcgtgttcgcgaccagcggtgcgggcgagaggggctggggcagcccagacgtgatagccctcctcgtggcgttcgtggcgcttctcgccctgttcctgcgcaggaccagggcgcgcgcccgcgacgggagggccgtgctcgtctcgcccgacgtgttctcgcaccgcggtttctcgctctccgtcctcgcactggtgctggtccagttctgcgtgctgggcctgagcttcctgctgcccaactactcgcagctggtcatgggccacggggcaaccgaggccggctcgatcctccttcccggctgcgtggtgggcgcgcttctcgccccgctctccggcaagatgctggacacgctgggggcgcgtcctcccatcgtcgtggggagcctgtgcatgctcgccgccaacgtgctgttcctggtcaccgccggcggctcagggctccagaccgcgggggccatgggaatctacgtgctgtttgcgtttggccagggcctctccatcggcaacaccatgaccaacggtctgtcgttcctgcccggctccgagcgccccgacggcaacgccgtcatcaacaccctgcagcagctctccggggccgtgggaaccagcgtggtgaccaccatcgtgcaggcgtcccagtccgccgccggcgggtcccggctcgctgcctcgaccatggcggggacgggcaacgcgtacctcgtgctcgtggtcgttgccaccggggtgctggcctcgcagctgggcgcgctctcgtccccgcgcgagggctaggggaggggaccgtccgtcccgtgctgttgcccgtcacggcgctgtcgcggtgggttgaggccgaactccactgggcgaccgtgcgtgtcgcaggggtggcggatctcgaagccacggaaggggagaagggccaccttcgtgctcgcgacccatccccacggccatccgcgcatgcggggtggagggctatggtcacgcaaggggcctcggaacccgagaactacgttccacctacgagggacttagagaagagggaacgcagcggggcgggaagtgcgcgcgtctccgcccggcttccaggtctgcggctccgcgttccagctgctctcgtaccgcaatggttggacccatgccagagattacgtccaacgtgtacacgcgggacgcactttctggcagcactgaggtctgaatgccccaccaactgggaaaacgctgcgttacgacaggcctttgtcagaaatcgcgtaccgtgtgtacacatgggatgggctttctggcgtccgcccgcccgcgacgggtggtcctgcctaaagtcacgccccgcgtgtacacacggggcgtttgcttccacagttagattagtgatgtgccgccaactgcgggaatacagttctagtgttcgtcgacaacccctgagggtactcacgcggggagtttgctgccaaggtttgataattgatgtcaaatccctggcagcaccaccgaatgccgtcccaggaagcccactgcccgcagtcggaggatgcccgtcatcgtgcacaacgagaatggaagtgctggtgtgttgctgttgcagcacgagcctctccttctatgagttcttcttctttcatctgccggctacgcggggactccggctccggtctgggtgctatggcaacggatctccgaaatgagcggtttcgcgaccgcgcccttggcggggagccaacaacgcctttgcatttgggcaggtagagaggatggatatggatccgcgaccgatgggttggcagggaactcctgaaatgagtgctcacatcgggagttcgctgccaatctgtccctgtccattcccagttgggcagccgattccggatatgagcactcacatcgggagcttcctgccaaggttagaatattgatatcctgtcactagggaaaacgcctcgctctcccatcccggtggcagcgggagcctgatgtgagtactcacatcaggagttttctgccaactctctgttagaccagcattgacgtagccgctccctaccgttgccaatagtcccagaagggctggggacgatcgatcatctggcgcctcgtatgctcgtagaagccgcaggcgctctggccggaaaggtctgagagcccgtctgcgtcgaggcgcctgcctgcgcgagccaaaggaaccaggaggaggatagggtccagcactggtggatacgccgtggaatgggcaaggaagttatgtcgcaccctctggtgcatcgcgtgaaaaccatgcccaactgctcgcctcgtcctttgcaggcgcgtgtcgtgtggcagcatgctcgttgaagagggcgggaaggcaacgcgcttgtagcctgatgggccgtcggtcgccaccagcggtacaggacgagccctgatgcgtaactcaggcccacttcggccttcccgtcggccacgcggcagagatcgtctcggcatcattggctccgcagatgccgcgaccttgaggtgacatgtcccgcgcgcaatggacgcgccgccccgtgtcttgggcttctcgggctattggcagcactcctgtgccctgtttcccgtgggagggactcgtcgaggtagcgacgtctactgccaggaggagaccgaaggtccgtcctgaagcgaagagcgaggcgctcgcatatgcctcggcagagtctcatgcgcatgaaccaggaggtctgaggcacacatggcacatcttcgcgcactgccgcaggcttgagcccgaaaccgttgcttccacgaagagcgcccaggtcgtgatcgagctggaggcggcgagcagtgccccgctcttggacgatacgtcctcaccgcaccccttgtcgagtccaagcgctaggggaccgtcggcatgtgccctttcctgatgaaggaggaagcagtccagcaagggcgaagcatgatctgggcgtcgcccatatgcctacttgccaagctcagcgcgcgaccgcacgccttcgtgggcaaagatgactcggcttctcctcgcgggagagcccctccatctcatggagtatgatgtccagcatcccgtccccgtctcttcgatgctgatgtttggcgacattcatcctagggcggggacgggacattattacgtcaacgctggtctaacggagagtctgccaaagccgtgcggcggggaggggagagcaacggccccatcctttcctagactcgatgggttgggggttagtggccccttggaatttcaagctttcccccaggttggaaacaggatgaccctccggcaaacccaaacggcccctcccgcgagtgatcgcggaaggggccgtgaagccgacggattggggccgtgagtcggatgcccgggcctctctcacctgcaaaggggcgaggaccaacctacgccttggactcgccatcgagcatcgcgcggatggcgtcgtcactgtcagattccagcgcgccgagggagcggtacagccactccgtctgctggggggagggctcgctcgccagcggggaggaagcaaagccgaacagggcgtcgaggagcttggacccgtcggcagagagctcggcggggtcggtgccctcgtgggcggggacggcgcggtggccggcgacgtgctccacgaagctgcggacctgggcgacctgctcggagatgcccgcaggctcttcgggggcgctggcggcgcgcagggcatccgtcacgacctgcgcgggggtgccgcagggcacgaagccgggcacgtcgtccatggctgcggtgatggtcgcgccgagcgcgatggtcgcgttggcgagctcgttctgaagggaggtcattcgtcgctcctttggggtgggttctctgttgtcgccacaacggtacacgcatttgcggcacaagactgttgccgtcacaacagtacgaccaccggtcgagaggcgcggcggacgggaccctgtccctcgccactgccggtggggtgacctgcggcgacgttcgcaatccctctcccctgccgtgccttcggcatttgtcgggtcggtggaggtggcgaatcgaccaggttacggatttttccgccagcctcgcgggagagtacctttctccgcttgtgtgccaccaaggcgagaggggagcccgaggtagatgacgcaggcgggatatctggagtgcgagaggcgctgggtgtactggcttctgatcctggttgcgggatggtacggcgcgtacacgttctcgctgcgaggcggcgtgttctgcaacgcgcagaccgcaaacgtggtcctgcttgcgatggcggttggcgacggcaaatggctcaatgccgcctacctgctgctccccatcagcgcctacctgtttgggtcgttcctctccgagtggatgggcaagtccatcaagcgcctgaacctcctgcgatgggacacgctattggttgcccttgaggtcgcgatggtcgtgttcctggccctgatgcccgccgactggcccgaccagatctgccaggtcaccctcaacttcacctgtgccatgcagttcaacacctaccggcaggtcgagggcgtccccgccgccaccaccttcgtgaccaaccacatcaggcagatcggctccaacctcgccaagctggcgcgccacccgcagagccaggcgctgcgcagtcgagtcctgacccacgcctcgctcctgggcttcttcgtcgtgggatcgatcgtctcgaccgtgatgtgcggtgccttctcgtacgcttcgctcctgggggcgcttgtccccctcggcgtggtcctggcagggctccttcatgccgacctggtctctgagcgcggccagctcgccgccgtcccgcacgggcactaggctctgggcaagcctcctcgtcaccaggggagaggagcgcgcgtccctgcccccagccagacgggctggcagcgggtgccaacgtccccctcgcccaagtcacccgactacgacgccaacctgccctgcgagcgaacgtgcgcccgcagggcaggttggttttgcgtgcacggccgcgatgcctcgcccgtatcgcgaggggggtgcgaatccctacttcctgagggcctcgtggccggtgacgatggtcatcgccatgcagaagagggtgagaaacgcaaagtacttgtgtgcctccattggcgccttcatggtctcctccagcctgttggtgagcgttgggtcgagtctagccctgacgcgcggcgcgtgaccaccgagcgggcgagcccttttgggcggagaggccatcgtgcgcggggtggggcctcgtgggaaggcgcaacgcccgtcgcgcggtcgcatgttcgaggcaagacatcgagaagggcgaatacctcatggggcacacccctaaggctgatcgggctcgttcttctccgcctacaagagcacgtccagcacctgctgcggggcatccgcgggcgcaaccagaaagtacgtggcgtgggcgtcggcatccacgatggggacggtgacgcgaccagggacctcgccctcgttctccggtgcgtcggtcgtgaagcacagtatgtccgtggagttcatgagccggctgaagaccacccggtcgtcccgcaccgacttcgacgagtgggagggcggacgcgcttctcgtccacccacaaaatagtccttgacctaaagccaggtttaggttcgagaatcagggcgaaccgcaagcgggccgggggccgatggggcaccggcgtcaatcggtccgacggcagacaaatgagcggaggcgcaggtggcgccccccgccaggggagaggagcaatcatgaggcagaccgcgggaagagaccagctggggcagatcgccccgcttttcgcgcacctcaacgacgacgtgctgtttggggaggtgtgggagcagggtgccatcgacgccaagaccaagtgcatcgtcacagtcgtcacgctgatggcgtcgggcatcaccgactcatcgctcaggtatcacctgcagaacgccaaggcccacggcgtcacgcgcgacgagatcgtcgccgtggtgacccacgcggcgatgtactgcggctggcccaagggctgggcggtgtttcggatgatcaaggacgtctggggcgacgagcccgccgatcccagcgcgccgcagggcctctcgaccgactttcccatgggtcagcccaatgacgcctacgcccagtatttcgtcggccgcagctggctcgcgccgctcggcgacccgcagctgggcgccgccaacgtcaccttcgagccgggttgccgcaacaactggcacattcaccacaagggcggccaggtcctgatctgcgtcgccggtcgtggctggtaccaggaatgggacaagccggctcgtgccctgggccccggggacgtggtgagcatcccgcccgaggtcaagcactggcacggcgcggcggcagactcgtggttccagcacatcgcgctcgccgtccccgcagagggcgacagcgcggagtggctcgagcccgtctcccaggaggactacgagggcctggagtaggggagaggcccacggtacgagtgccgtgggcccaacccgctgacatccgcggaccttctgggccaggggagagaggggggcgtgttccggccctgttgccgcggtgcatgcctcccctttcccggtcggagggatcaggacaatcaccttggtataccatcggggattcgaccgtggcgggaactgggcaaacatggacggccccgtcgccgggagggtgcgaaggtgcctacgcgagcgatttgccgctatgattgaatgattgattgactgccagcggggaagaaggtggggcggcgggcgctgaaggaccatgcctgctgaggaatgtcgagtaatggcaacctgaaagcccgttccgccgaggaaagtggagtattggcagcccggggccacgttccggcgctgcaaccccacttttcccgtcacttagcgtgcatccgcgctgccccgattgccacaactcgcatttcctcagcacccatgctcccgcggtggccaggagagcgtacacacatcgggagctcattgccagtggggctatcgtgagaggcacccgactcgctgccgttgccctccctcgcagtgaagggctctaagaaggggtcgtgggggcctgtcgcacgtggaggggccggcttgctcggaaggatgaccccgctccattcttagccgattgattcccgccgggatagtcacggctcggagccttggttgccagatgctgggggagtcaccccgcgtcagagtcctcgttccgcgtgcatgcgtgcgtgagcaccttcgaggctctccggcggttggcgacttctcgtttacccagttgcacaacaatcaggagtcgaatcttggcagcgaaggcctcgcgtgtgcgctcacgcgaggccttctctgccatttgggatctgaaattaggttcggtggcagcaaactcccgctgtgagcactcataccgggctcccgttgccatggtttggattctggtgtcctgggcgacccctctacctgcaccgatgcagaagccactcaatcccttaacggggacttgtcagccaaagtgcacgcttcgtgaatccgttgccacggtcttctccttgatgccatgcgtggagacggcaggtcaggggagttcctgcccccgagtgaggcgcccttgggtgcagccccttctttgacctgggggtccggtcggggtcggtatcgaaatgcagatttccccacgttaggcgcccgggaaccaaaggaggctgcccgcacgtgctcgtcccaacgcgatgcctccgctgccgggcggaaagtttatccgaacgttaggctgccatgagccgtgcgatagggccggagtccaggatgtatgccgtcacgttccacgcaaccccatggaggcgcgccatgtccctcgacccaatcatccagcgactccgaaagctggagcccatcctcgttcctctcgcctgcattgccctcttcacggggctgttcctggaggtgagggagcccctgcttccccgcatcgactccatcggcctctggcttgtcgccgcggtgagggcgccctggctcgtctccgtgatgcaggccgtttccatggcgcccttcgtggcccttcccgccgccgccatcctgctctttgcgagggggaggcgcatcgactccatcggcctggtctccgacgtctgcgtggcgctcctctcctgcgaggtcctcaaggtcgccatcgcccgcccccgcccctccgacgcgctcgtgaccgcgctctcgtccagcttcccctccgggcatgcgaccgtgaccgccgcgctcgtctcgtttgccgcgctgctctgggtgcgccgccatcccggctctgccccccgcgccctggcggggtgcctcgccgcgatcgtgctcatggacgccagccgcctcgttctgggggtccactacgtgagcgacgtgctcgcgggagacgccctggggatcttcgtcacctggtgcgtgtggcaggccttcgcgagaatggggtccgcacgccggctggcgtccgagggctcctccgaccagacgtacggtgccaatccggcttgagggcgttgaccgcgtcgcggcgctcccccaagggcgtgcgttgccgatgcgacctcaagccagacccgggtctccccgcgtcagcggaggcggcccgggcccttgcgtttgcccgggactcccagcaggggagacgggccgcatgcgaccccgcctcccgtccgcgcgcttggacgggagggcctcgccgtacactctgtctgacgggcggcagcggcggtgccccatcagtctcgtcccgtgccgccacccgacaaccccaagcgaaaggagggcgcagatgccgcgcctctcgaccatacggcagcgcctccgcctctccaacgtcctgaccctgctcgtccccctctgcgtgtgcgtcgccgtggcgctcgcctgcgtcgcggtgttcctggtgcaggtgcgcggggggctcgacctgaggatcagcgatgccgaggacatgaccacgctcggtcgggtcatctcggagtcgacgggctacatcctggacgggccccaggacgagagggacggctccctctcgtcgctcgccaagagcgtcgagggcagcggtgccgtgctccaggtgtacgacggatcgggcggcctcgtgttcagctccgggacccctgcggaggaggaggcgctcctggcctcggcgcgggcgctcgacgacaccaacggcgtgctggtctccgcggcggggaccagcctgtaccttcacgccgagggctcctaccatgtcgccctctttggccactacgccgaggtcagggggcacgccatcaagcgagcaatcgccatatccgcccttgtggtccttgctgcggcggtcgtctccacgcttgcgatggaccggctcgcccgccgcctggtgtacgaccgcgtgaccgacggcctcactcggcttgccgacggcgtggctcgcatcgccgacggcgacctgtcctatcgcatcgagtatccccggcaggacgagttcgcccccatctgtgacgacttcaaccggatggcggggcgcctggaggaggcggagcgccgcggcatcgacgacgagcgccgccgccgcgagctgatcgccggcatcagccacgacctgcggtcgcccctcacgtcgatccagggctacgtggagggccttctcgacggcgttgcctccacccccgagcagcgggagcgctacctcgggaccatccagcgcaaggccagcgagctctcgcacctcgtggaggacctcttcctgttctccaagctcgacctggacgactacccctgcgacctcgtgacggccgacgtgagtggctcggtccatgccatcctggacgacctcgcgcagacctacgacgagaggaccctgcgcatcgtcgaggagcccggggagcacgtggagtgccgcctcgaccgtgccctgctccagcgctgcatcgccaacgtcgtgagcaacgccgccaagtacgacgcgggcggcaccctcaccgtgcgtgtgggcgagagggacggcgtcgccacggtcgcgctgtgcgacgatgggaagggggtccccgaggaggagcgccagcgcctgttcgacgtcttctaccgcaccgaccccgcgcgccagcacacgggatccggctcggggctgggcttggccatcgtggcgcgcgccatgaggaggatgggcggcacggtggaggcgggcgagtctcccacgggcgggctcgcgatcctcctgcacctgccgacgacgagggagtgaggccgatggagcgcatcctgatcgtggaggacgacgaggacatcgccctcctggagcgcgactacctggaggtcgccggctttggtaccgagcttgccgcgacggggccggaggggctgcgcatggcgtgcgagggggacttttccgccgtggtcctggacgtcatgctccccgggctgagcggatacgaggtcctgaggcggctgcgtgcccagagcgccgtgcccgtgctgctcgtgaccgcccgctccgacgacatcgaccagatccgcggcttggggcttggggcggacgactacgtgaccaagcccttctcgccctccgtcctcgtggcaaaggtcaaggccgccatcgcgacggcggagcgccaccggcaggcggcttcgggcaccgtggcggacggtgggggagaggcccgtcgcctcacggcagaggggctggtcgtggacaccgggagccacgaggtgtgggcgcggggcaacctggtggagctcaccaaccgcgagtacgagctccttgccttcctgctcgcgcacaaggggacggtcttctcgcgagacgccctgtacgagcgggtgtgggggctcgacgccatcggcgacggggcgaccgtgaccgtccacatcaaccgcctgcgcgagaaggtcgaggcggaccccggccatccggccgtcatccagacggtgcgcggggcgggctacatcgtgcgcagcgactgaggggcagcgggccctggtcggggccggacggcgcgccgctgcgggagtggggcgccacccggccccctgccgcggcaccgtcaccccttcccaccgccgtgacggggcttgtacctgtgtggacgtgagcgtctcgccccgacgcgacgactttatccagagtttatcctgccgttgggaggccgttaggacgcctccgtagcatggggaccgtcaatagagcccatctcggaggtacccatgcaggacgcgatcttctccttcatctcgcagtttggctatgccgcggtcagcggcctcatcttcctcgagaacgtgtttccgcccatcccgagcgagctcatcctgccgctcgccggcttcttctctcgcacgggtgccctgtggctccccctcgccatcctcgccgccaccatcgggtcgctcgccggcgcctacgtgctctatgccatcggcaccgcgctcgacgaggcgcgcctctcccgcatcctctcgtccaagcccgcccgcatgctcggctttgaggagacggacgtccgcgccgcctttgggtggtttgagaccaagggccagaagactatcctgatctgtcgctgcatccccgtcgtgaggagcctcatctcgattcccgccggcatgtcgcgcatggggctgggcaggttctcgctcatgaccttcgtgggatcgctcgcctggaacacggtgctctgcgggcttgggtactgggccggtggcgcctggcagcaggccgcctcgggtgccgcgagcgtgatcgacatcatgacctacctcgtcatcgccgcatttggcgtcgccgcgctcatgtggttctgccgcaggatccttcctcgcatcaagagccaggggacgacgccccaggattccgtggccgagcgctagacctgggcaaagcgccgcgctgcgccttgggaagggcctcctcgatcgcctgccatggcattgcgagacactaattgcgagacactaagatactcgggagtaagatacttccgagtatcttgtttattgccgcaaatggagttctcgggagagtattccggtgtctgtcggcgtgtcccgtctcatccattgcttgaaccggctccgtgctgccacatccttttggaaggccagaaactttttgactccccctcgccgagataccgtccccgcatgcatcgatagccaatctgcatgtatggaagtgtcatttttgtgtcagaacgatgcatgaggacatcattttgagagcttagggcaactcctataattgccctagcgtgtcgggcgcttacgtgggagctggacaaaacatgaagagcaagcgggacaagaattcttccaacaagaagaagcggaagagcgcgcttctcaagcttactgccgcgacgggaaccttcatcgggaccacgatgatggggccgggcaacaccgtctacgcgcaggagatggactctgcgagcacggacagcgagacggaggagctggagagtgccgccaccgcctcccagacggtgtcggagtccgtcgcgacgtcgcaggagacggtcgaggcgcctcagtcccagaacgtgagcgctgccaggagcgccgccccggcgccccaggcgcagtcccagtcgtatgccgagtctgccgctgcggactcggagggcagccagtcgggagaggtgggctcagaggccaaccaggtcaccgccgagtcgcaggcgagtgctgcctctgtgggcaacgagggctctgactcccaggtcgacagcgacgcaagcctgtctgagagtctctcgacgtccgccagcgccgaagcctccacgtcggcaagtgcctcctccagccaggaggcgtccgagagggactcggttgcggagagcctctccacccagaggagcgcgtccgtctccacgatcgaaagccagcagtcgagcgaggccgactcgatagcctctgcgagcgagtctgcggagcagtccaccgtcctctcgacgagcgccgcgacctccgtctcggagtccgcctcggcagagcgctcccaggaggagtccacgctcgtctcccagtccgagtcagcggagtccgcgtccgagtcccagagcgagtcgctctcgattgccgcctccgaggaggcgtcgagggcgcagagcgtctctgccagtttgtcccagaccgtgagcgaggcaaactccgcatacgcctccgcgtccacctcgttctctgaggcgggtctccagaaggagtacctcgagaacctcatctctcagattgaggttgcgaggcagcacctgaaggcgattcaggagagggcgcttgcggagcataggtcgcttgctgcagattccgcgtactggagggctggagagggaccccggacaaaatcccggacctcgggagggtccaggaaggagtccggatgtacacgagggaggagcgcgaggggatcctctgggagttccaccggagcggcctgagcgtgagccgcgcctgcagggagcttacgatgttcccccacagagacgtcctcgcggactggctgcgggtcggaggcagctcggccgagctcgtcgcccgggaagatgatccggcatgggccggccgcatgcactgcacgcaccagccgccggccccaagagcgcctcctcgagtcggcttgttttagccttcccctcgtccttgggacgggggcgagcggacgggggccgaccttggcgacatcgtagagcacgcggggcagacggactgcgcgacggggggccccgacctgccggaggaccccgcgtagcgggcgaggataaccgaggtaaagctcgccgaggcccctggcggtgtttgacgtcctaaaagcacccgcccctggctctttgaccagcggggagaggtacccgatctcagggcaggcggccagggaggcgagcccggcggtcaggctcgctgacgtcctgcgataccacctctccatacccaatagcacctacctcggtccatgcggccagctctcccgcccgacccgaaggcgccctcagggctcgtcgtcgcgcgtcttcgcgctcccggcggcaaccttcggctccgaagagcgttcacccgccgaccttcagttcgcggcgaggcagcccgtctctggcgcgacctcgcggagggcgacgagggacgccgtctcatcgctcctgagaaggtcgtgagggccatcatgcgggaggagggcctcgtcgcgaggaaggctggcccagatgccaggcgagggcccgctacaaacagctaccgcggcgccaactcgccccgaggcccgacaacctgccgctcgggaggacggcacacacgacttccgcgcaggcgagcccggcctgctcgcggtcaatccgacgtcaccgagtctcgccctcgacggctacaaggcctacctctcgcccgcgatcgactgcttcgacgggaggcccgtctgctggagggtctcgctgcaaccccggacaaggagctcatgttgggtcatgctcgacctggtggggcccgtgaggcgcgaccgaggcgcgcccgctggtgggtccacacccgaggcggggcggtgtacatgacggacgactgggcctcggcgtgcgaggagggccacgtcacccctcgatgtcgccaagcgaggagccccgacaacgcgaggtgcgaggcttcttcgggacgctcaaagcgactcgatttcgtgcgaggtcgtcgactgggcgggtcccgttcgaggagttcagggacaggctcgaactcctacgtggtctggtatcgtgacgtgaagccgaagaagtcgctcggctggaggacgacggcggagtacaggagggacctgggctacggctacacgctggcggcctaggtccggaaaatcgtccggggtcccagatgagctggcaaaccttctggtgaagtacagcttctaccaggacagccaggtcactcagattgagtacggaacctgggagaagaactccggtaacgccaactacgtgcacgttgtctacgtcgatgagtatggcaggaagcaggacgcctacttcgattacatcaccgtcgacaaggacggcaacgccctgatggacagaagcggacatcagatgtccagttactctgacccgtcacagatcagcggcatcatggtgctgaagaagacaccagtgtataactggtggggtaagcttactggctttacggatgactggtggggtgcttctgattacaggaacgctacgggccaaacgcagagtggttactttggcacaaagggtaactattacttctccgaggctgactacgagaggggcaaggacagctactcccacgacaggagtgatctgacctcgacgtcgcactctgccagcgcggcacagtcgcaggcggattccgcgagtgcctcgacaaaggcatccgaaagcgcaagcaggtctgccagcgggtctttgagtaacgaggcaagcgcgagtgcatcggcatctgccagcaggtctcagagcagggatgccagcctgagcgactcgagcagcgcctccgaaagcgcgatggagagtgcgtcagtcagcacctcgacgagcgcctccgccagcacgtctgcctccgagtcgaggagcacgtcactggtcgagtccgagagcgtgtcggcaagcgagagcgcctcggagtcggggtccgagagcgcgtccgcaagcacctcggcgagcaagagcgccagcaccagcacgtccacctcgcggtcggcgtctgcttccacatctaggtcggattctgcctctatcagcgtgtccgagtccgagagcgagtcggagagcgagtcggagtccgagagcgagtcggagagcgagtccacctccgcctccgagtccgagtccgagtccgagagcgagtcgatctccacctctgagagcgagtccacctccgcctccgagtcggagtccgagtccacgtctgagagcgagtcggagtcgatctccacctccgagtcggagtccgagagcacctccgagtccgagtcgactagcgagagcgagtccgagtccacctccgcctccgagtcggagtccgagtccacgtctgtctccgagtccgagtccgcaagcgagagcgagtctgagagcgagagcgccagcgcctccgagtcggagtccgtctccgcctccgagtccgagagcgagtcggagtccgagagcgagtcggagtccgagagcgagtcggagtccgaatcggagtccgagtccacgtctgagagcgagtccgagtccacgtctgagagcgagtccgagtccgagagcagctcggagtccgagtccacctcggtcagcgagtccgagagcgagtcgatctccacctctgagagcgagtcggagtccgagtccgagagcgagtccgagtcggagtccgagagcgagtccacctccgagtcggagtccgagagcagctcggagtccgagtccacctcggtcagcgagtccgagagcgagtcgatctcaacctctgagagcgagtccacctccgagtcggagtccgagtccgagagcacctccgagtcggagagcacctccgagtccgattccgagtccgagagcacctccgagtccgagagcgagtccgagagcgtcagcgtctcggagtccgagtcgaccagcgagagcgagagcacgtcggagtcggaatctacctccgagtcggagagcgagagcgtcagcaactccgagtccgagagcaccagcacctccgagtcggggtccgagtccacgtctgtctcggagtccgagtccgcaagcgagagcgagtccgagagcgttagcgtctccgagtccgcttctgagtccgagtcggagtccgtctccacctccgagtccgagtccacgtctgtctccgagtccgagagcgagtccacctccgagtcggagtccgagtcgatctccacctccgagtccgagtcggagagcgagagcgtcagcgtctccgagtccgagagcacctccgagtccgagtccacgtctgagagcgagtccgagagcacctccgagtccgagtccgagagcacgagcgagagcgagtccgagtccacctccgagtccgagtcggagagcgagagcgtcagcgtctccgagtccgagtcggagagcgagagcgtcagcgtctccgagtccgagagcagctcggagtccgagtccacgtcggcctccgagtccgagtccgcttctgagtcggagtcggagtccgagagcgagtccacctccgcctccgagtcggagtccgagtccacgtctgagagcgagtcggagtcgatctccacctccgagtcggagtccgagagcacctccgagtccgagtcgactagcgagagcgagtccgagtccacctccgcctccgagtcggagtccgagtccacgtctgtctccgagtccgagagcgagtcggagagcgagagcgccagcgcctccgagtccgagagcgagtcggagtccgagagcgagtcggagtccgagagcgagtcggaatccgcttcggagtccgagtcggagtccgagtccgagagcgcctccgagtccgagtccacgtcggtctccgagtccgagtccacctcggtcagcgagtccgagtccaccagcacctccgagtcggagtccgtctccacctccgagtctgagtccggctccgagtccgagtccgcttcggagtccgagtccgagtccgagagcacgagcgagagcgagtccgagtccacgtctgtctccgagtccgagagcgagtcgatctccacctccgagtcggagtccacaagcgagagcgagtcggagtccgagagcgagtcggagagcgagtcgatctccacctccgagagcgagtccacctccgcctcggagtccgagtccacctcggtcagcgagtccgagtccaccagcgtctccgggtccgagtcggagagcgagagcgtcagcgtctccgagtccgagagcagctcggagtccgagagcgagtcggaatccgcttcggagtccgagtcggagtccgagtccacgtctgagagcgtctccgagtccgagagcagctcggagtccgagagcgagtcggaatccgcttcggagtccgagtcggagtccgagtccacgtctgagagcgagtccgagtccgagagcagctcggagtccgagtccacgtcggtctccgagtccgagtccacgtcggtctccgagtccgagtccacgtcggtctccgagtccgagtccaccagcgtctccgggtccgagtcgaccagcgagagcgagtctgagtcgaccagcgagtcggagagcgcctcgaccagcgagagcgagtccgagagcgcctccacctcggagtccgagtccgagagcgccagcacctccgagtctgagtccagctccgagtccgagtccggctccgagtccgagtccgagagcacgagcgagagcgagtccgagtccacgtctgtctccgagtccgagagcgagtcgatctccacctccgagtcggagtccacaagcgagagcgagtcggagtcggagagcgagtcgatctccacctccgagtcggagtccacaagcgagagcgagtcggagtcggagagcgagtcgatctccacctccgagagcgagtccacctccacctcggagtccgagtccacgtctgtctccgagtccgagagcgagtcggagagcgagtcgatctccacctccgagagcgagtccacctccgcctcggagtccgagtccacctcggtcagcgagtccgagtccgccagcgtctccgggtccgagtcgaccagcgagagcgagtctgagtcgaccagcgagtcggagagcgcctcgaccagcgagagcgagtccgagagcgcctccacctcggagtccgagtccgagagcgcctccgagtccgagtccacgtcggtctccgagtccgagagcgcgtcggagtccgggagcgcaagcgcctccgggtcggactccgcttccgcctctgagaacgaaagcagctctgggtctgcttcggccagtgggtcgacttcaaccagcgagtccaccagcacatctgagagtacgtcggagtctggcagtgccagcacaagcgagagcggttcggcatccgagtctgggagcacctccgagtccagcagcggcagcgcctccagctccgagtctgcgagcgtctcggagtccgggagcgtaagcgcctcgagctcgcggtctggctccgagagcgagtcgggcagcaccagtggctcggggtccgagtccgcaagcacgtccgtctccacctcagagtcgggtagtgtctctgccagctcgtctatcttcgggtcaatgagcacctcggccagctcgtcggagtccgtcttcgccagcctgtccgccagcttgacgactcccaccgcgacgaccacgaccgcgacggcacgtcctgcagcccccacatccgtctccgccagcgtcacggcggcagtcgccgtcgggacgactggtacgggtaccgtcactagcctcgtgacgtccgagtcagtggagacgagcgcaagcgtccttggcagcacaagcctctcgacctccggcgaagagaacgagtctgcctcgcagagcaggagccagaggggtagctcgagcgacagcgccagtgccgcagcgagcgagagcaagtctgcgtctgcctccaccgctgcgtcggagtccgagtccgagaacagcaacagcgtctcgaacagcatcaggatgtcggcggaggacgcctttagcgagagttccagcaacgccgccacgagcactcccgcggcgggtgccagcggaaccagtgcctcgaggagcgccgctaatgccgcgcttgcgacctcggagctggacgagctgaacgaggcggtgtccctgcagatcaggcactagagacatggattgaaagacctggccacctgcctcgcgttggaagcgggacgggtggccacagtgggcttctatgcggtcggaggggatgacggtgcacgggaaggattcgtttctaatggacatgcggcaaacacacgagctgcggaaccggctcctgttcacggccctcgtggtggctgcctacatgctctgccggagcatccttctgtacggcgtggctgcggacgagacgggcggcggcagcggagcacagtacttcctttccacgctggtcagcggcgacaggtatcggatgacggtgatggccctgggaatcgccccctacctcaacgcgtcgctcctcgtccagattatcttcgcgttccgcaactcgacctcgagggccaaggtctcgaagatccagagtgaccgctggatgcgctgggtctccgtcgtcttcagcgttgtcatggcgatcgtgcagtcgtatgggctctcgtatcgcccggacgcgggtccgctctggctggttaggtcgatcgtgatccttgagatgtttggcggcgcgatgctgacaagtctcatgtgcctcgagaacgagcggcatggggtcggtgcctcgatgccgatcatcctcctgaacatcgtgctctcgctcgcccagaacatgagcgccaaccacttcttcgagttcccggcgatcgccctcctgtgcatggtggcgattgctgccaccgcctacatggagaactcgatgatcaaggtccccctgcagagggtctcgatccataacgtgcatgccgaccagaactaccttgcctacaagcgcgcccccatgggcatcatgccggtcatgtttgcgtcgtccgcgtttctcctgccgtactacctcgtccacatgcttgatggcctgtatcccgagaacgcgatgcttgtttccatcagcgacaacatggtcctgaccaggcccctgggcgtggcggtgtacctcgtcctgatagtcgccctcgccgtgctgttctccttcctgatgctcaatccgcgggagacggcacaccagatgcagcgcaacggcgacagcatcgtcgggatgtacgcgggcgagcagaccaagcggttcctgacgagcaccgtgcttcggtggagcctgatcagcggcgtgctgcaggcgtcctgcatggccgcctcgctcgtgctgtcgatgcaggagatgattccggcggcgctcgccatggaccccacgtcgatgatgatcgtcaccagcatcgtctgcagccttggccaggagatcgcctcgtactaccggtacgacgcgtatcggttcttcatgtaggggggtgacgcagcgtgcagtactttgttcctgcctggtataagcagggtgagtggatggagaacgagcaggcctggtatcgcgccaggaccgtgacggagtttgacgacaccgtgaagcaggtccagttgttcttccgccgccacgtggccccgttccagatcgtgctcctgggcttctctcccaacttccgccacttcctccaccgccagggcgtgtaccacgcgccttactggtcgtgcttcgacgcgatgcagggaatctcctcccgctccatgcgcacgttctcgttccacgacctcgcctggccagacgacgtggagtttgtctactctccctttgccgtgctggcgatgagagggggcgacaagttcgcgcaggtggagtttgccgaggacggaaacatgttcctggtggacatgttccagggcgggcagcgcgtctgcaccaacctctacgacgaccgcggcttcgtctcgtgccaggtgtcctacaaggacggagcccctgtgcgcaggcggttcttcgacgagggtggcacctggaagcttgcgcagtacctgacggataggcacgtggtcatcaaccccgccagcgcgtggttcctgcacgggagtggagattccgccaagcgggtcccgtaccagaggcagcgctatgaccgcctggacgacgtgatcgaggaggtgcttgccgacttcctgagggacacgtcgggcgacgacgtgttcaccatcgccatggatccacggcactccgaggtcctggaccatgccctcgccgggcgtccgaaggtcctctcgttctttggccgtcgcatgggggagaggggcctcacgcctgcggggaggaggctgctctcgtcggcggcgtgcgtggtggccgacaaggaggcaaccgccttcgacgtgtgcgagctcatggggtcaagcaccgtcccggtgcgcgtgatcactccctacgaggccagggtggagtttggcgtcagcctgcacctgcacgttcagaacgtcctggtcgccgtcgactcgctgtcaccggggctgtttgacgccacgatcgtctcgcttgccaactacgtcatcacgaggaaccacttggcccgggtgtgcctcttcacgcgctcggcgcactacgaccagaggattgccttgctcaggcaggcccagggcgccctccagagggccggcttggacccggagatggcgagcgacggtcagggggtgtccgagaaccagctgccggagggggacgccaccccggtggtcttctccgtgagccagtgcgtggacgagctgcacgtgagccgcacgatccgcgaacagcgcgtggtcgtggacctctcgcccctgcccgaccagttcctgcagatctcggccatgagcacgggaatcccgcagatagccatgtgcgggacggaatacctcgaggacgggaagaatggcagggtcataggggacgtctcgcagcttgccgatgccgtggacttctaccttgggagcgtggagaatttcaacgaggcgcagatcgcgtcgtacgagctgggcggaaggttcacctccgcggagctcgtgaaggcttggaaggaggtgatccggattggtcagcattcgggcgctgcaactcgggggtagcgactactccgggctggtggagctgggggaggacgtggagtggcgcttcgagcctgccctcgaggacgacgaccccgagtatgacatcgcgctcgtggcacgcaccctcgcggcgccggaggtggcgtatctcgcccgccacgttcgtgcatactgcctgttcgtgtccgatgacatctccctggacgcacggatggcacgcctgatgcgcagccgcatgggaaggcggtatgcggaggcggacgtcccgcggtttctccgggacgacctgaggaactacttctcaaggccctatggcgagaagttcgacccgcatgcgatggaggtctctcccaacttccatggcagcgtgcgctggaacggctacaccgaggcggtcctgcagggctcgttcggcgagtccatgcagcaggtcgccttctggcgcggtaacgtcccggtggagcaggggcaggcgatcgacctctggctggagtacgagaaggacggcgacgtgcagattgagctgcaggtggtgcagttccctcgcggcagcgtctcggtgatccagaacgtctggaggttctcggaggaggacctgcggcagccggtgaccatcgacaacgacaagctcccgggtcccgtcttcgtgacgctcaatgcgcggggccagggtacgctcaggatccgcgccctccacgaccgccactcgcgccgtggagtgggcgccttcgtgccgggcgggcgacgctgggtcacctccgaccgggaggagctgttcacctactttgacccgggcgatctgaggccgcccctgtgcgtgtacttctccggctacaagaccatggagggctttgagggctaccacatgatgcggcggatgggctgcccgttcctgctggtgagcgacgcgaggctggagggcggagccttctacctgggtagcgaggagtacgagggcctggtctgccgggcgataggggaggccctgggggagcttgggttcacggagggacagacggtcctctccggcctctcgatggggaccttcggcgcgctgtactacggcaccatggtccgttccggcgacgtgatcgtgggaaagccactcctgagcctgggcaacgtcgccaagaatgagcggctgcagcggccgggcgtgttcccgacctcgctcgacctgctctggaaggagtgcggcagcctgggcgagtccgccgtcgatcggctgaacagcaggttctgggaccgctttgaccaaacggactggtccggacgcaccatctacgccgcatacatgatcgaggacgactacgaccacgacgcctaccagcagctgctgtcgcacgtgagcgggaacggggccaaggtgatagggaagggcctccatggccgccacaacgacgacacgcggggcatcgtgggctggttcgtggcccagtaccgccgcgtgctgtgccaggagtacggaaggggcagggggcgcgatgccggagcaagataggaactggaccgtctattgggacgagcatgccagcggcgtctacctgtacgggtcggagctggagttccacgcgcgtgacgacgtggagtttcgcaacgccctgatgcccgcggggacggtgatcaagtcctggtactccatggtcaacttccaggagaggagggtcgagccgtccctgccgatcatcgacggcgagggtcgctatcacgtgtccctggacatcgacagcgacgtgccgcagggcatcttcctgcgcttcgtgttccacggcaagaacggtgacgaggccgggagcctggtcatggaccagccggagatggacctgaggtgcccgctcaagacctacagctacgaggcgcagctgatctgtgccggggcgcactcgtttcgcttccactccttcacgatcaccgagagggacccagaatgacggagagaaggttcaggagggccgtagccgccgtgaggtcaaacgcggagcgggtgcgcgggctctctgacgacgagctgcgtgccgagacccccaggctcaggcgcgagctcgcgaggggcaggtcgctcgacgcgatcatgcccgaggcatacgcggcaatcgccgaggcggaccgcagggtgctgggcacctatccgtacgacgagcagatctacggcgcggcggccctgcaggcgggctgcctcgcggagatgagcaccggggagggcaagaccctcacggcgaccatgcccctctacctccatgccctcacgggccggagcacgatcctggtcacggcaaacgagtacctggcctaccgtgacgcggatcacatgcgcccggtgttcgcgttcatggggctgacggagcgagcgggcgtctcgcagacgcccgaccacaccctcaccaacgatgagaagcgcgagaactacgcggcggacatcctctacaccacccatggggtgctggcgttcgactacctgctgaacaacctcgtcaagcgggcggaggaccgcttcctcagggacttcgacttcatcctgatcgacgaggcggactcggtactgctggacagcgcgcagatgcccctggtcatctcgggctccccgcgcgtgcagtccgacctctacgcgactgccgacttcttcgcctcgacgctcagggaggaccgcgactacgaggttgaggacaaggctgtctggctgaccgacgcgggcgtgagctacgcggagcgcttctttggcatcaacaacctgtttgcacgcgagagcttcgatctcaaccggcacatccaactggccctgcgcgcgagggtgctgttcaagccgcagaaggactacatggtgtccgacaagggcgaggtcgtcctcctggacaacagcacgggcaggagcctcccgggcatgaagctgcgcgggggtgtgcaccaggcgctggagcagaaggagcacctggagatctcgcaggagcagcgctccgtggcatccatcacctaccagaacctgttcctcatgttccccacgatgtgcggcatgagtggcacgttctcggacgccaggcgcgagctgctgcacgtgtaccacaagcgcgtggtggtggtcccgacgcaccgcagggtccagagggtggacagggaggaccgctacttccagaccgcggaggatcagtacgaggccgccctcaaggaggcgcttcgctgccacgcgagcggccgtcccgtcctggtggtcacggctacaatccaggacacgcagatcttctcaaggatgctggtcgagaagcacgtgccccacagcgtgctgaacgcgaacaatgcctactgggaggcagagatcatcgcggcggcgggccagaagaacgccgtgacggtctccaccggcatggcggggcgcgggaccgacatcaagctgggcgagggcgtccgcgagctgggcggacttgccgtgatcggcctgggccgcatgcagaacacgcgcctcgagcgccaggcgcggggccgcgcaggcaggcagggcgacccggggtcgagccagttcttcgtctccctggaggatgaggtcgtgacccagatgtaccccgagagggtctcgcagatcctggatgccgaccgaacggtctcgcgccggagactccgggacgtgatcgaccgcgcccagaggaccataggcgagcagagcgtatcgtcccgtgagcaggcggttcgctacgaccgaatcctgcgccggcagcgcgagatcctgtacggtgcgcggaacaggctgctggacggcgaggcggtgccggaggaacaggtgctctcggtcgttcgccagaacctgggccgcttcgtggaggggcaccccaggctcacgcaggccgagctcaaccgctacgtgctggacaacctgtcctacgagctggacgaaggcgaactctccatgctccgggacgccccggacgcccgtacgctgctgggcaggatggatgcctatgccaagaggctctacgccgccaaggtcgccacgttcgcctcgcccgaggacctgcaggactacacgcgcgcctgcatgctgaaggcgctcgacgagggctgggtcgaggaggtcgactacctgcagcagctccagtacgccatcgtctcccggggcaccgcgcagcgcaaccccatcttcgagtacagtcgtgaggcgtaccgctccttccaggacatgcaacggatgatgatggagagcatcgcccgcaacttcttcctggcggagttccagacggggcgggacggcaagcggaagattctgtttccgtaagaagggcgacgatggtctacaacttcaacctcgggatcgggtgggcgtcgagtggcgtcgagtacgcccaactgtaccgcgcccgcatgttccgcgcgctcggggaacctgcccggttcgtgttcaccgacatgttcccacaggagaacatagagcacttcacccgggcgatcggcttcgaggacgacgaggtggactggctctacacccacttcacggatttccgcgtctcgccggtcacctacaccctggcgcagttccaggacacgatcggcgaccaggacttcgtggtcacccgtgacgggaaggccggcaggctgcagtttgcggggcagggggactactgcacgctgtacttcacggacgagaggcacgacctcctccatcgcgtggagtacgtgtcgggtggcaggctgatccgcaaggactacttcacctacgggcgcatctactcggagtactacgcaccgctcgacggacgggcgcacctgtacctcaggcgcttcttcaacgaggacggctccgtggcctacgaggagatgccctctgccaacgggtcgacgttccgctttgccgaccaggtgctcttctccaaggaggacctggtgggccacttcgtgcgcagcctgaacctctccgcgagcgacaccgtgatcatcgaccgcacgaccggcatagggcaggcgatcctgcagaacgtgggcgatgcgagggtcggcgtcgtggtccacgcggaccactacagcgtgtccgggaccgacgacaggcacgtcctgtggaacaactactacgagtaccccttcgacatgtaccgccacatcgacttcttcgtgacctcgacacaggcgcaggcggacctcatggccgagcagtttcgtcgctacgtgggcgaggcaccttggatcgtcgtgattcccgtggggagccttgaccacctgaccaggccctccaagccgcgcaggccgttctcggtcgtcacggcgtcccgtctggcatcggagaagcacctggactgggtgatcgaggccatcgtgctggcgagggagcgggtcccgggcctgacgctggacatctgcggcgaggggtcagagctcggccgcctccaggcgctggtgcgggagcgcggcgcgggccagtacgtgcgccttctggggcagatggacatggctcaggtgtaccccaactacgagctgtacctgtccggctccacgagtgagggctttggcctgagcctgatggaggcggtgggcagcgggctcgccatgatcggcttcgacgtgccctacggcaacccgaccttcatcgacgacggggaaaacgggtacctggtcccggtccgggaggccatgactgagggggagcgggtgcgggcgctggctgactgcgtggtgcgctacttcctgcacgacgaccacgccgcgttcgagcgccggtcataccagattgcggaagactaccttacggagcgtgtggctgagcgatggaacggcgtgattgggacaaggtgagcggggagggcgtcctcctgcttgaccactacgacgagatggcggggatgctcgccgactccttttggcgggcgggcttctcggggcccacgatcgtgctctccgaggacgcctgcctgccggagggcatgacctccctgtaccggcttgccgcggacgactccgtgaggagcgcgttcccgggcgccgtgcgcgaggcgggggagagggacgcggcccaggagcggggctaccgccttgcccatgcgggctggacgcccgggacgggccgccacttcaaccagatcgagctccccgactactgggagatcaccgccgacggggtctcgggcaaggtcttcgaccgcaaccacctgcggggcaggatcttctacgcgcgcacggaggcgagccgcatcgtcagcgacgtggactggctggacgagacgggcacggtgcgcttcacggaccactacgacctccagggccagctctatgccaggaccacgttcaacgagcgcggggagcggttctgctgctcctggtttgacgaccggggccgcgagcgcattgtggagaactacgtgatcggcgacctgatcgtctcgcgcaacggggtcacccgccgctaccgcaacaggacggagctcgccgtggccgttatgcgggagcttgggctggagggccagcggatcttctacaactcgctctcgtacccgctcttcgtgagccagcgccttgccatgcatcccgccggcaacgtgctgttctggcaggagggtccccgcagcgacatccacgggaacatgcagatgatcctgcgcgggaactcacataccaggcagatcctggtgcaggacgggaagagctgccaggcgctcctctcgctgggggcgtcggccgactacgtccgcccctttggctttgcgtatggcttcgagcgggccaatgcagccggcgatgacgtcctgatctgcaccaactccgaccagatcgaggcgctcggccagatcgtgagggcactgcccaacatgcgcttccacatcgccgctgtcacggagatgtccggcaagctgatggcctttgggtcaaagcccaacgtgcgcctctatcccgtggcctccaaggccatccttgcccggctgctccaggagtgcgactggtatctcgacatcaaccgcgggagcgagatcgtctcgtccgtcaagcgggcgttcctcaacaaccagctgatcctgggcttctccaatacgctgcaccgcccgcgctacgtgagtccggagcacgtgttcgacgacgcagacggcctgattgccctgctgcgggggctgcactcctctcgggacgagctgcagaggcacctggggctgcagcgggcggcggcgatgaccgagggcccggaggcataccgtcggctgctcggggagcgctgaccctctcgccttctctcgcgtaggcaatgccaggggagaggggccaggcaattctgcttgccggctcctcccgccgggttcctgctttcagcgtgccgaaagggttgaaagggttgcccgatggcgctagcgagcgggttgcaaatccgtcggcttgggaatagtacaagattgacccctgacgccccctccgtaaactgacccaggacaagagcgttggtcgggttctgaaacgcatgcgtgctcagttgcgaagggattgccatggcatcgaagattgtctctgaggagcgttccccgcagacgctctttgacattctcaacaccattccgatgccggtgctcgcgtatacgttgaagggcggcgggcgagcgttggtcttcgcgaaccagaggtgcctggatatgttcgggaaggcatcgacggcagacctcatcgactcttgcgacgggaacttctggaacttcctcagcccggatgacatggagctcgttaagggcaacgagcagcgagtgctggatacccccggcacgtcagtcacatacgaatgccatatcagccagggagacgatcgctggcagcttattcgcgtccgatccgtcgcatggaggaccacagacggagaccccatagtcgtcgaccttacggtcggtcggggccttctgggagacctcgatcgggtcgaaacgcttgaccccatcaccgggctgatgcccatgaactccttctttcaggtcatgcagagatggaggaggaagttcaacccggatcgggacgagtcggagcttgcggtcctctacatagacgtggtgaacttccgctccatcaacatgcgcaagggaatatcggcaggggacgcgtttctcaagtccgtgggggaccagcttagggcgatgtttccggtcaatgcgatatcgcggtttgacgtcgaccactttgccgtcctgatccattcggccaacatgagggccaaggttgtctcggtccgagagttgtttcaggagattgcgccgaagggtgttggcatcaggatgggtgcaagcatctggagcgatcacgaatcgagcccggagacgatttgcaaccgcgcgaaggctgcctgcgacgactgcaggaagcatccgggaaccagcttctccgtctatgacgaggagatggggaggcgtctggagaatacggtgtacgtcatctccaacatcgacgaggcaatccgcaacggctggattcgcgtctactaccagccgatcattcgttcgagcacgggcaacctctgtggcatggaagccctcgctcgatgggacgaccccacaagggggctcctctcgcctgcggtcttcgtgggccccctcgaggagtcgcgccagatctggaagctcgacctctgcgtcatcaagcaggtcgtcgagcgcacctcggagcgaagccgaaggggcatgaccgagatacccatctccgttaacctgtctcgggtcgacttcctgtgccgtgacatctttggcgaggtcgagtcgctcgtgaggaagtacgacatcccccggcacatccttcacatcgaggtaaaggagagcgccatcgcctcccaggagaaggcgatcgtcgacgcgctcaatcgcttccgcgaggctggctacgaggtctggatggacgacttcggaagcggctacagctcgctgaaccttctcaaggactacgacttcgacgtcctcaagctcgacatggagttcctgcgcaaggatacggagcgctcccgcaagatcatctcctcggtaatcgccatggacaaggccattgggatcaggacgctggcagagggtgtcgagactgaggagcaggcaaactttctcaggatggcgggctgcgcaaagatgcaggggtacctgtttgggaagcccctcccgtttgacgacgcgctgaacgactgtctgaggagcggcagctcgatcgaggacgcaaggcagaagatgctgctcgacgaagctgcctacgtcaactttctcacggaatccccgctcgtgatgtatgactactacgacgggaaattccacatcctgcagtacaacagggcggctgtggacatgttcccccagtatggggcgagcggacccaaggacttcgaggacgccgtgaacgattggaactcgctgtccggcaacgacctggacagggcggcggtgtttgcgaagaagtccgggaaggtgggggagcagtcaatcacgttctttggaagggagatgctcttccgcttccgctgcgtcagccaggtggacgggcactgcgtcatcgtcgcgagcttctccgacatgtccgagcagatgaaggggctggtggagctgagggcggctgcggtcagcgtctttgcctattatcaaagtatcttctacatcaacctcttggacggcatggtccaggacgtcgtgttcgccaacttctcaactgaccccgagaagcagtcggtgcccctttgggacgagaagggcgagtgcgcaagcctgatacccagggtctttgattccgacaagagcaggtatgcggcatttctcaatctcgataccatgaggaagcgcctggagcaggccgatgacatggtcctgcgcgatgccttccgcacccttgattccgacggtcggtatcggtggatggagcatgtgctcacctttgtccaggactcaagcagaacgagggccatgtatggcatccgcatcctggatatgcaggggttggaaaacaccatctgcaccattcaggagaactcgcagtcgttgcttccggggcgtaaccagtccgtgagcgattcactgtgggactcgcttgtgcagaacgttcccctcaaggtgttctggaaggatgacaagcgcagattcctgggggcaagcaacgcgtttctcgactactacggatttgcctcgcccggcgagatcatcggcaagacggacgaggacatgggatggcacccaaacgaggagcactatcgggatgctgagcttggcgtcctgagctccggtgaggtgagccgttccgtctcgggatgctgcattgccaggggcaccacccgcaacatccatgcaaccaagtggccaatctaccgcaatggggcgattgtcggcctgattgggtgcttctcagaggacccggagtttggggacggccaggagggggtctcctcgggcaaacgtgacgacatcaaagagttcgtccaggacttcatggagtacgaggcggactatcggctgaacggaaggaagttcggcgcaatttacgtcaagattctcgaagccccgagggtccttgagcggattggtcgtgatgcggtgcgcgagcttgactctgcctgtacggcagcaatcgcgaatgcagtagggtgcgaggccaccttcgccaaccttgagggagggcgttttggaatcctcgccaagtatcgtcttccgggcgagctgcaggacatcgccagtcgggtgcgagcgagcatcgaggcaatccacaaggttgggaacctcgacgtcacgctgtttgcggacgtcagggtctcgctcatcgacgagttgatcagctttcacgatagggtgaccagctctctcttcaaaggtgaccttggggaggaatccgagggaaagaaggccccccaaaccaatatgaccgtcgcctgggagggcctcaagggactgatggactccgttcccattgggtgctacgtgctgctgcccgaccaaacggtcgaatactggaaccatgaggcggagcggctccttggctatgcctcggacgaaatcgtgggcaagaggtgcatcgactcgaagcttggctgctccaatgccaacggagtgaggattgcgacggaccattgccctgcgattctcgccttggcaacgggaaagccgcagaccacccagatgtttatgagggcaaaggacggaagcgacgttctgattcgaaacacgctctccccgctgagggacgagacggggaagattcagaggatagtctcgctctttgtccctctcgcggacggcgacttcgaacatgacctcgtgaagcagatatacgaggctgcgacgagggattccacgacctgtctgcccggcagaaagtacatggagtcctgcatcgacgatgccctggaactctaccgtcgcacgggccgtcagtttgcggttctcttcgcggacgtcgacaacctgcattacctcaacaacacctacggtcacgggacaggagacaaggtcctgagggctttctccctcgccctccgcaagtttgggaggaagaccgatgacttctgccgctggggtggtgacgagttcgtgggcatccttcgcctgaggagcgccgaggacgtcagtggcgcatcccgtcgatttgcaaagatcgcggagaagggccgcatcaccgagggtggtcaaacgattgattgccaggtgtccatgggcatgactgtggtcagggacgatgatgaccgcaagtccatcgtcgatcgcgcagatcggtacatgtacgaggcgaagaggaaccacccaaataggattgtgacggattttgatgcaggggcctttggtagcgaagagtaagttgtattacaaattgtgggcgtagcggtcatcctccttgggaagatgggaagggacgcatggtacgtccatgaggttgccgctgttgcatgctaaccgcagcgtgggcttcttcatggaggtgtgaacgataccgcatgcaaaaagcgtgcgggggggggtcttcggtccgatgggggcattgagacaattcagggcgagactggggaaaggcatctccgacgaggagtgggagcagatacggccgaaggtctccaaggagaaccgtcggaacatcatcgtggtcaccatcgcgttctccctcatgctagccgtcatgctactggcatccctcttcagcgcgatgatgcggcatgccagggtcctgtactccctcatgctggtgttctgccttctcctatgcgtgattgcggttcacgtgaaacccagcgacgagaggaagatctcagctctcacctacgtgacgatcagctccctcctcgtctactcgacggtggtgggaacgttgttcaactcggacctggtggcaaccgccttccctgccttcgtgcttgcctcgcccctgctcttcactgataggcgcaggaggatcgtcctctgcatcctcatcaacactgccttcttcatctgcatggcgctgacgttcgataacccggcgttcgtcgtggacaacatcgtgaactcctgtctcttctccgccgtcagcatcggcatcaactcctacacgctcaaaatgaagctccagcaggagtacgctcagctcaagcttgccgaactcagcgagaaggacctgcttacgggggtcagaaaccgcaactcctacgagcaggcgctcgcgacgtacccctacgagtgcaagcggagtctgggctgcgtctttgcggacctcaacgggctacacgagctcaacgaggtcacggggcacgcctcgggggatgccatgctcaagtgcaccagccttgccctcaaggaggtgtttggaggaaaggacacgttccgcattggtggcgacgagttcgtcgtgttcgttcgtgacgccgacgaggaccagatcctcaagcaggtcgaggcagcgaggcgtatcaccgagaagaggtcctgccacgtctcgtttggggttgccggggcgcaggcgcccggcatcgacgtcatcgacctggtcaagcgtgcggagcggcagatgtacggagacaagcgccgctactacgatcaaccgggcgtcgagcgacgtggcatgagggactgactgcgggcgtaggtgcctggcttgtggctgcctgacttgtggcgtgcgccctttgcctggccagtgggcccatgctgtcagcggcctccccgggttgtgccgaccctcggcctggtcaatgggactgggctgccggggcgttccccgtcctgccggcgggatcggttccggggacggcgttgtgcccttctcgccacgaccgtctcgcctccctcgacgtcgcgcggaggcggcgtcgtaaagaatgacgcgtttagggtggcgctaaacacgtcaattcttacggaactcgaagtctcgtaagattccacgcgtttaggcgggtcctaaacgcgtcagcctttacggtacgtctttcggggcggcatggcggtcgtctcgcccgcccggcgcataatgtgtgccgtcaatgacaccagtgggggagggcgtggcgcatgcaggactacgaggagaccgtcgccagggtgcgggcgttccgcgaccagagggactgggcgcagttccacacacccaaggacctcgccatctcgatcagcctcgaggcggcggaactgctggaggcgttccagtggtcgggccaggacgcctcggcggaggggcggacggaccaggtggccgaggagctcgcggacgtcctcatctactgcctctacatggcggacgcttgcggccttgaccccctccagatcgtgaaccgcaagctcgaagccaacgccaagaagtatcctgtaagtctgagccgcagaaactcgagaaagtacaccgaactctagcgtcggcggtaccaccggctgggccagccgaccgtgggggcggggcgtaccttgccgtcgcgccgccggttcgggcggccatcggcccgaggccacggccacgcagccggcccggggggcaccgccacccggcggatgcgctcgcggcaacgtcacggcacgtctcaccagggagggcaatggcgccaaggcagcccatagtcatcgacgtcccctttcgcgaggacgaccgagaggtcgagcagagcatcgacaacgccgaccgcgaggtcgatggccgcaaggtctcgcgggaggaccgggccctcctgaagacctacccaacggtctatatcatccacggcaagcggcacgagcgcacgcgcagcgggttcgaacgcgacaggttcctggtgtacgtgggcgagacaaactccatcgtgcgccggaccaaggagcactactcggacgaggccacgtaccgctccgagcgcggcaggaaggcgtggcgccagctgaaccagtcggacgcccgcatgctggtcattggccaggaccacttcaacaagtcgctcacgctcgacctcgagaacaccttcctgagctacctcctcgcgtccgacgtggaggacgtgaccctggtcaacgggcgcggcaatccccaggacgactactacaccaagcgcgagctccccgccatcacatcggcagcgtggcgcaagctcaaccgatacgagccccgactcttccccgcggagtcgatcatccgggactccgccatcttcaaggcctcgccgttccatgccctcgggagggaccagctcaatgcggaggacgcgattctcgcccgcctgcgccaggcgctgccaagcgggggagaggtgccggcggacccggacgcgcccgtctccaccggcgagctcatcgtggtcgagggtatggcggggaccggcaagaccgtgcttttgagccacctgttcctccgcgtcatgaacgagctggggtcaggggagaggcccgttgacgcgtgcctgctggtcaaccacaaggaacagctcaccgtctacaacgccatcatgcgccggcttgcgctgcaggggtccgacggcaaggtcgtccttgccccgacgcagttcatcaaccagcgcagcgagctggggcacggcaagggcctggacaggcaggaccaccccacgcgccccgcggacgtcgtgcttgtggacgaggcccacctcctcctcaacgagggcaaccaggggtatcgcggatccaggaacatgctcgtggacatcatgcggcgcgcgcgggtcgtcgtggcggtgtacgacctgggccaggtgctgaggaagtcgcaggagcttgccccggcgatgcgcgacgccctgttcccgcaggggcgcttcgcgggcaggcgcaccgactgccctaggaggcaggccgagctcgaccacttcccgtttcacgtctccaacctgctccttcggcagcagtatcgcatcgacgcctgcgatgaggtcgtcgcgtggatcgacgacttcgccagcggcaggggcgtgggcccaatcccccgcgacatcccacgggacgggcacgagccctaccagatcagggtcttcgactccccgtttgcgctgaggtccgcgatcgaggaccgcgccctgaccttcgacgacaggtcgggcgagatggtcgacgacacgtcccacgggctctcccgcgtgcttgccacgtacgactggccgtactcgagcaagtcgcaccccgcctcgggaggggcgtgggaggtccgcatcgtccgggaggagggccactgggtctcgctcgggcaggatgtccgccggtcagacggccaatccgaagtccgcgagacggacgccccggagtgcttccacatgccgtggaactaccagaccacccagatgcccgaggaggcgaggcgggacaagggcaaggcgtgggcggagcagagccacaccctgggtgagtgcggctccatctacaccatccaggggttcgacctcaactacgccggcgtcatcatcggcccgtccgtctgctggcgcgacgggcacctggtgttcgaccccgccaagagctgcaacagccaggcaatcaacggaagcgagaggcccgaggacaacctcaggcacgagctcaacgtcctgctcaagcgcggcgtgcacggcctgtacctctttgcggtcgacgaggggctggaacgccatctgctcgacatgcagcgggcgggctccgagggataggcgctgtcccaagacagcgcgtcctgcagccgccggagtacgccgtcacccagccgttggtcccgccactcgctgattgtgggccatctcactcactaattatggttgctgtgacttaccgattgtgggaatgccgagggcctgatgccaccgatttagcttcctcgggagcagtctcaagggaagctgctgagaaaactcgagtcgtggcaatcgggaggggccaagtcgctgagaaagggcgagtgttggcagtcagaggtgctttgaggcccccgttctctgccattactcgcatttcctcagcagtcgagactttcagattgccacaactcgcatttcctcagcaggcatggtgcgcacgggcgatttcgccaaccacagtctccgcgacaagccccaggatgcccgggacgacccagcccagccccatggaggacaggggaaggaggtcgagcgggagcgcgagaccgggagcgaacgcgtcgcgcagcgcagagagcgtgctcacggcgccgacgcacgccatcgagacgcgccagggcagcacgtgccgctgcgacccgggcacgaggcccatcgccacggcgcagattcccatgggatagagggccatcagcactggcaccgagtaggagaggatggcggtgaggccgacgttggagagcccgcacgacacgactgcgatgagaacggcccaggtacggtacgggagccgggggaaggtcttggcaaagtactcgccgatggaggagaccaggcccacgcacacgttgaagcaggcgatgaggaagatggcggcggtaagcacggttcccgcggtgccaaagtgcatggaggcagcgagcgagatgacctccgctccgttctgtgcctgtggcatcacggtgcccatcctcgcgcccaggtagctgagggcgcagtacacaaccgccatgagcgtgcccgcgacgacgcccgaccgcgcgacctggcgggcaatcgcatcgggcctggtgactccgaggccacggatgctgctggtgatgaccacgccaaaggcgagcgatgcgagaaggtcgagcgtctggtagccctggaggaagcccgctaccgccggcgtcgcggcgtagcccgcctgcgccgttgggagcgggtccccggcgggcgccaccacctgcgccgcgaccatcagaacgaggagggcgattagcagtggccccgtcaccttgcccatgaggcggacgatccgagccgggtgaagggcgaaggcgagcgccgcggcgaagaaggcgagcgagaacagcagccgaaaggcgcccgcgtcccctcccgaggggagcagcggcctcaccatctcgaaggaggtcgaggcggttcgcgggatggcgagcaggggccctatcgccaggtaggtgagaatcgcgaacacgcgcgagaacctcgtcccgatgcggtcgaggagtgccccagcggttcccgcgcgggctatggccacgatggcggcgatgggcagacccaccccagagaccaggtaccccagcgtcgcaaccacggcgttgggccctgcctgcacgcccagcagcggtgcgatgatcaggttgcccgccccaaagaacatggagaagagggcgacccccacctcaagcgacccgcgcgtgtcgagggtctggcccgtctcgcccgcgccccgggcaattgcctcgcgccctcccatgtcctgagcagatgattccatcgtccctctcccaacaagtcgaaaccccgacggaagagtatgaccaattccgcctcgttgcgcgcccgcgcccgacggcgcgctcccttggctcccgtgctgtcattcgcccgggcccgcgggcgggcgtctccatcacagcttccgtcgcaacaagacgcggcaatacaccgcaacttgacgcaaatcaattgttcccttcgccgtagcgaatacagtgtccgcgacacagagcagaaggaggcagatgacatgcagaactggctgttgcacaacagaaaccgactgaccgcggtcacgggagccctgatcctggcgtcactcgtggcaaggctcggcacgggtggcggagagacggaaggacgtctcctgcttgtggcctcgcttgtggggggacttccaatactggtccaggcggtccaggccctgagggtgcgcgtggtcagcatagacctgctggtgacgatcgcaatcctgggcgcgtttgcgatcggggagtttgaggagtccgcggtcgtggccttcctcttcctgtttggcgcgctcctggagcagaggaccctggcaaagacgcgctcggcgatcaggggtctggtggacatggtgccggaggttgcccttcggaggaacgaggacggtggcttcgaggaggtgccggtcgacgaggtcgagcagggagacgcgctcctcgtcaggacggggggaagggtccccgttgacggagaggtgacctttgggggcggaagcgccaacgaggcgagcatcaccggggagccgctccccgtggcaaagggcgtcggcgacaaggtgtttgccgggacgatcctggagaacggcaccgtgcagctgagggcagagagggtcggggaggacacgacctttggcaagatcatcgagctggtggaggaggcgcaggactccaagtcgcaggcggagcgcttcatcgaccggttctccaggtactacacgcctgcggtgctggtgctaggtgccatcgtatggcttgtcacgcgggacgtctcgctcgccatcacgatactggtcctgggatgccccggggcgctggtcatcggtgtgcccgtgtcaaacgtgtcgggcataggcaacggcgcgcgccatggcatcctgttcaagggcagcgacgtgatgaccaagctcgggcgggtggacacgatcctgttcgacaagacggggacgctcacgtacggcgacccacgggtcgttcggtcgatcaactacgacggtgaccgcaagctggcagaggacctgctcgtgagcgtggagcgggagtcgagccacccgctcgccaaggccatcgtcggtgcctacccatccgcgaggacgtaccccgttgactccaccgaggtgatccagggcgagggcatcgccgcccgtctcgccaaacaccaggtgctcgtgggcaacgcgcatctcctccagaggttcgacgtctcgtttggcgaggcagcagggggagacatacgtgccctggaggaggcgggcaactccctcgtccttgtggcggtggatgggagacttgcgcttgcgattggcatccgtgaccaggtcagacggggcgtcggtgaggacctgagggcccttagggagatgggcgtcaagaacctggtcctcctctcgggggacaaccaggcgaccgtcgaccgcgtggcgggggagcttggcctgagcgaggcccacggcggcatgctccccgaggacaaggcggagttcgtcagggctcgcagggcgatgggcgagacggtggccttcgtgggggacggcgtcaacgacagcccctcgctggccctggcagacatcggcatcgcgatggggaatggcacagacgtggcaatcgagacctccaacgtcatagtcaccaactccgacttccaccgcatcccccatgccctggggctcgctcgggcaacccgccgcaacatggcggagaacatcgccatcgccctggccgtggtggccgcgctgatcctgagcctgttcgccagcagctggatgaacatggcggtcggcatgttcgtccacgaggggagcatcctcgtcgtgatcctcaacgccatgcgcctcctgaggtactgacgcgttcacctgcccagcgcatatgcgtgcccgccagcgggagaactaaatggcacgtttcttgacacaaatcaatttcttttcccgtgactgcccgtaccctgggtgcagcaagagggaaagagagaggagaccaagatgaccaagagaggaaccctgcagctcgagaccctggcatgccccacgtgcatgcagaagatcgagggtgcgattcgcaaggtgaaaggcgtgagcaaggagagcgtgaaggtgctcttcaacgccagcaaggcaaagttcgagttcgacgacgcggtaacgagcgtagaagaggtctcggactccgtccggtctattggatacgacgtcctcaaggcgtcagagaggtgagggagcacaggccatggtgaggaaattctttgaggagaacgacgaggcgttggacctctacacgaaggcgatcacgagggcacacggcaggaaccacccggaggtcttcgaggtgcgtgacatctaccagaggatccagggcaaggtcaggggaggggacctcgaccttgcggacgagttctcccggctgcgtgaggtcacgcacgactacgccatccccggtgacgtgtgcgggacgttcagggcgacctatgggctgctcggggagtttgataggcttgcaggcgaaggcaatccaaagacggagagcgaggtccgatcatagaggagcatctgtgcgtgtcgctcgtcccgctgttcagcgacctctccaccgacgagcagcgcaaggtcatggggctggcgcggcaccgtacgtacgagagggacgagctggtcttccagccgggggacgagaggctcgacatcgtggccagcggcagcatgaaggtgtaccagctgtccccaagcggtagggagcaactcctccgcgtggtcgggccgggagggtacgagggggagaagcagctctttggcctgagcaacgagacgctctttgggcaggcgctcgggcggacccaggtgtgcaccctgagcaagcgtgcgttcaaccaggtgctgctgagcaacccggacatctccctgaagctgttcgaactgaccgcgcagaagatggtccaggtcgagagccaggtgcgatacctttcgatggggcgggttgaggagcgccttgccgactacctcctgggcctccccacggtggcagagggccgggtaaccctccccatgaggatgaaggatgtcgcgcagtacctggggacgacgcccgagaccctctcgcgcaagctgaggtacctcgaggacgccggctacatagagcgctcggggagaagggtggccatcctcgacgagacggcgctgcggggcatgtagtcccgcggcgcccgctgccctcctgagacaaacccaaggtccgggagggacgcccctctcccttgcgctacaatggcacgcgacaaacgggagctggcgcacgccggctgagaatgggcccagcaacgcggtcctgaccgaacctgatccgggtaatgccggcgtagggaccagagcaccggatgttcggggcgcctacgtggagtgggcgccccttttggcgtccggaagggaagctgcatgaactgtagcgtggcaatccagtttctgcccatggactccaagtcggacgaggagacctgccgcgtggtggacgcggtgatcgcctacatcgcctccacgggcgtgagctacttcgtggggccgttcgagaccgccatcgagggcgactacgacacctgcatgcagatcgtcaagaactgccagctggtgggtgccaaggcgggctgcggctcgatgatgacctacgtcaagatcgactaccgccccggcggcgacgtcatgtccaccgagcacaaggtctccaagtaccacgagggtgaccccgagttcgctcccgcgggcaaggcggaggtcgcgtagcccatggcacaaggctccaggggagaggcccgtcccgcctcgcatggcaccggtcgcgcccggcgcgtggcgatcccgctcgtgaccacgctcgccatcctcgtggcatggcagctgctggtggtgtgcggcatcgtgcccaacttcatgctgcccactcccacgcaggtgatagcggcgctggtgggggacttcccgctgctggtctccaactccgccaccacgctcgccgagtccgcgctcggcctggtgatcggctgcgccgtgggctttgcgttcgcggtgctcatggaccggttcgagggctttcgcctggcgttctcgccgctcatcaccatctcgcagaccatccccaccatcgccgtggcgcccatactcatcctgtggctgggctacgacctggcacccaaggtggtcctcgtggtgctcaccacgttctttcccatcacggtgtcgctggtctcgggctttcagtcggtcgatcccgacatggtcgacctcatgcgcaccatgaacgccacgcgctggcagatcttctggcaggtcaagatgcctgccgccgccgagcagttcttcagcggcctgcgcatcagcgccacctacgccatcgttggcgccgtgatcagcgagtggctgggcggattcagcggcctgggcgtgtacatgacccgggtgcgcaagtccttctcgtacgaccgcatgtttgcggtgatcatcatcatctctgcactgtcgctggcgctcatggggctcgtcgatgctctccagcgcctctgcatgccctggaagagggcagaaggggagaagtaacatgaacagcatctctcgtcgccagttcctcgccgcgagcggcctcgccctggggtccgtcgccctcgcgggctgcggcgcctccgcgtccaagggcggctcgacgtccgactccggcgccagctccgccgccaagaccaagatcacgttctgtctggactacacgcccaacaccaaccacacgggcatctacgtggccaaggagaagggctactacgcggacgagggcatcgacatcgacatcgtgcagcccgccgaggacacggcggaggccatgatcggctccggccaggcgcagctgggcgtgtcgtaccaggactacatcgccaacgccctcgcgtccgacaacccgctgcccatccaggccatcgccgcgatcatccagcacaacacctcgggcatcatgagccgcaaggaggacggcatcaccagcgccaagcacatggaggaccatgtgtacgacacctggaacatgcccgtcgagcaggccaccatcaaggacgtggtcgaggccgacggcggcgactactccaaggtcaagatggtgtccgtctccaccgacgacgaggtgaccagcctcaagaacaagcagttcgactgcgtgtgggtgtacgagggctgggccgtccagaacgccatcgtccaggactttgcctacaactacttcagcttcatcagcatcgacgacaagctcgacttctacacgccggtgctcgccgccaacgacgacttctgcaagaagagccctgacgtggtgaaggccttcgtccgcgccaccaagaagggctacgagtacgccgtcaaggaccccgacggcgcggcgcagatcctgtgcgacgcggtccccgagctcgactccaagctcgtgcgccagagccagagctacctcaaggaccagtacatcgccgacgccaagagctggggcgtgattgacaaggaacgctgggccacctacttccagtggctcaacgacaacaagctcgtcaacaaccagctggacgtgaactccggctggaccatggactacctggaggcctagcgtgctgcgacgcaagcgcgacgtaccgggcgcagacggcgggggagaggggacgggcccctctcccgcggcccgtcccgccggcagggacgacccccttgcccccagcctggaggcgcgcgggctgacgcttgcctgggagggcggccacgacgtggtccgtgacgtcagcctccatgtggggagcggcgaggtcgtgtgcctcgtcggccgctccggctgcggcaagaccaccatcctgcacgcgctgagcggcctcacgcgccccgtgagcgggacggtgctcctgcacggccgcgacatcaccggtgcgcccggccacgtgagctacatgctgcagaaggacctgctcctccccagcaagcgcatcatcgacaacgtgtgcctgccgctggtggtgggcggcatgtcacgtgccgaggcgcgggccaaggccgagccgctgatggagcgctttggcctcgcgggcacggaggagcgctggccgggcgagctctcgggcggcatgcgccagcgcgccgcgttcatgcgcacgtacctcatgggcaacgacgtggtgctgctcgacgagcccttctccgccctggacgcgctcacgcgcaccgacatgcgcggctggtactgccgcatgtcctccgatctctcgctggcgaccctcgccatcacgcacgacgtggacgaggcgatgtccatggcgtcgcggatctatgtgctgcgcggcaacccctccggaggggtgcccagcaccatcgcccgcgaggtggtcgtggaccggcccgagggcacggcgacccccgaggagtttgccctcacgcccgccttcctggaggccaagcgcgaggtcctctccctcctggagggctagcccctctcgcccccatcccgcgtgcggccgcccgtcgtcccggcgggcggccgcatcgcgtctgacgcatccccgctgctgcgctatggtggagccaccacgaggacggaggctgccatgctcgaccaacgcgagggatacgttccctttgccggctaccacacctactaccgcatagcgggccattgcgagggaggcaagctgccgctgctggtgctgcacggcgggccgggcgcggcgcactactacctccagacgctggacggcatcgccgagcgctccggtcgcgccgtggtctactacgaccagatcagctgcggcaggtcaaagaccccgccccttccggacaggtggggatgccgactcttcctggacgagctcgactgcgttagaaggacgctcggcctgggtcgctgccacatcttggggcagagctggggcggcatgctcgcgatgatgtacgccatcggagagccgtggcacccgtacgggcacgacggcctggcgtcgatggtcgtggccagctcgcccgcgagcatggatctgtggctgcacgaggcggtgcgcctgcgccactacctcccgcccgagatggaccgcgccctcgcgcaggcggacgtcgacggcgactacgaccgtcccgaagtccgcgccgcgtccgcggagtactaccgcaggcacgtctcgctcgtgcccgaggacgagcgtccggacggcctgcacaaccccgagcccgaccccgtaggggacgagtgttaccacttcatgcaggggatgagcgagttcgtggtcacgggggcgctcaagggctggagcgtggtggaccagctcccgggcatcgacgtccccacgctggtgacgtccggcacggcggacgagtgcacgccgctcatcgccaagcaggtggcggacggcatcccgggcgcgcggtgggagctcttccaggacggcacgcactgggtgcatggggagcagccggagcgctacaacgcggcggtcgaggccttcttggaggcccacgagtagggtgccgcacccctctcgcctgtgcatggtgggaagacggggcgagcgacgctcgatcgccgaccgcgcccctctcgcccgccgtggccgatttccgggtggcgtgtgtccgggcgaccttaaaatgggcttggaaacgtaggggacggacggcgccgcgcgccgcccgcgggaggcagggggcctcgtgaacatccaggacttctactcgggccacgagttctttgcgcacacctacctgggggcgcatctggagggggagggggcgaccttccgcaccttcgccccggcggcggacggcatcgtggtgctgtggtggcccctcggcgacgatggcgaggcgccctgcgacgagccccgcacggtcgagatgcaccgggtggaggacggcaacttctacgaggcgtccgtccccggcgtgcgcgagggcgacctctaccagttccgcatctaccacggcggctcgtacgtggaccacgccgacccctacggctacggcacggagctgaggcccggccaccgctccgttgtccgcgacctcggcgggtacccctggggcgacgcccggtggatgggggagcggaccgcccgtgccaacgcgcctcttaacatctacgagctgcacctgggcagctggcgcaagcgcggcggctcggaggaggcgtccgacgacccggccgagtggtactcgtacgaggagatagccgaccccctggttgagtacctcaccacgatgggctttgactgcgtggagtttctccccctggccgagcacccgctggacgcgagctggggctaccagcccacgggattcttctcgcccaccagccgctacggaacggcccgccagctcatggggctcgtggaccggctgcacgcggcgggcatcgccgcgatcctggactttgtccccgtccactttgcggtcgactcgtttggcctggcaaactacgacggcacggccctgtatgagtaccctaacgacgccgtgggcgtgagcgagtggggcagccacaacttcatgcacagcaggggagaggtgcgctcgttcctgcagtcgtccgccaactactggctgggtgcctaccactttgacggcctgcgcatggacgccatcagtcgcatcatctactggcagggcgacgaggcgcgcggggtcaacggtaacgcggtcgacttcctgcgtgtcatgaactcgggcgtgcacgcgctggacccgggctgcatgctgatcgcggaggactccaccaactacgacggcgtcacgcggcccgtggagcagggcggcctgggctttgactacaagtgggatatgggctggatgcacgacacgctggagttcttccagaccggcccggagtggcggcaccagaactaccacaagctgtcgttctcgatgatgtactactacaacgagcgctacctgctgccgctcagccacgacgaggtcgtgcacggcaaggcgaccgtggcgcagaagatgtggggcgattacgacctcaagttcccccaggcacggtccctgtacctgtacatggcagcgcatcccggcaagaagctcaacttcatggggtccgaggtggcgcagctgcgcgagtgggacgagaggcgccagcaggactggttcctcaccacctatcccgtgcacgacgcgttccgccgctactgccacgacctcaaccagctgtacctggcgcacccgtcgctctgggagggcgactacgaccgcgacggcttccgctggctgcaggtggacgacccggagcacgtggtctacgcaatcgagcgctccacggttggcaggacggacgacgaaggcgagagggagcgcatcgcgttcgtgttcaacctctccgaccgggcgcacgagggctatgagcttccggtgccggatgccgcgtcggcggaggtgctgatcgacacggaatgggactgctatggcgggaccatcgccaggggagacgagcgtgcgaccctggaggacgggaccctcaccgccgacctgtcgccgttctgcgggatggcgctgctcctctcgcccgaggaggggtgagcgggcagctaggcgtcgcgtgtctcctggtcatgaagcagcgaacgcatgagggagaggagctgctccgccgacctcacctcgtgctccgccggctgctcgccccgcggcatctctcggttgcggtggttgaaccagaccacgggcatgcctgccgcgtgggctcccgcgacgtccaccctgaaggcgtcccccacatagagggagcgtgacggctcgacccccatgtggcggcaggctcgcaggaagatcgcggcatcgggcttcgccacgcccatggcgtcggacacaaacacgtcctcgggtcgcacccaacggtagacgcccagtatgcgcagcttgtcccgctggcggtcgtccctgccgttggacacaacgcccaggcgcgcgtgcctgtggcacaggtccaacacctgcgccatggtgggggagagggacatggcctccccgctgtcgtgcgagtacgcccgctgcagcgcgatcgccgtctgccggtcgacgctgaccccaaagtccgccatggtctgctgcatgcggcgcacgtactcgccctgggtggggagcctgcccgccgagagggcggcgaacacctggccgctgtgccttcggctggcgtcaaagagctcgtcgtcactggcggggatggagcccaacaccgaccgcacggcgtgcgcgaagggctgcgcctggtcgtagagcgtgtcgtctatgtcgaagaggatggcgtccatgggatcgactatacgccagcgacggcgcgggcgaaagttgcggcaatgagattgaaagcatcgaatatgcgtttaggatgcaaatggatgggtactatacacagtgaaccgaaaccaaaggggttccgacggacgcaggagattcgggggcgattccaatgggcacagaccagatacatcccgtcctgccagtggttgccaacccaaggctcgcccgttagaaggctttcgtagcagccagcaaggcgaagctcaattcgcgacaagggcgcaatcaacctggccaaccgcggggcaggggtagtgtaggctcgaggttgcgagggagcgattccacccaacagacaggcacgggggccgggagagtgattcccggtccccatttttgtgtctgggacgggcgtcgatggaatgcctgctgaggaaagtcgacctatggcaatccgggtgccagaacagctgaggaaagtcgacctttggcagtaatagagggtggaaaggctgccgcggcacgcaatctcctggcagttggaccctcggggcggcccatgaattgccacaactccattttcttgagcatccatcccaggctcatccagtggcaccggtgattttattgagttcctgccgtaactgaccgaacggggaattggcatggatgcatcgaacaccccgaacggacgattactatcactaacgtaatgacctagaatacaggctaaagaacagctccgtttttagccctatcttcaaggaggcaggctatgacagccactcccaccatcggaatgtccgacgcaaaaaccaactttagccgcctgacagccgacgccaaccgcaccggccgctcggtggtggtgttcaagaacaacaagccctgggtagagatacgcccgttggcgcaccaggagaacgaagtgcctgacgagactcgcgaggcaatggaagaggcaaacgctctggcggcaaattccgaccacgcgacctaccaaaccgcagagagcctgttctcggcgctcgacctgtaaggatcgtcaatgtacacggcgtctttcaccccgcgcttcttgcgcgacgtaaaggcatgcaagaagcgccattgggacgaacgagccctcaagaaagcaatttccgacttgctcgtgagcgacgaacgcgagctggggcaacgctatcgtgaccacgcgctgactggcgcctatgaaggatacaggtccatccacgttgactccgcgcccaatccgccgaaggatacgtgggtgctgatgtaccgggtctcgaacgctgaactcacgctcgtgcgcacaggcactcatgatgaggtgtacgggaaataggcttgaagatcagggttccgcgtctttcctggaacggagacttatgccagagccatcagatttgggacaaggcaaagcgggggctacaagcctggggtactgagcagggggacgcccgctccagctcctctctctgccccgtgatgagaaagctcgtctcataaggttgggctcgttgggtgcttagcgctactggcaatcgtgctgttgtggcgcgaactgcttagaaactctagcccccgtgcggattccggcgcgttacgcttaaaaaccctagccctcatgtggattttcccgccaaatgcttagtgctactagccctcaggcgagtttgcttcccagaaaacagcacgagggctagggctgctaagcacccagactgctaatccacacgagagctaggtttgctaagcagtgacaacccgccctccgtcggaaaccggtgcggcagagctcctgtctctattttccccttgggaacagcaaccgcctcgcgcctggggtgcgcatgcaacccctaatggacctcatagggggagtcctcgctcacgtcgaaggagagcagcgcctcgcaggaggttcggatcatgtcctccacgtcctcctcggtgtagaacgccatgtgcggcgagacgatcacgttggggaacgagtccaggatcgcacggtcgtggttggggagcacgtcacggctcttgtcgtggtagtagaggttggcctcgttctcgatggtgtcgagcgccgccgctcccaggtgcccgttctccaggctctggatgagcgccgcggtgtccacgagcgagccgcgcgccgcgttgaccagcaccgcgccctggggcatcttggcaaacgcgtccgcgtcgatcatgtggtagttctccgccatgcccggcgcgtggagggtgatggcgtcgcactgggagaggagcgtgtccaggtcgacgtaggtggcgatgcgcgcgacgtcctggttggggtaggggtcgaaggcgaggagcttgcagccaaacccggcgaggtgcctggcgacggtcgcgccaatgcggcccgtgccgacaatccccaccgtcgcggacgagatgtccatgccgatcttcccgcgcaggccgaagctctgggagtcgttgccgcgcatgatcagcttgaccttgcgcattgccatcatcatgagcatgatcgagtagttggccacgccctcgggcgggtacacggcgtgcgccacgcgcatgcccaggtccctcgcggcggcgacgtctatgtggtcgtagccgatcgtgcgggttgccacgttgcgcacgcccacctcgtggaacgcctttaggaggtccgctcccatggggctcgtgatgatgtcgatggcgtcgtaaccccgggcaagcccaacgttcttggcggtggggtattcgggcgtccatccaaactcgaagcccctctcgcttgccatcttctggagatatcccagctcgtcgtactccctgagcgcgtaggcgaacagccgcattgcatagcctccttggtacgttccaatagccagcccatcgtatcccacgggggtttccaactgttgtcccgtcgacgggcgttactacggcttgggggagaggggagtgcccctgcaagttgaggaggaactgtgaacttactattaggaaagattcccgttagaagagtccacctcatggggtatagttccactaacaagaaagagtcctaacaaggacaaccaaacaagaaaggaaccaccatggaatccaagctcaaccagctcctcgccaacgtcaccgtcgagtaccacaagctccagaaccagcactggtacgtgagcggcagtgacttcttccaggcccacgcccagctcgaggagctctacgactccctgctccccgtgatcgacgacgtggcggagctcatcctccagctgggaggcagccccatcgcctccctgcgcgaggtgctcgacctggcgaccatctccgagcgcgaggacgcgccgctcaagagcgtcgacgccttccgcaacgtccgcgaggacctctccgcaatcctcgagcaggtgatcgcaatcaaggcgcaggcggacgaggagtccaactacctcgtgagcgccaaggcggacgagtacatcgccagcctgtcaaagacgctctggatgctccgccagcaggcggcgtagggcagccggaccgccaaagacgtcatatcccggcacagcataaggggaggggcccgcacgcaatcgccgcgagcccctccccgtctatgcgtcacgcatgtgagaggtgcgttttttcggctcttcgacgtttctagtgggtagcgcatgcgacggtcgtctgcgccgagaagtccaggcggccgagcctgaggaagatcatggtctcgaagtaggacgtgtttctgaagcccctcgcggccccttgattgttggatgacggagttgaggccctccatgatcgcgttggcgttcccgagaaccagttgaggatgccctcgcgctccttgcgcacggtcttggccacgaccttcatctcgtcacgttggagtgcatcatccaggggtgagcctgtcgagctcggaggcggcggaggccctgtcggggcaggcgtagacggcccgtgcgctcggtcatggcgcacgcccgggcacagagcaggtgctcggacgcgagggactccttcctgcacgctgccctccgtgagcctcccggcctcttcagccagacgtacttggtccgcccgggcaggcgccgcttctcctcgcaggacttcgcctcgcggcagcggaccttgtcggtgccttgcagaagagctgcatcacgtggaagcggtccacggtctgggcggcgttgggcatcgcctccgccgcgccgagcgcgtaggcctcggacatgtccgcggtgacctcgcggatggccatgcggtcgcccccgtgctcctcgagctgcgccgcgagcctcgcgggcgcccccttgtcgcggccctcgcagacggccacgaccctggcgccgtcggtccaccatcgtggatatgtagctctggccgcgcctgcaggccgtgtcgtcgatgccggccctcgtgacgccggagtagtcggcggcccctcctggcctcgcgggccgcgcggcccagcatcgcccacacccttctgtcgctctcgcggacccgcttcgctatcctccgtgacggtcatccccgacatggccatcacgaggacctcgtgcctcgaagagcgccgtgaagtgggagttcggccgcacctcccagggcatcctgacggtatggacgccgtcctcggggcagtcggccctggggacggcgcagtggacgatcgtctcgtactgccagatgtccaggtggcgccaggtgcgctccctggcgtcgtaggtgccgcagcgcctgtggcagacggggcactcgacggcctcgcccctcgcgtgggcgaccctcacgtgcagctcgtccggggcgcccccgcgctcctcaaccagacgtcggtgacctcccacccctgccgcccccatcgagcggctcgaagagcctcgcgagcaagcatgccggccttctcgtccatgcgcgcctccagacggcagccttccatgggaagaatgctaccgccggggggcttcggctcaaagtcttgcgaggcgtgatacccacccaaaggttcgaagagccgttttttcttgctccctacgcgaccacgtagggctcgagtatctcagccgccctcctggttgcgtcagggttgttgatggtgatgggcttgccccccatgttgaagacgcgcgggacgttgaaccagaccgtggacgtggcggcctgtgcgcgcacgaggagcccaaagtccttggtctggaccaactcgacgctctcgaggtcgtgcagcgagatgaactcgttgtcagaggcgatgtggagctcctctcccacgccctcgagggagccgtccttgggcttcgcgttcttcttgatctggttcccaacgtagtagaagaccctcacaacgacctccccggccaattcatttatcaccctataatctagcattcctacgcattgttcgccgtccgtccgactgggttgtgcgaacagtcaatcgaacggcgagaatatcgctccaaacggcagtccagctcccgcattcggtgcctgtggcgtgacggttgggtgaagttcgaagcccgtattggcttcatgccaaccgctggcagcgacatgcgtggaattcggaatatttcgaacatacttcaaccatgaaaaatcacagttcgaaccaaggcggcgattgctcggtatgggggagaagcccctggccgctgacggcgcatgcccgtctccccggatgcgcgtggcggcggggtagaatcgaggcgacggtcggcccgccccgcgacggcgccggccgaggcctcccgcggcgtgcgccgcggctggtgccctggcgtctgaccgaggagcgaggatgaaccttcgacagctcgagtactttgtcgccattgcggaggagcaccagctcacggctgccgcccgccgcctccacatcacgcagccgcccctctcgtacgagctgcagcagctcgagcgcgagctggggaccaagctggtggagcgtggcccgcgcacagcggagctcaccgaggcgggcaagctgctctacgtccgcgcggggcagattcttgccctcacctccgccgccaagcgcgaggtggagacgttcgggagcggcgaggcgggaatcctctccgtgggcgtgatctcgtcctcgggcggcaagctgccgggccccgctctctgctcgctcgccgcggacttccccagcgttggcctgcagctgcacgagggcaacacgtaccaggtgctcgacatgctgagtcgtggcatcgtggacgtgggggtggtgcgcacgccgttcccccgggaggggctcgagtgccgcttcgccgccccggagcgcatggtcgccgtgatccctccctgcctcgcgtcccgggatgcctcacggctcgagtcgggccgacccatcgatctggcggagctcgcgggcctgccgctcgccatctaccggaggtttgagcaggtgctgcgggcgtgctttgaggaggcgggggtggagcccgcgttctcgtgcgtggcggatgacgcgcgaaccacctgtgtgtgggcgtcccgcggcatgggcgtggccctggtgccggagtcgttcgtggacaccatccgactcgaggagggtacggtcgtcctgccaatcgactgacagagcctggtcacgcgcatggcggtggtctggaagtcggggcgctacctgccgcccgtgggccgcaggttcgtcgagctgttcgagagggactgcggcaacgacgccgggggagaggggcaggaggacggcacccccgccccgcaggggccggggccccgctagaatacctgccatgggaggcgcttggccgccgcggggcggcccgtctccgcaaaccaaagccttggaggtactaatgctcggattcaacaacggatcccgcggcgcagatgccgcgctcgccccgaccctggtgcgcacgccgtccgcgcgcgccgtcgcgacggggattgccgtggtggcgggggtcgcgctcccgcaggcgttccaccttgccggtgccgccctgggcgtggggggtgccatcgggcagaccttccttcccatgttcctgccggtgttcatggtcggccttttggcgggtcccgtggccggtggcgtggcgggcgtcctcgcgccgctgacgagccttgccctcacgggcatgcccgcccccggcatcgccctgacgtacgtgaccgtcgagctcgccgtatgcggtgccgtctgcggcctcctggcccccaggcgtatgccgaccgtcgccaaggtccttgtcgcccaggcgtgcggctgggcgacggtcctcgccaccttcgtcgccttcgccctcgcctcgggcggcctggggatggcgaccctctcggcggtcggagccgtgatcgtgcgtggcgtgccagggctcgtgctgcagtggacggtcctgcccctcgtggtcgacctcgcctgccgctcccgcaggggcctcgatgagtagcgccgcggagcaggggggcggggagcccaggggagacgacctcgagcgagcccgcgagctcctcctcgccggcgggtgtacgctcgcggcggtgcgcggcgaccagtcgctgctgagccaggcgcgcggcgtgaggccgctcctctccctcatcggcgagggagggagcctggagggcttctccgtcgcggacaaggtcgttggcaaggcgcccgcgctcctgtacgcaacgctgcggcccaaggcggtctacgcccccgtgatgagcgaggacggcgtgcgcgtcctgcgcgggcatggcatccaggccagctacggcgagctcgtgccgcgcatcctcaatcgcgggcgagacgggcagtgccccatggacgccagcgtcaacgacgtggaggattcccgctccgccctcgaggccatctgggcgtgcgcgcgccgcatggctgccgcaaacgcggcgagggggtagcaccgcaaggcggtaggcccggggccctcctattacgcgttttcctgcgggcgaatcgtccatgtggcggtccgcccgtttttcatgtctcccgaacagggatgcttgacttggtaaaaagattggacacaattgaattgtgcgcaatataaaatgtccggcagatcggtaccgggcgaggggagaggagaccccatgtacgattacgacgttctgttcattggcgccggccatgcgagctggcacgctgcgctcatcttgctcaaggcgggcaagagggtcgccttcgtggaggagggcgtcgtcggcggtacctgcaccaactacggttgcaacgcaaagattctcctcgacaccccgtttgagctcatcgacgggctcgagaggtatcgcgggctgggcgtcgacgatgtccccgccgtggactggaccaagctcatggcgtataaaaagcaggtcatctccccgctcaaccaggtgatggagggcatgttcgccaagtcgggcatggaggtgctccatgggcacggcaggctcgttgacgcccacaccgtggacgtggatggcaagcgcgtgacctccgactacctcgttctgggcactggcgagcgtcccatgaggcaggacatcccgggcaaggaactcgtgcacgactccagggacttcctcgacgtcgagtcgttcccccgtcgcatcgccttcgttggaggcgggatcatctccatggagttcgcctccatcgctgccaagatgggctcgcaggtaaaggtcatccagaggggcgaccgggtgctcagaatgtatccggagcggtacgtggaccgcgtggttgccaagatggagggcgagggggtcgagttcctgttcaaccagagcgttgcgtcagtccagcgggatggagacgcgtatctcgtcaacctggtaggcggagactccttccagaccgactacgtgcttgaggcaacgggccgcacccccaacgtcgaggggctggggctggaggacgtgggagtcgagttctcctctcgcggcatcgcggtggacgaccacatgcggacgagcgtacccaacatctatgcgtcgggcgactgcgtctgcaagcggattcccaagctcactcccacggcgacctttgagtccaactacatcgccactcagatccttggcgtcaatcccaaccccattagctaccccgccatccccaacctagtgttcaccctgccacgcatctcccaggtcggagtcacgcttgctcaggcgcaggccgagcccgacaagtatcgcgtcgaggtcgtggagtacggcaaacgcctcctgttcgaggcgaagaacgaggcggacgcggagttctccttcgtgtttgacggggatggctaccttgttggcgcggcattctatgggcaggacgcaggcgtgtgggctgaccttgcgacgatggtcatcaaccgtcgcatgaccgccaccgacctggggagcatggtcttcaccttccccaccgagtcccaggggctcctgagcctcctcatccccctgcttccgcagaagtagtcattgcaaggttatgattacgcccccgagcacacctcgcgcccgggggcgctttcgtctgcatctcgtgagacgtttgccactatcggtgcatgccgtcggtgcggtagggtgttgcggttggggccccgtgccccgtaatcccaagcgacggaaggcccctcatgatcaggctcgctctcaccgacctcgacgacacgctcatcccctttggcgcggatggggcgagccccaaggccctctccgccatccaccgcatgctggacgcgggcctggagtttggcccggtcaccgggcggctcccctccgccatgggttggatgctcggcggcgacccgcgctgctgcgcgacgggggccttcgcaaacggccaggtgatccgcatagacggcgagacggtcaaggtcatctcgatggcgagcgacctgctccagcgcgtggcggacgtcctggacggcgccggcgttcccgcctggctcgccatctacgaccagaggggggaggagccggcccgcctcgtcacctcccgcccgcagagcgtgggggagaatccccccgacacctggggcaggagcgtctgcggcacggcggcgcgcgtggagccgggcgggcacgtgaaggcgaacgtgcagtgctcgtgcgaccgacgccagatggtggaggtgcgcgacctgctccgccgcgaggtgcccgagctctcgttcgtgctccccagcctcacggcccgcgtcatcgacgtgaacgtcgccggatgggacaagggcgacggcgtgcggctgatcgcccgcgagctgggcatccccatcgaccaggtggcggtgttcggcgactccgagaacgacctcgccatgatcgagtccgtccccaactcggtcgccgtcgccaacgcctccgaggcggtgcgcgacgcggctcgctggcacatcggcccggctgctgacgactcagtcgccgacgccctgctccagatcgtcgattccacagccaggggagaggatcccgccttcatgcgctgatggcggtcccgtcggcatcgcgcccctcgcaatcggagccgacaaccgtggccgctcctctcgcccggccatgcccttgcgccatgccatatgtcctcgggacacgttgcttggccccaggaccgtctccggtcatacgatgccgttcgaaggcacctcccttggacgagaattgacccaatcgcgcggcggatgcgacaattgccctgatgccacgtccctctcgccaagcccaggacctcgcgcttgtcccaaagcgcttcaactgcccgtgaaagcctttccactgtttcagcccgttccatggggctagggttgagaactaccatgaggtcagtcggcacccttttggtgcctcccttcgcattggccgcatgctccttgtccgaaatcacgcccgagggatgtgtgcccaagtgaacgaacggaccgtccagatagtgcacaggctttccaggtcttccgacgactgctcgctcgggagccttgcggaggagtttgacgtctccgagaggaccatccgcaacgacatcaagtccctcaaccggttcctctccgagacctccataggcgagatacgccttggcccgggtggggtcatcatccttccggacgactttcagcgcgccgaggggctcctgcccgtgcgcgacaacgtcacgtacaagatgtcgagcgacgagcgcaagtcgctgggtgcggcaatcctggtcggcgccacctcatacgtcacgctcgcggacatcgccgagcgcttctcggtgagccgtgcctccatcctcaacgacctcgacggcatgaagcagatcgtgcgggacgccggcctcgaggtggagtccaagcccagccgtggcctcagggtctctggtcccgaggggctcaggcgcaccttcctggtcaacttcctcgacgacaagacgcccatcgtggagcagtggctgcactttcccgagcactcgtccatccgcgacgacgcgatcgtggtgaagaagatcctcaacgagcagtgccacgccttcgggctcttcatgccggactccacgttccgcaaggcgaccaacgccctgtgcatcagcgtgatgaggagcaggcagggcaagcgcctggaggagggagagacgcgcggcgacgcccgcgacggccgcagcgctggcgactttgagaagaacgtcgtcgcctacgtgtcgcagtactgcggcgtggagctgggcgagggcgaggtggcgttcttctccaacctcctgaggtcgctccgctttcacggggaccagcagttcagcctcgacgacctccaggtgcagaagataacgaggatcttcatccgctgcatctcggaggagatcggtgtcgacctcaacggcgactacgacctgtttgagtacctctccaaccaccttgagtccatgttcaccaccgagccctcgcacttccccgagaacccggtgctgcaggaggtcgtggaggaccaacccatcgtcctcgccgccgtgcggaagaacctggacatcctggaggagtttgcagggcgcgagatcacgcccatcgagaccatgtacgtggccctccacatctgcgctgccctcgagcggaggaagaacaggggcgtccgccctcgcgtcgtcgtggtgtgcgacgggggagtggggacgtctcagctcctcgccgaggagctgcgcgggcgctttgacatcaggatcgttaaggtcatgccggtccacgacgtcccctacatcgacacgtacaggaccgacctggtcatatccaccgtgccgctcgagaactgccccgtggagtcggtggtcatcaggcttcccatgaacgaccgggagtaccggcggatccacgagaagctcgggagcatcgtctcgtcgtccgaccgcgtcctggacgacagccccgagaacttcaccgcccagggcctgctggagaggatcgagcccatcgtccggcgcaaggcgcctggcgacgaggagctcctcaaggagctgaggctcgaggtccgtcgctacttccgcgaggcccagcagcttgaggaccagatcatcgcgccctacctgcaccagctgctcccgcccagtcacgtgaggctcgacgtcgaagccggcgactggcgagacgccatacgcgagtcggcccgcccgctcctcgagatgggctatgtggaggagcgctacgtcgaggcgatggtggaggacgtcgagaagtacgggccctacatggcgctgtcccccggcgtcgccattccgcacagctcgcccgagaacgggacgataaagatgggcatgagcatggtccgccttgccaggcccgtcgactttgggagcgaggagaacgaccccatcgagttcgtgttcaccctgagcgccgtggaccgcaagacgcacctgcgtgccttcgcggacctcatcgacatggtgtcgaagccggggatccccttcctcaacgagctccgggcggcaaggacgcccgaggaggcatcgcggatcatagagacctgcgagtttcagctcatcagctagagaaagtttaaaaacacatatatatgaccgcatgtctcggcgtgcggtcattttatatcggtcaatggcatattccaccgacattcgcacgaatgggcgtgctacctgcttaaacaacttggaggaaaacgcttcaaacatagtgaaagaaactaaacagatcacatgtctgcacggttgtgtgaagcacctttcactagtgtgcagagtttgtggcccatagaatctacatcgacatgagggattgggccggtcaaggccccaggagcctcgggaggaggatagatgctaggaaaagagatcatcatgcgcgagctcgcagagatcgacctcgacgtcgacaactacgagcaggtgtttgacgtgatgggggcgcgcttcctcgagaaggggtacgtgaacgaccagtacctccccaccatcaagcagcgcgaggcggagtaccccacggcgcttcccgtggacccgtatcccatcgccatcccgcacaccatggcgaccgccatcatcaagcccttcatcgcaccggtgcgactgctgcacacggttccctggggggacatgtccgacccggacaacaagttcgacgtcaagctggtctgcatgcttggcttcaaggatccgggagagcacatcgagctgcttcagattctcatgcacaacttccagaagccggagtgggtcaacccgctgtttgccgcaaagaccgtcgacgagttctacgacgccttcgtgaagatggaatggacccacgactaggggtcagaaaggtgcggccggctgacggccgcaggggagcaaggaggacatcatgccagtgaaggtaatcgtcgcctgcggaagcggggtcgccacgtcccagaccgtggcatccaaggtcaaccgcatgctcgacaaggacaagatcgacgcccacgtcgaggcagtggacctcaagagcgtcgaccgctacctcaaggacgcggccgcctacatcaccatcgtgcgcgacaagaaggagtacgacctgcccgtgatcgacgggatcgcgttcctcacgggggttggccagaagcagcagtacgagaagctgctcaaggcgatcaaggagtacaagggctagccacaggcgctcgaccccggcactttgctgggatgcgaatggaagaggttctccgaaacaaggaaggtgagagtgtatggactttgctgcagcgagtcagtggatcaacggattcctcagctcggtgggagcggcagtcttcgtgcccatcatcatgatcatcatgggcctcatcgtgaggatgaagcccaaggacgccatctccgccggcatcctgctcggcgtcgcgttcaccggcatgtcgatgctcatcagctatatgggcaacatcatccagccggtgggcgaggcaatgctcaagaacctcggcatcgacctgccgatcctggacggcggctggaccaccatggcggcaatcgcctggtcgtggccctacgcgattctcatgttccccctcatgattatcgttaacatcatcatgctcgttgggaacaagaccgataccttcaacgccgacctctggaacgtctggggcaagattttcaccgcagtgggagtcgtcggcctcaccggcaacgtccttctcgccttcgtgatcgccgccatccagatcgtcttcgagctcaagaccgccgacctcttcaaggacgagatctacgagctcaccggcatccccggcgtcacctgcacgcacaagatggtcttcctaagcgcaatttactaccccatcgataaactcctccgcaagattcccgcgctcaaccacaaggctgacgccgaggccctgcacgacaagatcggcatcttcgccgagaaccacgtcctgggcttcatcctgggctgcctctttggcctgctcggcgggtatgaccccggcgctctcctcacgcttggcatccagtgcgcaatgtgcctgaccctcttcccggtcatctccaagtacttcatggaggccctctcgcccatctccgaggcagtctccgactacatgcacggcaagttcgagggccgcactctggtcgtcggcctggactggcccttcctcggcggctccaacgagatctggatcacgatcatcctcagcatcccccttaccgttctctacgcgttcatcctgcctgacaacaagatcctgcccttcgccggcatcgtgaacatcgcccttgttgtccccgcctacctggtaaccaagggcaacctgccccgcatgatcatcctgagtgtcatcggcatccccatcttcctgctcgtgggcaccgcgttcgctccgtttgtctcgcagctcgccctctccacgggcgccgtcgccaaggacgcgctgggtgcctccggcctcatctccaactcctccatcgacggcccctggttcacctacgccttctcgcagttcctcgactgcatgaacggcaacttcatccctcttggaatgctcatcgtctggctcgccggctacttcttcatgtaccacgacatgaagaaggtcgccgccgccaagaaggcggagtcggagttcaccgaggctgccgccgagtaggaggcaaccgcacgtccccaactaccgtcccatcccaacggcacacggtacgaacagctgaatggccggtgggcaccaacggagtccgccggccattctcagagaaaggacaagctacatgcttgaggatcttaagcttcaggtcatgaacgtcgccaagcaggcccagcgcgagggcatgtgcaagcacaagtcgggcaacttctccgcccgcgacgaggagacggggcttgtggtcatcacccccacgagcgtcgatcgcgaggacctggtcgtccccgacatggtggtcatggacctcgacgccaacgtggtcgagaaccagaccggcctgcgtcccacctccgagtcgctcatgcacctcaagatctaccagacccgtcccgacgtgaaggccatcgcccacacgcactcgcagttcgcgaccaccttcgccatcctcgagaagcccatccccgccgtggtgtacgagctggcgaacctcaactgctccaaggcgcgcatccccgtcgccccctacgggcgccccggtacccccgcgctcgccgactccgtggtcgaccccgtcaaggaggcggacgtcttcctgctccaggggcatggctccgttgcggtggacgagtccaacatcgacgaggcctacctcaaggtctgctacatcgaggagctcgccgagctgtactaccacgccctcaccgccaacggcggcaaggagcccaagtccttcccgcccgaggagctgcagagctgggagtaccccaaggagatcaagtttcccaacaagtagccattcggtttggtgagacgtccttccccagccgcccgtccacgcctcttgtgcggggcgggcggctttctgggaggcctcgccaaggtcgtgggaggtcgcgagcgtgagcaagaagaggcagcggaagggccgtaccccgggtcccggcaacgcgtcgaagaggagacagcaggagagcagggagttcaggctcccgcaggtgagcgagaccaagcatccccggcccgttacggtgggggagcgcctcgccaccatcgtcgagctcgtggcggtgtgcgtggtgtggttcgtcgtcgccttccgcttcttctcgagcaccgagccggtgggtgccttcgcgatcggggcggtgtacttcctgggggccttctccatgtacatggtccgcgccgccatcgagtcgaggcgccgctacggcaaggtcgacaggaagaggctcctgtactacaaccagatgatcaagggcgaccagaagtggtccctctacataggcctctcgttctttgcgctgtcgatgctgctccgctggctgttcccctctcccaacttcaacatggtcggcatcgacatcgcgacctccttctacctgggctacatctggaccgcaaagtacaagggcgaggagtcgctcccctttgagtacatggagacgaccttcctcctgctcaccgtgtttaccaactacattgtgtacttccttggatgagaggaacaagccatgaagaagatcatcaacgcgcccgaggactacgtcgacgagatgctgcaggggatctatgcctcgcatcccgatcaggtgaagtgcgcggcgggcgacctgcgctgctactgcaccgcccgcaagcacgacggcaaggtcgccatcatcaccggcggcggaacggggcacctcccgctgttccttgggtacgtgggcgacggcctgatcgacggctgcggcgtgggcggggtgttccagtctccctccgccgagcagatctacaacatcaccaaggaggtcgaggcgggcgccggcgtcctctacctctatggcaactacaccggggacatcatgaactttgacatggcctccgagatgctcgagatggacgacatcgagtgccgttccctcgttggggcggacgacgtgctctccaacaagaaccccgaggcgcgccgcggggtcgcggggatcttcttcatgtacaaggccgccggcgccaaggcagacgagggcggcaccctggacgaggtgtacgccgccgccaagaaggcaggggaaaacgtgcggacggtcggctttgccctcacgccctgcatcgtccccgaggtcggtcacgccaacttcgagctcaaggacgacgagatggcctttggcatgggcatccatggcgagccaggcgtgtggaacggccccatcaagacggcggacgagctggcggaggagtccgtgggcgagatcctgggcgacatgcccctggaggagggtgccgaggtcgcgcttctcatcaacggcttgggggcgacctctgtcgaggagctctacatcctcaacaactcggtccgcaagcagcttgacgcgaagggcgtgaaggtctggcgctcctggaccggcgagtacgcgacctccatggagatggctggcgcctcgatttcggtctgcagggtcgacgacgagctcaagggctacttcgagcaccccgtcaacaccccgttcatctgccagaagtagcgattgcgaggagcgtgagcatggataagatgacgattggcgacgtgccggacatgttcgactgcgtcgcccagatctttgccgagaagaaggacgagctctgccagatggacgccgccatgggtgacggggacctggggctcacgatgagcaagggctacggggcgctccccggcttcctgcgggacctccagggcgagggtgacatcggcaagatgctcttcaagggtgccatgaagatgcagaacaccgtcccctccacgatgggcacgctcatgtcctccggcgtgatgcaggccgggaaggccctcaagggcaaggtggagcttgagcctgccgacatggcgacgttcgtcacctcgttcgcggagggaatcaggaagcgcggcaagtgcgagctgggcgacaggaccatcctggactccgtcgatgctggtgccgaggctgcgcgcaaggcagttgccgatgatgcggacgccacgttctccgatgtcatggcggcggcggtcgatggcgccaggaggggcgtcgaggcgacgaaggacatggttcccaagttcggcaaggcggcggtccacgccgcaaaggcgaagggcgttgcggaccagggggcggtcgccggcttgtacctgctggaggggatcagcacctacttcgctggcagggactagacataaacgggggtcgttgccccaatatggggcacgacccccacatcagtgggaggcaaccatgctctacaacgatcccaagaacttccgcgacgacatgctcaggggctacgtcgccgcctaccccgactacgtgacgctcgtccccggcggcgtcgcccgcgcgaccaagatgcccgagggcaaggtcgcggtcatcaacggcggcggctccggccactacccggcgttctgcggcatcgtgggggacggcttcatggacgcgaccgtggtgggcaacgtgttcacgtccccctcgaccgaggacgtcctgggcgtggccagggccgtcgaccagggcacgggcatctacatcgtgggcggcaactacgccggcgacaagatgaacttcaacatggcgcgcgacaggctccgctccgagggcatcgactgccgctccttctacatcaccgacgacgtcgcgtccgccaggccgggggagcgcgagaagcgccgcggcaacgtgggcacgttcatggtgttcaaggcggccggcgcggcggcggcggcaggcctcggcctcgacgagctcgagcgcgtgacggcgaaggcgaacgaccgcaccaggaccatgtccgtcggcttccgcgggtgcaccctgcccggcgagggcgagcccctgttccacgtccccaagggcaggatggaggtcggacagggcatccacggcgagcccggcgtcggcgaggacgacgtgaggcccgcagccgaggtcgcggagctgctggtcgacagggtcctcgccgaggcaccggacgacgactccaggcgcatcgccgtgatcctggacggcctgggctccaccaagtacgaggagctcttcgtggtgtggggcaccgtgagggagctcctggaggagaggggctacacgctggtgagcccgctcgtgggggagtacgtgacctcgctcgacatggagggcatcgccctcgcggtcgagttcctggacgacgagctcgaggggtactggctcgcgccgtgcgacaccgcctcgttccggagggggcagggctccatggccaggggcgagcgcagggtgtacgcacgcgccgaggaggcggccgagagcttcgaggcgggctccgacgcctcgcgcaggctcgccgggcagatcgtcggcgccctcgaccgggtgcgcgacgccatagcggccgccgaggacgagctcgcgaggatcgacggcgtcgcgggcgacggcgaccatggtcgcggcatggcgaggggcaccgaggccgccgcctccgccgcgaggagggcgtacgacctgggggccgctgccggctccgtcctcgacgaggcgggcaaggcgtgggctgccaaggcgggcggcacctccggagtgctctggggggccgcgctcgaggcggcgggctccgtcgtcggggacggcgcggactcgtacgacgcaggcaccgccgcgagggcggccgacgccgcggcccgcaggatggaggagctcggaggcgcccaccgcggagacaagacgatgctcgacgcgctgatccccttctcggaggagctcgggaggcgggccgcggccggtgccggcttccgcgaggcctggtcctccgcggcctcggtggcgcgtgaggcggcggaggcgaccaaggacctcgtccccaaggtcgggcgcgcccgtcccgcggccgagcgcagcctcggcacgccggacgccggtgccgtctccatggcgttgtgcatgagggctgccctcccggaggaataggcccatgctgccgacccgtcgggccccatgccggcgggtcggcctctctcttcttggggaacgaccttctccccattgggatgtgccctatgattcctgggacatggttgatgcgctgcgaggggagatcacatgagcgacgatgcggcaaagcgtctgagcggacagctgtatgacgcgttcgcggacggggagtcgtttgcacggctcaacgagtgcagggacctctgttggcgctacaacaacacccttccgtctgcgatggatcagaagcgccggctgcttaggcagatcgtgggcgagatggacgagacggccgtggtcatgggcccgctgcaatgcgactatggctcaaacgtccacctgggccataggttcttcgccaactacaatacggtcatgctcgatgcggcgcccattgtgtttggcgataacgtcctggtgggccccaactgctgcttcactacgtcggggcatcccatcgatgcctccacccgccggcagaacctcgagtacgccctccccatcaccgtggggagtgacgtgtggtttggcgccggggtcatcgtgtgcccgggagtcacgattgggagtgacgtcgtgattggggccggaagcgtggtcacgcacgacatcccctcgcacgtggtcgcggtcggcgtcccgtgcaagccgatacggcagatcaccccggaggatcgccggtagcgtgacctcccgctttcatccccggtaactgccaggtcgaggaatagggggctgccgttctgatggcacgtggcagcgcgggagtgccgagatgtgcgggaccaagctcctgtcccccaaccccaaccccaaccccaaccccaaccccaacccgtgagccccttcgctggatttgtcaaagaggggaagagaaggtccgcgcgatgcgccatgggagccgtcgcccattccaggaccccacgggtgggctgggcaaaacatcaagattagaatcatggcagcgaaagcctcgcgtgagcacttttctggggaagttgctattggaagatagagtcgtttccgtgtttgagcaggtagatgagtcggcgccaattcaaggcctttcccgatggcagaaggcgccccgcgtgagcactcacgcgagcgagttgctgccaatccgtccgaatctggagccaagatggcaacggaagcctcgcgtgagcactcacgcgggcaaatttctgccaatgtacgaactttgatggatcgccaactgcggaagcgcagggccgatgccgaagggacacctccacaggtgctcacgcgagggactttctgccaaagtacgatgtttgatgcttgccctgccgtcgtgagccggtagggaaaggagtgggcgcagccatctggatgccatctgactgggtggatgcccagtgacgctccgtgtcacattgaaaccagtagcgacttccgccacagctccgcgcggttccccctctctgaaccccttccgagaggcttgcatttgaggatgagcccagggttccgttatgtcgtaagggcgagctcccttttgtgtcagagagaggtgtgtcctcgctccttcaccgcacgtctcggacgccccacgcctagtgcaccttcgtcggcggggtggagtacgtgatggtgattcttccgtcgccgacctccatcacggtgtagccgcagttcgcctgcttcacgctccagaagtcctcgagtgggattcccctgatcaggccgatgattgcgcagttgatgccgccgtgcgccgtcacgagcatggcatcgtagttgcgcgaggcacccacgatcacgtcgtcgatgaacgacttcgcccgcgcgtacacctggtcaaaggtctcgccgccgatgggtgcctggtacctctcgggatgatgctcgtagtcgttggcggggttggtgaggtagaaccacggcgtgtgccgatagctgcgcccctccagcaggccgtacgagtgctccagcagacgctcgtccttcactatggggacgctggggtcgtcgagcgcgatcttcgccgtctcgaccgcgcgcacgagcgggctggagtagcacacgtcaaagtcgatgcccgaaagctggtcgtgcagctcgtgcgcctgcctccgcccctcgtcgttgaggggaatgttgacctgcccctgcatcttcttgcgggcgttccagtaggtgaacccatgacgggcgagcacgacggtacagggcatcctgcctcccagcgcgatgtggtacgaatcagggacaattgtatctctcacctgcggaaaccttgggtctccaatgaatatggagagaatgtggatgccatgctgccacgagggcacttgttgtccggggtcccgcatagcctaggcgtcaaggcaggcgagaggcacgaggcaacttggaggcagccatgtacgagatgggaaggcagttcgtcctttgcaacgtcgcgggattctcccactgggacggccccgaggtgcatgacaagctgagggtgggggcacccctggagctcgtggcagagccggacaacccgtacgacccccatgcggtcgccgtgctgctcgatggcaccaagatcggctacgttccaagaacgtgcaactccgtgatagcccagctcctgttctacggccacgggaacgtcttctacgcgctggtcgcctccatcaatccggaggaggacctggagcattgcgtgaccatgagcattcgggtgaccgacgccaggcagcttgggtaagggagagaagctgcccgttctcctcggggcggcgtcccactggctttgcgggtgagcgaaggtgggcaacggaactgaggggcgaggcgcccgcaggcaaagcccgtcgagcgtcccacccctcgaaggtcagcaatggcacttggacggcagcgctcagtcgtgccggcggttgcggacgatacgtgcgatgcccgcggccacgacggtcaccaggccagccaggaagaacgcctcggccatgggcaccaggaagaagttctcgtgcagcattcccgccgagtccacgtactcaacggagctggccttcacgaagaggcagaacgcacccatcagcatgagcgcgcagccaacggtcacggtgaccatgttgctgtgggcgcgccttccctcgctgccgtcgcggatgagcttgcgggccaccttgctgtcggccgcctccgcggcgcctgtcgtctggctggcccccgccaagtccttgtcgtccatgttcgattcccccttgccgaggatgagtaggtcgagggacacgtggaaggtcgtcgcgatgcggatgagcgtctctatgtcggggaggttggtccccctctcccagttggagaccgcctgccgcgtgaccatgaggcgctgcgcaagctgctcctgggtcagcccctcgcgcttgcgcagctgccgcatctgatcgccaaactccatgtgctcctccttcgcccacaccatcccccggatgggggccgggggcaagaaagggtcccttgcagggcggtcgtggccgttcatgtccacgcaaggggtgcttgcacaaggctatcacctggcaaaacgtggggggagaggccatttgcgccaatcctgggggcatgcgctccccgggcgcggcgagacatcccaaggcgtaaggttagtgacggaagccttgagcttccgttcccgttgctcgcccgttccaggagtggtcacatgatcaggctcgtcctcacggacatggacaacaccctcgtgccctttggcgacgagagggtctcgcggcgcgcgattgacgcgatccgcgcctgccaggaggagggcatcgactttggccccgccagcggacgcgaccgcggggaggtggcgagcttcttcggcaacgacgcgagctgctacaacaccggcgtcatggtcaacgggcagaaggtgtacttcctgggggaggtcgtgtacgagaagaccctgcccaccgagtcgctccgcaaggtggagtcgctcgttgccccgctccccggatgtgcgttcatcacgtatcgcgacaacaactttggggactgggtcggtgtcacgcgcgaggagctgggcaccatgtacgaccgcgcgttcatgtgcggcggcaggcggcacgagcgcggcgggatgcccgactaccccgtggtcaaggccgggatcatcgtccggggccccgaggggcgggcgctcgacctgtctgcgcggctgacggaggcgtgcgcggacctcaccttcctgcacaccgtggagcagtggctcgacgtgagcccccggggatggggcaaggccaacggcgtgggcatcctctcaaacgtgctggggctggagcccgacgaggtctgcgtctttggtgacgcggacaacgacctggacatgctccgggcggtccccaactcgtgcgccgtcgccaatgccaaccccgctgcctcgcgtgcggcgcgctggcacgtgggtgcctccgcggactttggggtggcacgcgccctcgagcagattgccgaggcggcccgtctctcgcacgtgaccgggcgagaggtgcttcccgccttcatgcgggagggggagtagcgccgcccaacaagggtgcgcccgcatccgtcgcggtggatgcgggcgccctgggatgcggaatctctcgccttgctacgagaggagcatgcggtcgttggcgagctcgccgcccgagacctcctcgaacttcttgagcaggtcggcgaccgtgaggccggacttctcgtccccgcgcacgtcgtagatcacgttgccctcgtgcatcatgatcaggcggttgcccaggcggatggcgtcgtgcatgttgtgcgtgaccatcagcgtggtgaggtggttctcggccaccagcttctgggtgagcgagaggaccttgctggcggtcttggggtcgagtgccgccgtgtgctcgtcgagcaggagcagcttgggcttcttcagcaccgccatgagcagggtgagcgcctggcgctggccgcccgagagcaggcccaccttggaggtcatgcggtcctcgagccccaggtcaagctccctcaggcgctcgtggtagccgtcgcgctcctccttgctgatgccccacgagagcccgcggtgctgcccgcggcgggcggcgagggcgaggttctcgtcgatctgcatgtcggcggcggtaccgcgcatggggtcctggaacacgcggcccaggtcggcggcgcgccggtgctcggggaggcgcgagacgtcgcgaccgtccagcacgatggtgccgccgtccagcgggaacacgccggcgatgctgttgagcagggtggacttgccggcgccgttgccgccgatgatggtgacgaagtcgccggcgtcgaggtcgaggttaacgcccgtgagcgcgggcttctcgttgaccgtacctcggttgaaggtcttggtgactcccttgagcgacagcatcagcgctcgcctcccttcgagtacgcgcggcgcgcctggctgcgctccactacgacggggatgaccagggccagggccacgatgatggccgagaggagcttcatgtcgtttgcgtccatgcccatctggaggacgacggcgcggatgatgaagtagatcacggagcccaccacggcggaggtcaggcggctgccgaacgcctggagcttgcccggggtgaggcggccgagcacctctcctatgacgatggcggcgaggccgatcacgatggcgccggtgcccatgttgatgtcggcgtacttctggctctggcacaccagggcgccggacaggcccaccaggccgttggagaggctgagcgcgatgagcttggtcacgcgcacgtcgatgcccagcgcgcggcacatgtcctcgttctggccggtggcgcgcagggcggagccgatctcggtgccaaagaaccagtagaggaggaggatgcagagaacggcgatgaccagcccgatgagcagggacgccatgctctgcgagatgccaagcgccttggagacgcgcgtgaacacggtgtccacgcccagcagcggcgtgttggacttgcccatgacgcgcaggttgatggaccagagcgagatctgcgtgaggattcccgcgaggatggcggggatgtcgaagagcgtgtggagaagcccggtcacggcgccggcgacgattccggcgagggttcccagcagaatcgcgaccagcgggtcgagccccaggttgaccgacgccaccgcggcgacgcagccgcccagggcaaagctcccgtccaccgtcaggtcggcaatgtccagcatccggaaggtgatgaacacgccgagcaccatgatgccccagaggattccctgcgacaccgccccagcgagtgccaatgccatacgttcccccaaacccgatgatgtgcccgggacgcgttgccccgggcacatctgacgtcgccgcacgtggcggccctaccttgctccgtttgacccgaagggtcgcacgtctcctatgccgaggcgctgtccgcggagtccgctccgttgctcgaggttgcggagtcgcccagcacggtgaggtccacgccaaccgcctcggcggtcttctggttggtcgacagcgtgcactccttggcgctcaggtgctcgatgggcatgtccgcgggctgcgactcgcccttcaggatcttgaccgccatctggccggccttgtagcccagcttctcgtagtcgatgccgtaggtggccaggccgccgttgtcgaccatgcccttctccccgcagatgacggggagcttgttctcgttcgcgaccatcgagaccgtggacatgcccgccgcgatggtgttgtcggtgggggcgtagcaggcgtcgacctttcctaccatggactccacgacctgctggatctcgttggagctcgagaccgagtagcgggttgccgtgaggttgcgcttcttggcggcctcctcggccatcttcacctggacgtccgagttgctctctgcggtgcagtacaggatgccgacggtcttggcgtcggggagcagcttcaccagcaggctgaactggtcgtcgaccggcgtcaggtccgaggtgccggtgacgttgttgccgggcttgtcgttgctgtccaccaggccggacgcggcgaagtcggtgatcgccgtccccacgatggggatgtcggtcgtggcgcccgcgacggcctgcgcggcgggggtcgcgatggcaaggatcaggtcgtctccgtcgttcaccagcttggtggcgatggtctggcaggcggactggtcgttctgtgcgttctgctggtcgatgtcgtatttgatgcccgagtcgtcgagggcgctcacaaagcccttgttggcggcgtcgagcgcgtcgtgctcggtgagctgcagcacgccgatcttgtaggtcttggagccggcggagctgtccgagccgctcccgccgccgctgcatccggccagcgtaaaggccgccagacccccaaacagtgcaatggcatcgcgacgtgtgacgttcttggtcatgctgacagcctcctccttgtgcagtgccatgcccgtgcatggcggttgcgcttatcagcacatcctaagtttgatgttggggacgtatggtttggggagaaaaacgattacaagctcgtaaccgcacgcgctggcagcgagccgtccgaggtgcatggaatcccatcccgcgtcgggtatcctctatcaatgttggggcattgtctcgccggcgggcgaggcggcgcgaggggagagctgcgtggaacaggggagaggccacaccgtgaagggccgcggggaaagcgacggcgggagccagggaaccctctcggagctcaggggctccgaccgcgtccgggcgtccgccttcctcctcctcgtggcgctcgtcctgggcgtcgtggttggcttcctgacctttgccgtgctaaggctgggcgacctggcgcagtccacggtgtgggaggggctgaggggtaccctccccgagggcgtgcgcgctgcctacccccttgtcgtctgcacggttggcggcatcctggtggaggcatggacccgcaggtgcggctacacgctcgataccctctcggtggtcgtcgcccactgccgcgagaacggcggctactccgtgaggagctggggccgctccctggtcctcttcctgcttcccatcgcgtttggcggggcggtgggtcccgaggcgggcatctcgggcttcgccgccgcgggcttcaccgcctcgatggccgccctgaggcgctctggcggggccgtcgccgacgacccgtccaagcccgtgaggagcggcgtccccgcgctcagccccgagtgggtcgggcgagaggcgcggctcatgcacaagcgccacaaggcggtcgtgtgggcggtcgccggcatcggcttcgtcctgggcgccgtcgcgctggcgagacttgcggggcccgccggggcgcttccccgcttcccggcgatcgactacctgcactcctcggtcttggcggcgcttctcgccctggtcctggggtggggcctgagcgtcgccggtgccgtcgccgggagggccgcgaagagcgctgccgaccggatgtcccaggcaggcgtgccgcgcgcggtcatctgcggcgtggtgctgggcgcggttgccgtgcttctccccaacgtcctcttctcgggcgagtccgccacgggcgacctggtgggcggctggcagggggtgggcgtcgcggtgctgtttgcgaccgccctcgccaaggtctgcctcaccaagctgtgcgtggcgtgcgactgggtgggcggcgagttcttcccgctcatcttctgcggcgtaagcatgggctacgtggcggcggcgcttctcggcgttgacccgctcctgcccgttgccgtcgcggcaggcgcagtcgtgagcgccagcaccagaaagccgctgctcacggtatgcgtcctcgccctgtgcttcccgctccagagcctgcccgccgtcgccgtcgccgcgtttgtggcggcgaagctcccgctgggcgtctcgtccgggaagacctcggaggaccagggggagtaaggggaacgttgggctgcgggctctcgcgcccgggctgcagtgcggaccgtccccaggagggaaagagccctgagaaggggtgcgccggcggcctggcgcgtgcggaggggccggtggtcctggacggtcggcggttcgctggactcccatctccagcggagtcctcctgacctggcggcgaacccccgcgtgggcacctccacggccggctggctggcgaaccctgggcttccgcggcattcgtgtggatagcgggctctcggaaaaatgagcgacctcggccctggcaacagatgccttgcgtgtctgcttgcgatggatgggggccaagagtcaaagaacggagggggtgctgtcgccgaggggacggggcgtgccagcccccccgcgagtaggccgactgcgctgggtgggcccaagggtcaaagaacggaagtgggccgacgccgccgagggagttggcctacctccgcccgagagggcccaccgcgaccgaccccgaggcgcggccagccccatgggatccgggcccgtaaggattgacgcgtttagggcccccgtaaacgcgtgtgatcttacgggactcggagtttcgtaaggattgacgcgtttagcgcctccctaaacgcgtcaacctttgcggaacggcctctgcgcggatgttttgccgccgaggttcgaggtttgatgggacggcggtcgtgggtcgtgggagggagacctccgatggcggccggagcccgatgtgagcgcttccccacggaagggttcctggcactggccgtgcatccctggcgtttccccaggtgggagaactcgggacccacccgtctcctctcgctcgtggcggcaagctcccgccgtgagcacccacatccggagttcgctgccaggagattatcctctcggggttcgaatggcagagggggcccgaagtgagtgctcacagcgggagctcactgccatggttggcctactggtgtacctcaaactgggagaacggccggcctctctcgcctccatggcagccaaaccccgcggtgagtgctcatttcaggagcttgccgccagcatgcccacctcggaggaggcccggcccgcaacgccgccccttccccggttggagggagctcgatgaagggcgtgcggcgacccggcgtacgcggggcggcaacttgtccggacggtaggcaaccagcttcattccgagcccaccgatttgccttcatgaccgttgctgcttggggtcggatgtgtaggtgacgcagcaccggaaagcgcccgtgcgcgtacgctcgggtcgggcttaacgcgggatggagcgcccgaccgccgtggggtgggccgacagcgcgcgccccgtgcgtgcgaattctagcccgtggcatcccctcgcgccttggccggtccctcgtcctcccgccctttgatatcctgcgaatgtgtggagggggagcgcgaatcccccgtcctgggcagcgtcggggggaggaagctatggcaaggctcgatggtgttggcgtcgcgttctgcggtggtgggttccgctcgtttgccgaggtcgcagccatagaggacatggagtgcaatgacgtgcgcattgccgcggcggcggggacctccatgggctcgatggtcgcggtgctcacggcggcgggactcccctcgtcccgcatcgaggagctcctggtgaagatggaccgtcgcgtggtcgagggcggcttcctcaagaacatgcagttcaaggtcctcaacatggtcaagagcaacggcttcctggactcgggggtgatggagggctacgcccgcgacatcctgggcgaggcgggggcgctccacatggacgacctcaagatgcccgtggccatcccggcggtggacatcaccacggggcagctgtgcgtgttcaccaacgatcccgacctgtttggcgaccccaacggctcgtgggcgtgcctcaccggcaacctcgacctggccaagtgcgtcacctgctccgcctcgtaccccctcgccgtcacgcccacccagtacctgggccgcaccttcatggacggcggctgccgcatgaacctgcccacgccgctcttcgaccgaggctcggtggacgccgtggtgggcgtgggcctcatccgctccatgagcccgctcgagtctcccgcccccatcgacatcgcccgtcggaccatggcgtgcggggcaaaccagctcgaccgcctgtactcccaggcggcagacgtctacgtcaacctccccgtctcgggggacgacgccttccaggcgggtacggggcgccaggtgatagacgaggcgcgcgccatgctcgcggcgcatcccgtcgactgggtggcggccaggccctccgggttcacggccctcaggagggcggctctcgacgccctggcgaaggtcatgcgcccccaggggtccgagtggcaggagggccaggcgccccgcccgtagcgccggcgcaaccgggcggcgggggagaggacccacgcacgtctccgatgcctcaccgtcccgaaacaatccccgcctacgctggtgcgagaccggggaggtgccatgaggagctttggcctgatggatgtcctgggacccatcatggtggggccgtcgtcgtcgcacacggcgggcgcgctccgcatcgcgcagatggtgagggagcttttggacgcgcctcccgccgaggtccggtttacgctgtacgggtcgttcgcgcgcacgtaccgcggccatggcaccgaccgcgcgcttgccgcggggatgctggggctccacacggacgacctgcgcatccgcgactccctgcagtttgcgcgggaccgcgggctcgcggtgtcgttcgaggctgaccccacgtcgagggtctcccaccccaacacggtcgacgtgtgggtgcgcgacggcaacggcgacgagctcacggcccgcggcgagtccatcggcggcggggccgcgcggctgacgatgatcgacggtctgtcggtgcagatcacgggggagtacaacgccctcatcctctacgagcgagacgtgccgggcgtgctcgggcacatcgccggcacgctgggggagggcggggtcaacataggctccgtgtggatgtaccgctcgcgtcgcgggggcgaggcgttcaacgtcctggaggtcgacggccccgtgtcgcgggaggtgcgcgaggcgatcctcgcgagcccggacatcagccgcatgcgcttcgtccccgccgacgggctggggcgcgcccccgacgccgaggggctgggggagccgtcgatggggcccggcgaggcggagcggctgctcccgacggtcgacttcgaggacgcgtcgcagctcctctcccatgccgaggctcacgggctcaccctggggcaggcgttcatggcgcgcgaggaggtgtgcgaggccatgcacggccggcccgttgcggcggcggagcgctacctggaccgggtgctggacgtgatgcgcgagtctgcgtacggccccctggggggaggggtgcgcaccatgggcggcctcatcgggggagagtcccgggcgctttcggggcttgccagcgggggagacgcgcttgccggcggggtcgacgcccgcgcggcgacgctcgcgatggcggtgctcgagaccaacgcctcgatgggccgcatcgtcgccgccccgacggcggggtcgtcgggcgtggtgcccggcgtcctcctcgccatcgacgaggcggttcgtccagggcgagaggagatgcgcgacgcccttgcctgcgccgcagccgtggggttcgtggtcagccgcaacgccacggtcgcgggggccgagggcggctgccaggcggaggtgggcacggcgagcgccatggcggcggccgcggcggcgcgcctcatgggggccggcccgcgcgcctgcctggacgcggcggcgatcgccctgggcaacctcctcggcctggcctgcgacccggtgcggggcctcgtggaggagccgtgccagaagcgtaacgccgctgcggccgcgaacgccctggcctgcgcccgcatggcgctcgcgggcgtgaggtcggtcgcgcccttcgacgaggtggtccaggccgccaggcgcgtgggggcctcgcttcccatggagctgcgcgagacggcgctgggcgggatcgccgcctgccccagctgccgcgggtgcgcccagggctaggtggtggcgctgctctcctccccaaagatgaactcggcgaagctgcgcgacgccacggggagcgtgtcccacgccgaccacgccagcgcgatgttcctgctggggcgctccgcgatgggccgcacctccacccccgtggcgtagccctcgagcatggtcgtgtacaggatcgagacccccaggccctcgcgcaccatggcgaggatggagtagtcgtcggtcacctcgtagcggatgcgcggcaccagcgagagcctgcggaacgacgagagggccacgctcacctggccctcgtccagcaggatgatcggctccctcgccagctgggccagggtcacctcgtcctgggaggcgagggggtggccctggggcaggaccgccatcatggtgtcggtcgccacggtgcggcagggcagcccctccgagtagtcgccgttcaggaagccgatgtccaccctcccctccgcgacccactcggctatgctcgtgtactcgccctggcggagcacgaagcgcacgtcgggatgcagcccttcgaaccggtgcatgagcggcggcaggatcctgcgactcacgctcgagaaggtgccaacgcggatggtggcccccatcaggccggcgacctcctgcctgcgacggtcgagctcctcctccgcctgcgccaccgcgcggatgttgggcatgaacgtctcgccgtccctagtgagcgagagggacccccgcctgcggtcgagcagggtcacccccagctccgactccagcgagtgcatcgtctggctcacggcgctctgcgtgtatcccagctcgcgcgccgcctgggtgaagctgcccgcctcaaccaccgtgcagaagacctgacagcgcgacgtcctcatgtgggccctccctcacgtgcatgcattaggggtgctaatcgaaccataaaatacattcgtttaactaatcgcttccgcgatgcttttaaagaagtcacagggtgtttacggcgtggggagcagacgtgggacaggcgagtattgcaacagccatggcagggtcaaaggggtcgtcccgccggggtgcgggggagtgggcggcaccgtttcgcgagggtctcgccgacggactccccatcgccctggggtacctcgccgtgtcgttctcgctcggcatcgccgcgaagatggcgggcctgagccttgggcagggcgtgctcgtgagcttcctctgcaacgcgtcggcgggcgagtacgccgggttcacgctggtggcggcccatgcgggatacctcgagctcgccgcgatgatgctcgtggcaaacgcccgctacctgctcatgggatgcgtcctttcgcagcggttcgcaagcgacacgccactctggaggcgcgcgctcatcgccttcgacaacaccgacgagatcttcgccgtcaacatcgcccagaggggagacgtgcggcccgcccgcgccctggggaccatggtcctgccccttattggatgggcgggcggcgcggccctgggcttggtcgtcggcagcgtcctccccagcctggtcgtgcaggctctgagcgtctcgctctttggcatgttcctcgcggtcatcatcccgccggctcgggagaaccacgcggtggccggggtcgtcgccgtgagctttgccgccagcctggccgcctccgtggcaccgctggtctctggcctctcggagggcgtccgcaccatcctgctgacggtggggatcgcggccgccgccgccgtgctgttcccggtgcccgacgaggagggcgagacgcgcaacgacgtcgcccccgactccgacggtgggcggcagggagcgttcgagcccgtcgccctgtcctccgctaccaccgcggtggaggcatagcatgggcgcgaccggctgggtctacgtcgcgatcatggcgggcgtgacgtttgccaccagggcgctccccgccacgctcatcaggcggaggatcacgagccccttcctccgctcgttcctctactacgtcccctacgtgaccctcgcggtcatgacgttcccggcgatcctgggcgccaccggggtgccggtcgccggtgcggtggcgctcgccgtgggcatcgtcctctcgtggatgggcgccggcctgttcgccgtgtcgggcgcctgctgcgcctcggtcctcgcggtcacgctcctggcgcaggcgctctaggccctcgccccctctgcggcatcgctcgctggcaaagcctgacgttgcgggcgaccgcgcccttgggcgaggcacgcttactgccatggggattggcgtgggggtggtccgtcgcacctctcctcaaggaacctcgatatacaataaaacccactgcgattctccgccgtgggtcggatgcgcctcacccgctccgagcggcggtctccgtggtgtcgcccgcgtgacgccacggtggaagggccccgcattgggcgggggagaggggatgtgccatgaggttctcgaagaggctcgacctgtttggagacgaggtgttcgccgccctcaacgtcaggcgccgcgagcttgaggcgaggggccgcgaggtctttgacctgtccgtgggcacgcccgactttgcccccgaccagcggctcatcgacgcgatggtgaagagcgcaagcaaccccgagaactggaagtactccctgcacgaccgcgacgagctggaccaggcggtctgcgactactaccacaggcgctacggcgtcgacggcatcacgccggacatggtcatgagctgccacggcacgcaggagggcatgggctttgtgtgccaggcgcttgttgacccgggcgacacggtgctggtccccgacccgtgctacccgctgttccgcacggcgagcctgcttgcgggtgccaagctggcgttctacccgctcagcgccgagcacgacttcctgccctacgtggaggggattcccgacgacgtggccgacgccgcgcgctacatggtggtctcgcttcccgccaaccccgtgggctccgtgggaacccccgaggtctatcgtcagatcatcgacttcgccaaggcccacgacatcgtgatcatccacgacaacgcctactctgacatcgtgtttgacaccaaggagccggggggctcgttcctcgcgtacgagggtgcccgcgaggtgggcgttgagttcctctcgctctccaagtccttcgacgtcaccggcgtcaggctgagcttcctgatcggacgtcccgacatcgtcgccgcggcaaagaagctgcacggccagctggactacggcatgttcttccccgagcaggacgtggccattgccgcgctcacgggcccgctcgacggcgtcgagcgtcagcgcatgctctaccaggagcgtcgcgacgcactgtgcgacgcgctcgagggcatcggctgggagcgtcccaatgcgcacggctccatgttcgtgtgggcacgcatcccgggcgggcgcatggactcggtcgacttcacgctcgagctcatggagaagtccggcgtcatcgtcacccctggcgccagctttggccccgcgggcgagggctttgtgcgcatggccctggtgatgccgcccgagcggctgcgccttgcggtctccaagatccacgaggcaggcttctaggagatctgcgcgatattcgcggtcgcatcgacgccgcccatcgatcccccggagacgtgcgttggagcgtcatcggcggtttcgcgtggcatcggggggaacaccttgggtcgcggcccgctcggggcggatgtcgtgggaggtcccctttgagctcccgtgtccccgttcgcgtcccgccacgagtcgcccaagcaagaacatcagtgaagccggggccacgggccagatgttcgtggccccggcttcgtcttgcgcagattctctcccggtggtggatagtccggatgcggttgccttgcctgcgccagggagccgggggccaccgttcgattgcggagatgggctgccgtacgcgccccacctcccatactgctgtctccccttatgggttcttctctgggggctcaccagccggtcagaccgtgagcccccggcgcttaaacggtgtgcgccctcaatggtctaagaaggggagggacggttctccgccggtgggtctcccgttaatcgcgcgcttgctcgtccctgatttccctcgagtctcgcgtgccttgaatcgagggtcgaaccatggaagtgggagacggatatgagtgggtcggctggtgagttctcgtcgggggtcgtggttacccccagcgtttcagcaggtagaggggtcgaggggacatcgctcaccctggagcgtggcagcgacctcccgaagtgagcactcacgtcgggagcttgctgccatttggccatcattccggacttgattggcggcgggagactgatatgagtgctcacatcgggggtttgctgccatggcctgggagatggccggtcggcagctgggagacgtgaccctgctggccctccatggcggcggaatccggatgtgagtgctcacttcgggagttcgctgccaatgtttgaagattgatggccccgcacgctgcagattgcaaaggagcgccgagggagccgtgccgatcgcgggcagacggaccgtctagggtcagagagggagaggacgggtcaaggttgaacgggacggccaccggtgcgggcctgccccggggcccaccgctcgacccgcgccgcccgccggctgccgcgcatcaccggaaaccgcgtcccgcgtgtacacgcggcacgcggttcctgacatggggcccaccccaccgggtcgtcttgcctgctggaggggtgccggggccgcgcccgggccagagagtgcgtcccgcgtgtacacgcgggacggggttccaggcagagccgcccctgagggacgggcggatgtcggaaagccaaccccgggtgtacacacggcgcgcgatttccgacacgggcccgccgcgacgcggcgcatccccagttggcgggaaggcggggccccggcgccgccgaaaggtgcgtcccgcgtgtacacgcggggcgcggttcccgacgtgggcacggccgccgcggccggccggcggggatgcggggccgagggcccggggccgggcggggtcgcgcgcgccgcgcgccgcgcccagcggcatccgccccctccccttctttgacctcgaggggcaactgccagggtcagcgcttcgggcatcccacctggccatcagcaggagagccccgatgcggccacatccggaatccgcgagaccacgacgcagacctccacgcgaacggaagccgccgcaagaaagggggacggaggggcaacttgacccctccgccccggtcacggctgtgatgtgcgctcttcgccttagaactcaaactcgtccagcatcatcggctgggtctggtagcgcagcggctccagctcgtccacggtgtggtagccgggtgctgcggagaggaccgtggggatgcggttgacgatggtggcgcaggtgtggcgcacggtgtcgggcttctccacgtggaaggtggtgttgggctcgccgtagatcttccagtcgcacaggtcaccgtcatccggcccgtacaccttgccaatctgcgaggtcaccaggtcgatcccctggtacgtcttggtggtcacgcgcgtgttcatgcccaggaccttgccggcggggatggtctcccccatggtctgggagtaggtgtccgcctctgccacgtagggcacgttctcttggatgacctccttcaccgtgaggccgagctcctgagccaggcactcgttggagttccacacgtaggagggcacgatctcgtccggatgcgccagggtcttctcgaactcgtcggtcgtgagacccacgccgtgcgccttcgcgagcgcaagcccgtagtcctcgacgttgtacgagacggagccctcgaccttggtgatcgagttcacggcgccggcgagaagtccgacgatgcggacccagaacacatcctccatgccggcgccgacgatggtggcgccgttctccttggcgattgcgtcgaggcggttcgtggtggccgccgaggtggtccaggggaaggtcgcctcctcgcaggtggtcacgacgctgatgccgcggctcacgcacttctcgaccatcggcgcgatgtcgtcgacgagcgagaacagggtgacgattgcgatgtcgggcgcggtctcgtccaacaccttgtccgcgttgtcggagatcttgacgcccagcttgacgggcaggcccgcatagtcgcccgcgtccatccccaccctgtcggggttggtgtcgatggcgcccaccagttgtgctccgtgctcgtgcagataacgaatggtgtactttgccatcttcccgcaaccgtactggactaccctcactggcctgcgactcatgggaactcccttcgtgaagaactccatcgcaacgtcgcgcgaggtggcggttgggtctgcctcgcggcgacttatggctgtttgttcccataattcgtccgcgtagattgtgcccggcccacttttccgttgccatttcgtgacgtggcaacggatgcggcgaacgcttcccgacgcgtgcatgcgctggtcgtgggcttaccgtccgcttgctgccgtcttgccaagggcccgctacactcgcgcaaagggccgcccgcgggcggacgaccgagcggaggtgccgtatgggaacgtcggcgcagggagggggcggaggcattgccgtccccgtggtgatcctggcggtctacgttgccctgtgcgctctgggcgcagtggtcggagggccgttcggcgagttctggagcggcgccgcgccctgggtcgcggtcggactcgtcctggcgatagccgccgcgtggtggccgtcccgcaaggggcgctagcggcacgggactggcttcagccgtcgagccccgggtacccctgctggcgaagtgcctcaaacagcacgatggcgacggcgttggagaggttgagcgaggtcacctgcatgctcctctcgtccacgaagttgccgcacacgtcgcgcttgagctcgggatgcaggtccaggtgcgaggcgtgccactcgcccgcgttggcgagcgccgcgtcgcccaccatgggaatgcgctcgcacagggtggggtgcgacgcgatgagcccctggtccaagcccgtgctctcgcgtccaaacaccaggtagtcgccatcgcggtagcggctgtccgagtgcctcctcgccccgcgcttggtgaggaggtgcatggcgggagccggcttgccgtcctcgacgacgggcgagaggtgcccgtcgagcgccgcccacgcgtcgtggttggcgaggaggaacgcctgccagtcctcgtagaccctgacgtccaggctctgccagtaggcgagtcccgcacgcctgagggcgcgctccgacagctcgaacccaggcgccaccaggtgcaggcgcgaccccgtgagcacgcacgtcctcccgatgttaccggtgtttgccgggatctccggctccacgagcacgacgttgagcatgtctccccctacagaccaagcagctggcgcttcttgcggtcgaactcctcctgagtcaggatgcccaggtccaagagctccttcgccttcttgacctcctcgtaggggtcggccaggggagacgtggccgcgatcccggagcctgctgccccgggatttggctccgctcccttcggttccgccaccgagcccttgggggcgggggagagggacgtccccctccgggccgcgtgcagcgcctcgacgaccgcaagcgcctcgtcgggtccaaggccaagccgcatggcgtcgcggggcgcctggaccgtgaggaccgatcgctcggtgccctcctccagcgcgatgtccgtgaccgtctcccaggggagcgtgacggggcgcaggccaaacagcctccgctgcgaggagtgaagcgcacgctgggtcgccacgaaggcgaactggccgtcgttgtgccttgcgtcccggtagttggcctgagcgacgaacgtggcgtaggggcgctcgtccggctccaggccgtctgccacgaccgtcaggtggcgccggagcagctgggggtccatcccgtcgtcgagcccgtccgcctcacacctcctggcaagggcctcgcgcgcgtccgcctcgagccggcgctcccggacctcctcgtccgtcctgcccccgcgattcctgagcgcgatgcggtcgagctcctcgatgatggcgttgccggcctccaggtccttctgcgcaaacgacacgttgaccaccctgtcgcccaccgtcacctggtacacggcggcgagcaggcgcgacggcttggtgaacgcgcgcacggccgtgacctccgagatggggtagtgctccctccccacgacgagctccgtgtcggtgagcgtggtgtcgggcccgtatcccgcgcccggtgcgtagagcttcatgaggtcccctctcgcttgtcccatcgctctaggctagcgcgaagcgttgtggaggggtgggagaacctccgccgtcctcgctcgggatcgcccgtcccgcacgccgggatgccgtgggttgggaatagaatcgtgtgacccggcccgcgcttcccgcgggaccggcgggcggaatgcgaggctgagggaggcaacccatggaaggtgcggacgaggtcatggacgaacgcgcggtcacgcgcgagggggatcccggcaacccccacggggcctttggcgagcggatgctcgagcgcatgaaccggagccacgccgacgtcaccaactgggccctcgacctggtcgacttccatgccggggaccgcgtcctggacatcggctgcggcgggggcgccacgatggggcgcatcgcggaccgcatcgaggcggcgggtgggggcggccacgtgagtggcgtcgaccactcggaggtctcgtgcgccacctcccgccggcagaacgagggggccatccgcgcggggtcgatggacgtcacgcgcgcctcggtggaatcgctgccctttcccgacgcctcgtttgacgtggtgaccacggtcgagagcttctacttctggcccgatccgccgcgctccctgcgcgaggtcgcccgcgtggtgaggccaggagggcgcttcctcctggtggccgacgtctaccgccgtcccgacctcgacgacgaggtgcgggagaacatcgagcgctacgacctcacggtcctggagccggcggagtacgaggagctgcttgtgggcgcgggcttctcgcatgcgaccgcccacctgcgcgaggggacgacctggatcgccgtggagggcgtgaggtaggtgggcgccctgcaagggcttgcgtcggcggtcttggcgttcctcacccccgagccggtgttcctctcgcaccccgaggggggattcgcgacctttggctcccagcacctctgcatgctcgcgatcatggccgctctctccgccgtgctgctgcgcgccttccgccggctgcccgcgggatgggggagagggacggcgcgccatcgcttcctggtcaccgtggcggcggtcccgctcgcgctcctggggtcgcgcgacgccatcctcattgcccgggggctcatgacccccaacttctggccgctgcacatctgcaacatatgcgagttcctcaacctcgcgctcgcggtgagcgagaatcgccacgtggcgcgcgtcgcctacccgtggggcatggtgggtggcatcggagcccttctcctccccggctggacctactgccccgtgtggagctacgcgtcggtgggcggcttcgtggagcataccctcatggtcgtgtgctgcctgtgcgtggtgggcgggggcctgtatcgcccgagcctgcggcatctgtgggagccgacggtcgcggctgcggcgggcgggctgctgttccggttcctcaacccggtgctggacaccaacttcttcttcgtcacctggcccgtggcggcgcccttcgcgtggggcgtgaggaggtttggcaacccggggttcctggtcccctacctgctcattgccctggtgctgtggtgcgccttcgacggtttggggcttctcctccagggaaccctggtccatcccgaaaacgggggagacgagccaaacctcagtgcgagtgcatgagattttctgaatgcaagattacaggtcaatccccggggtacacacttagctgtgaaaaaaccgcacgccgcaagaagggggacatgcctgcatgaagcagttcaagacagagagcaagaagctcctggacctcatgatcaactcgatctacaccaacaaggagatcttcctgcgcgagctcatctccaacgcgtccgactcgctggacaagctgtcgttcgaggggatcaacaacccggacctgcacgttgaccaggactcgctcgagatccgcgtgagctttgacaaggacgcgcgcaccgtgaccgtgagcgacaacggcatcggtatggacaaggacgccctggagaaggacctgggcaccatcgcccactcggggtccgaggagttcaagcgccagaacagcgagcaccagggcgaggacgtggacatcatcggccagtttggcgtgggcttctacagctcgttcatggtcgcggaccacgttcgcgtggtgagccgcgcgctgggcgccgacgccgcctacgcctgggagtccgacggtgtgacgggctacaccatcgagcccgccgccgagggcgagaggggtggcgcggacgaccacggcaccgatgtgatcttgcatctgcgtccctccacggacgacgagaacaccgaccgcttcctgagcgagtggggcctgagggacctcatcacccgctacagcaactacgtgaggcatcccatccgcatgatggtggagaagtcgcgcgagaagcccaagcccgaggacgccggcgacgactacaagcccgagtacgagacgtacgaggagctcgagaccatcaactccatgacgcccatctggaagaagcgccaggcggacgtggagcagaaggactacgacgagttctacaagtcgaccttccacgactgggaggacccgctccgtaccgtcagcttccatgccgagggcgcgctgagctacgacgcgctgctgttcatccccagccaggcgccgtttgacctctatagcaaggactacaagaagggcctcgcgctctactcgtccaacgtcctcatccaggagaagtgcgaggacctgctccccgactactacaacttcgtgcgcggcatcgtggactcgcccgacgtgcacctcaacatctcgcgcgagacgctgcagcagaacgcgcagctcagggccatcgcccgtcgcgtggagaagaagatcacgagcgaactgcaggccatgcgtgacaacgaccgcgaggactacgagaagttcttcgacaactttggtcgcggcctcaagtttggcatctacaacagctacggctccaaggctgacgagctggccgacctcctgctgtactggagtgccaagcagggcaagatggtgaccttcgcggagtacgtggcgtcgatggcggagggccaggacaaggtctactacgcctcgggcgagagccgcgagcgcctggagcagctgcctgccgtgaggagtgccgtcgaccacggctacgacgtcctcctctgcacccaggacgtggacgagttcatgttccaggtcatgcgctcctaccatgttgacgccaaggcgggcgactccgagcacaaggggaccgaggccaaggactacgacctggtcaacgtcacgaccgctggcctggacctggcgaccgacgacgagaagaaggatgccgagaaggcccaggacgagcacaaggagctgttcagcgagctcaaggatgccatggacggaaaggtggacgacgtgaaggcagccgccggcctgggcgacgcccccgcggcgatcgcgtccgagggtcccgtctcgcttgagatggagcgcgtgatcagccagggccccgagggcgagaacgcccccaaggcgcaccgcgtgctgcagctcaacgcggcgcaccccgtgttcggcaagctcgtggcggctcaggagtcgggcgacaaggaccgcctcaagctctacggccacatcctgtacgaccaggcgctcctggtcgcgggcatgcccatcgacgacccgatcgagttcgcaagggacgtcacggagctgatgtaggcatcgcgcgggacttcgcgccatggggagggggtcgtcccggacggggcggccccctcgtcgtatgggcggcgcgcgtctctccccgctagcctcccacgatggtgcccaggagccagccggcgacgtagacggcggcgagggcgaccatgaccctggtgtaaagcctcctgcggagggagatgtaggcggcccactccctcacgagcgcgttgagcgagaagtacaggcgcacgtgggagcccagcccgtcgcagcgcacgcccagctcgcgggtgaggagcagcgcgcggaacacgtggtagtcgtccgtcaccaccaccgcgcgcgagtgctccccgccgtcggcggagatgagggcgaaggagttcgctacgttctcccgcgtgttgcgcgagcggtcctccaggacgatgctctcgcgcggcacgccctgggagacggcgtagtccgccatggcgctggcctcgctcaccagctcgtccggcccctggccgcccgacatcacgagggtggagccggggttgtcgcgccacgcccggacgccgaggtcgactctgcgcgccaggagcggggtcacggtgcgccctcccgcaaggcccgcgcccaggacgatcacgtgggcgtagcgacggtgccggtgcgggatctgggcgagcgcaccgcttatggtgtagagcgtgaagaccgtcgagagcacgccgaggacgatggcggcgaggccaaacgcgaggtcgagcagcctgcccgcaagcgggagcgagaccagctcgcccctgacgaggggccacaccaccacgtaggcgatcatcatgactcccaggcccagtgacagcaggttggagggtcgcgccccctcgcggcggaccagcctcgcccccgagacgatgagcgtcaccaccagggccaccgggaacagggcgagaagcaccacgagcagcaccaggaccaccaggttggcctgctgcagcaccgggtggtcgccaaacggcgtgcccgagaccagcacggcctccacggcgaccgccagcgtccccaccgcgaagaggaacgacagcccgtaccacaggctcctctcctcgtgcaccctcaggcgccagaaccacgcctgcccaaccgccgccatcgccaccagcagggcgaccagggtccccaccgtcatggctcgctcccctcgccctcggccccaaggctctggcccaggtgccgcagaaagtccctcgtcgccctcgacagctctgcctgcgggcggtgcgtcacgtagatgtcgcggtacgccctgggctcgagcggcaggatcgccacgtcaaaggggcagcgcgacaggatgagcgagggcaggatcgacacccccagccccgcctcgaccagcgccattatcgcgtagtcgtcccaggtcctgagccacacgctgggggagaggcgcgccctcctgaacaggcgcggaaccatgccggcggactcctgctcaagcatcaggaaggggccgcgggtgagctcgcgcagggtcaccgactcgtgcgcggccagctcgtgcccccgcggcaccacggcgaccagctcgtcccggtcgatggcggcgcgctcgatgcccgcgcccggctcgtaggggagaaaccccacgtccacgcgtccggagtcgacccaccgctcgatctggtcgtagtcgcccagcaggagctcgtagtcaacgtgcgggtggcggcgctgcaggtcgcccagcacgcgagggaggatgtaggtggccacgctcgacacggtgccaatgcggactgcccccgtctggaggccgcgtatctctcccacgcgctcctcgaggaggtggtactcggagcagaggcgctgggccacgggcaggatccgctccccgtcgggggtcagggtgatcccgcgccgcccgcggttgaacagcgtcacctcccagtcgcgctcgaggtctgcgatcatgcggctcacgcccgactgcgagtagcccatctgctccgcggcgcgcgtgaggctccccaggcgcgcggtctccacgaaggcctggtacttcaggatgctggcgtccactgcccctcccttgctaggtatgcaaaagcatcatgacacacatgatacattcgcgcttttctcagatgagcgggagggtcagactaggcgcggaaaacgtcgtggagggaatggctcttgtctcggtcgtatgggaagtacctcgcttcgctcctgctgtttgggtccaacgggatagtggcgagcgggattgcgctccccagcacgcagatcgtgctcctgcgcaccctcctgggggcggcgctgctcgtggtcgtcctgctcgtctcccggcagccgctcgtggggcgagagcatccccgccaggttgcggcgctcgccgtctcgggcggagccctgggcgtgagctgggtgtttctcttccaggcctaccgactggtgggggtggggacctccaccctgctgtactacctggggccggtcatcgtgatggcgctcgccccgctccttctccacgagcggctcggtgcccccaagctcgcctgcttcgccgcggtcctgctgggtgcctacctcgtggtgtcccagggctctggcggcctgggctccgcgcgggggatcctctgcgggctgggcgccgcggcgttctacgcggtcatggtcatcgccggaaaggggtcccgcgacgtgggcgggctcgaggccgccacgatccagctggttgcgagcttcgtgatcgtcgctctgtacactccgttcgcaggcccgctcagccccgtcagtgcgtcgtctctccccatggtcgccatgctcggcctcgtgaacaccggcctgggctgctacctgtacttctccgccatgggtcgcctgagcgtgcagtccgtctcggtcctgggctacctcgagcccgtctctgcggtgctgctctccgccatcctgctcgcggagcccctgggccccggtcgcatcctgggtgccgtgctggtgctgggaggggccatggcctgcgagctggtgggcaggcgccaggcggccgacgggcgtgggtcccgcggcggcatggtgcccgacggtgccggcgcgagcggagtggctgcatagggacccgggatccttgccttgaaacgcgcggggcggcgggcatctggtgcccaccgccccgccttgtctcgccctgccttccggctatgccgtcgcggtcacgccgccaaagctcacggatgccacctgcgacgggtcgatggtgcggtccaggaacgcgcccatctcgaccaccgtcctgccgtcctcctcgtgggagctgcatgcgccgctggggaccgtgatggtcgtcccgtcgcgcagggtgacggtgatgtcccccaggtcgaggtacttgggcgaccacctgccggacgtcttgggggcgtcctccgtgccgttcacggtgtagtccacgctcacggcgacgggcgagatgctcacggactgcacgctcgcgtccgtccccgccacggcgaggcttccggcgggcttgaggctcacggagtccgcctcgtagttgagcttgaacttgaggtcccagctccccgttgccacgggcgtctgggactgtgcggagtcgtccaacccgttgatggcggagaggtgcatgtccaccgttgccccgatcacgttggtgtcggcggtgagctgcgtcaccagctgtattgcgttgtcggaggggtcggcgtcgtagaagtacgctccgccgccctggccggtcgctccgtccacgctctggtcgaagtctgcagacagcgggcgcccgtccagcgtgagcgtgccgttctcgtcggtgcccacggtgccgagcggctttccgtcggtgcggctgatgctgtagaccaccacgtagttgcgctcgtctcccatgatcgcgtctgcggagacggtgatgccattgctcgtcgcgaccgcgttgaccgggcggccgaccttgttggtgacgttggtgggggcggtccctccgccaaacacgtcgtcgaacgcgctcgcaacgctcacgagctggccgctcgcgtaggcgtagccgcccagtcccacggccacggcgacgcctgcggcgacagcggcgacggcaagcccatggcgcctgcgggggcggaatgcggcaactgccgcctctccgctagcctgcgtacccagtgctgcagaggcaaccgcctgcgccatcctgtccctctgcgcctcggagagcgtgacctgacccatctcgtcccgatacctcgctgccatgtcgctcatcgctcgtcccctccagcctctcgcggagctccgcgcgggcgcggctcagcctcttggctacggcaccctcgctcgccccgactgcctcggcaatctgccgaaggctcatgtcctcgtagtagtgcagatagatgacctcgcggtatgtgggaggcaggcccatcacggccctggtcacctctcccggggcgtcatccgcgtccgtctcggcggtggcgtcaggcacctcggcgacctggtcgagcgagacgttccttcgccttgacgcgctcctcaggaggtccttgcaggcgttggaggtgcagcggatgacccatgcccgctcgtgctcggggccgttgaacggctccttcctgcacaggagcttgcacagcacgtcctggctcacgtcctcgctgtcctggcgcgaacccaggtaggtgtatgcgagcctcagcgtcaggtcgccgtactcgtcgaccaggcggcgtgcctccctctgcacctcctccgcgctgtcccatcttcttctcagcatgtcaaccccttgtcactcggctggctcgagccttcgacaacaacacgttcgaggggggtggaacctgacattccgctgaggggatgcctggcggagcgatgggctacttggaggctgcgaacatgttcctctcggcaaactccgcctggacggtgcggaacatgaggtccacgtcctccaggccaaggtggcgctccttctcgtctgccttgagggtgccgcgcctgcgggcccagctctccagcgcggcgggacgggagtcgtgggggagggtcttgtactcggggtcgaccttgcggcagatgtcgcgggtgtcgatggggacgaccctgcccgccttgcgggcctcggcgtagccgtcgatgttgagcatgaaccaggagtcctcgaaggcggcgttgtgcgccatgaaggggtacatggtcagcgctgccaggatcgcctcctgcatcttcttgtttgagcggaagggcttcttgccctcgacgtccttccaggtgatgtggtgcacgaaggagaggggcacgcccttctcgcggtacatctcgggcaggccgcagcagctgctgaaggggtggttgggctttgccttgggggcaagctccatgaactccaggcccacgttgactatgtagcctcggctggggtcgcggtcggtggtctcgatgtcgatgcccaccaccgtgcccgagacgggtgcctccacgtaggcgatgcccaggtcgcggcagtcggggacggcggtgcgcctgacctcggcctcgtcacggtgctgcatgcgggcgacggcgcggatgaggtcgtcgttagagaggctgcgcgagaggcagctgggcgacacgttgcgcaggcggtcggtgccgtagctgtcgcagctcacgcggttcctgtccgccagccccagcaccaggtcgaaggggaagggctcctggccggcgggcgccgacttccaggcgtccatcaagaggcagatggcctcctcgttgcgctggcgctccacggtgagcgtggcgtcgtccgccatgaagccggggaagacgaaggcgttggcgtgctcgattgcttggctcaggttcatggcagggtccctctcgcgtaggcatatccccctagcctagcagtgggcgggggcgagcggcggccgggggagacgaaacacgaagacggcagggaagcggtcgtggcgcgtgggagccggcgtcccctcggtggccaggatggggcattgcgccggggccctgggggagggcgcacccggacggatgccgcatcggccgtgcgtgattgtccctctcgccccataagcagtctgaaagggctaccatgtgaccaaaaggaacgtttggctaacttttggacgggacgaggggacctcgatggcagatgcgcgcggcacgacgctggggagcctgaagatagggcagacggcggttatcaccaacgtgggtggcgagggggcgctgcggcagcacttcctggacatgggcgtcatccccggggcgcgggcgaccctggtgaagtttgcccccatgggcgaccccatggagttcaggctccacggctatgagctcaccctgcgcgtggcggatgcccagcgtataggcgccacgctcgtctcgcctgtctcggccgggggagggggtgcctcctcggggcaggatgcgaccatccggggggagaagggcaagccctccggcatggagcaccccggcctgggcgagggcggaaggtaccacgtgaaggccaccgagcaccccctgcccgaggggaccacgctcacctttgccctcgcgggcaaccagaactgcggcaagaccacgctgttcaaccagctcacgggctccaaccagcacgtgggcaacttccccggcgtcaccgtggaccgcaaggacggtgccatccgcggccatgccaacacggacgtgaccgacctgccgggcatctactccatgagcccctacagccaggaggagatggtcagcaggaacttcatcctggaccagcgtcccacgggcatcatcgacatcgtggacgccaccaacatagagcgcaacctgtacctgacgatgcagctcatggagcttgaccggccgatggtgctcgcgctcaacatgatggacgagctccagggcaacggcgggtccatccacgtcaaccgcatggaggacatgctggggatcccggtcgttcccatctcggcggcgaaggacgagggcgtggacgagctgatcgagcatgcgctccacgttgccaagtaccaggagcgccccggccgccaggacttctgcagccccgaggaccacgggggcgccgtgcaccgctgcctccacgcgatcatgcacctcatcgaggaccatgccgagcgcgcgggcatccccctgcgctttgcggcgaccaagctcgtggagggcgactccgccgttgaggaggcgctgcgactcgaccagaacgagcgcgagacgatcgagcacatcatcgtgcagatggaggacgagcgcggccttgaccgcgcggccgccatagcggacatgcgcttctccttcatcgagaaggtcgtggcgcgctgcgtggtgaagccgcacgagtcgagggagcacgagcgcagcgagcgcgtggaccgcgtcctcacggggcgctacaccgcgatcccggcgttcgtggccatcatggcgctggtgttctggctcaccttcaacgtggtgggggcgttcctccagaacctcgtcgccgacggggtgacgtggctcaccaacgtggctgacgccgggctcactgcggcgggcaccaacccggtcctgcactctctcgtgatcgacggcatcttcaacgcggtggggacggtgctgcccatcctgcccatcgtggtcaccatgttcttcttcctctcgctgctcgaggacaccggctacatggcgcgcatcgcgttcgtgatggacaagccgctgaggaagatcggcctctccggccgctcgatcgtgccgatgctcgtgggctttggctgcacggtccccgcggtcatgtccacccggaccctgccctccgagcgggaccgcaagatcacggttgcgctcacgccgttcatgagctgctccaccaagctcacgatctacgcctacttcactgcggcgttcttcccgggcaccggtgccatcgtgattctcttcctgtacctgctgggcatcctggtgggagtgaccgtcgcggcaatctcgcaccgcacattcgccaagggcgaggcggttcccttcgtgatggagcttcccaactaccgcatgccgtccgcccgcagcgtcctccagctcatgtgggagaagtccaaggacttcctccagagggcgttcaccgtggtctttgccgccgccgtggtgatttgggtgctgcagaccttcagcccttccttccagatggtctccgaccccagccagtcgatcctcgccgtcgtcgcgagctggatctcgccggtctttgcgccgctcggctttgccgactggagggtcaccaccgccctcatcgcgggcttcatggccaaggaggtcgtggtcgccaccctcagcgtgctctttgggagcgtcagcaccctcaactcgctgatctcgcccctctccgcgctttcgctgctggtgttctgcctgctgtacacgccctgcgtcgccgccatcgccgccatcaggagggagcagggcgggcgcttcgcgcttgaggtcgtgatgtttcagtgcgtggtcgcctgggtcgtcgccttcgccgtgcgcctgatcgggctcgcgctcggctttgcgtagggcttgcagggggtcttgtcccctcagcggctccctcggatgttcgcgggggccgttttgcgtacgcaggggcgattggcgacggaggcccatcaggggcctatgcatcagggttccaactatggcagcggaatcccgatgtgagcgcttctgctggagggcctgagcaaggacggctgcatgcccctgtgttcctgctggtggaggggttgggataattccaatccaacgtggacggcaaatggagcccgatgtgagcacccatatccggcgtgccctgccatttgcgaccgccaatgcgatcggacggcggcaaactcccgacgtgagtgctcatatcgggaagcggctgccagccgccagggagcggtaatctgcatgaccggtccacctgcgcaaatacgaggactcgttcgcgcttccccaagaaccccgcacgaaagcactcacatcgggattccgctgccatgatgcgaacattgatgagcgtaatttcccacggggggaacatcgcccagccaagtggtccctctgccggctcagggggggtcgggccccagcgtcagtccgccatgacattctgacgccaaatggctccccgccgacacaccctgaaccgcctcccatttcttggacacggaaattgaagtccaaggaatgggaagcggttcacctatgcactcccccctcttagacaaagacgggggaatgggtcccgtagcgcgggaagccggcgggaggggctcgggcgacgtggccgtgcccctctcacccgtcctcgcgctaagctgggtgagagaagacaaccccatggcgcagcgaatcgatccacgggtcgacgcgcgcgccgagagaaggaggacacatggacggcatggaggatgacctggaggtctcgcgcgacctgatcgacttcatcgcgagctgccccagcatgttccacaccacgaggacgattgccggaaggctcgaggcggcgggctttgagcagcttcccgagggtgacgagtggcgcctggagcccggtggcacctactacgccacgcgcaacgggtccagcgtgatcgccctccgcgtgggtgacgccatggacgctccccacttccagatgacggcggcccacggagactcgcccacgttcaagctcaaggacgcccccgcgctggagggtcccgagggaacgctgcggctgaacgtggaggcctacggcggcatgatcgaccacacctggtttgaccgcccgctctccgtcgccggccgcgtgatggtgcgcgacggcagcacggtgcgcagccgcctcctcgcgcccgaccgcgacctggtgctgatccccagcctcgccatccacatggaccacgacgtcaacaagggctttgcgcccaaccgccaggtcgacctgtgcccgctcctctccgccggggagctgaaggcagccgacgtcgaccgcctgatcgcgggcgagctgggcgtggagccgcacgacgtgctggggcgcgacctcttcctggtcaaccgccagccgggctgcgtgtggggtgcggcaagcgagttcgtgtcgtcccccaagctcgacgacctgcagtgcgcgtacgcgtcgctcgcggcgttcctctcgtctcgcaacgagtccgcgatcaccgtgtactgctgcttcgacaacgaggaggtgggctccaacaccaagcagggggcactctcgaccttcctgcacgacgtgctcctccgcgcgtccctcgccctgggcatgaccgaggagggctacctcagggcgctctcgcgctcgttcctcgtgagctgcgacaacgcgcatgccgtgcaccccaaccacccggagcgcgccgacgacgccaaccgctgcaggctcaacggcggcctggtggtgaaggaggcggccaaccagctctataccaccgacgccttcagccgtgccgtgttccgagcggtgtgcgacgacgcgggggtgccgctgcagcacttcgccaaccgcagcgacatgcagggcggctccacgctgggcaacctctctaacacgcaggtgagcgtgcatgccgtggacgtggggctcccgcagctcgccatgcactccagctacgagaccaccggctcgcacgacaccgcgctgggcatcagggcgctgcgcgcgttcctctccaccaacgtcgccatcgacggagcggagtccgcgaccctgggctaggggagaggggccaccgccctcgcccgcggcccgtcccgccggcatgcaagcgccgccgcgcccccaacccggggatgcggcggcgccttccttgcttggctcgaacccgcgacgacctgactgccagctaggctacctgctgcgttggcgggacgtaggtctcgcccagggcacggcggatgtccaggatcgcctcgcagaacacgtagccgtggggtgcggaggtcctgaccagctttccgtcgcgatacgcgatcaggcggttgcgcgggacgggggaccatgcgtcggcctcgtcgggcccgcccaggggataggtgctgaacaccaggccgtcgcccacccgcctgaagtacagggtcacctcggacgtgttggtgtgcacgtaggtgtacgtgccgtcgtccaggatcacgttgagcttgttctggttgcccagctgcgacaccgcgccggcgagcgcgtcgaaggtctggtcaaagcccaggcgcccgttggagcgcagcgccgcctcgtccaccacgtcgaggaagaagagcatggcgcgctcgctgtcggtctggccctcctcacgctggtcgtagccccagagcatgccctcgttgaagaggatgccgttgtggatcatggtccagtcgcggccggtgatgtcgctgccgcgaaaggggtggcagttctccgggctcagcgtgccgcaggtcgcgttgcgaatgtgggcctgcaggtggctggcctcgatcggatgctccagcagggtcggcagaagcttggactcgtacgcggcgacgggctcgcgccagagcctcacggcgtcgtcggagtccccctcgcggtacatcaggccccagccgtgggggttcccgtggctgtggtcataaaactccgccaggtagcggttgacgttgatgggggacttggagttgacggcaaagagctcgcacatgatggcatgcctcgattcaatggtgtccggctagtacgcaaacgcgtgcgtacagcgacaacacatcgccaggcgtgccatgcgaacctccctcttccgtcttggttgctggcatcatagggcaaaacacccaccaggcaggtaggaataccctctcatcaccaactggtaacatttccgcgctttcgcgggcattggcgggggagagaaacgccccgccgggactggtggcaatcccagcggggcgagggtctctccctgtggcggcgccacgcgctacttgtcgccgaagctgatccccagctggcgcgcctcgcgcacgaggtcgctgctggtgtcgacgtacttgagcttgccggcgacctcctcgagcgggaccagggtcatggcgccgccaacctgcgcgaccatcacgccgaacgtgcccttgaggcaggcgatcgccgcctcgaccccgcactgagtggcgaagatgcggtcctgggcgtcggggatgccgccgcgctgcgtgtggcccgggatgcccacgcggacctcgcgcccggtcgccgcggcgatctggtcggcgatatcataggcgaccgacgggctggtgcgtgcggcgacgcgcgccttgtactccttcttgggaagagctgcctcctccttgctgatggcgccctcggccaccgcgacgatggcaaagcggccgccgtccttctcgcgcttctcgatggccttcaccacgttgtccatctcgtacgggatctcggggatcaggatgacgtcggcgccgccggccacgcccgcgtagagcgggatccagcccaccttgtggcccatgatctcgaccacgaagacgcggccgtgcgagctcgccgtggtcttgatctcgtccaggtacttggtcgcgacgtcgatggcgctcgtgaagccaaaggtgaggtcggtgccgtaggtgtcgttgtcgatggtcttggggagggcgatcacgttgaggccctcctgggcaaggcggttcgcggtcttggtggagccgttgccgcccagcatgaacaggcagtcgagctgcagcttggcgtagttcttcttcatggcggcgaccttgtcgacgccgtccgcctcggggatgtccaggcgcttgaagggcgtgcggctggttcccaggatggtcccgccctgggtcaggatgcccgagaagtccgcccaggtcatggtgcggtacctcccatagatgagcccctggtagccgtcctcaaagccgtacaccttcaccggctccttggacttgttcatgaccgtcttgacgattgcgcgcatcgtggcattgagggcctggcagtccccgccgctcgtgagcagcccgattctgagcatggttcttcctctccgcaggtaaaccacccgacgtgatgattctctcacagttggcttgccgcaagcttgcacgtggctgccctgaccgtcggctgacacgcagcttacgggagtgccgggggagagggacgagccgcgccgctcgccacgtcacccgccggcatcccgtggggcggttggacccattggttccacgaaacgatgggcccgcaggcgtttccgcgctggcgtcgcgcgagggggtggcgccgtccgaggggcagacggcgccacgggtgcgatgcggggcgtacgggtttggaaaagaggtcacagaatggtacgccttccctcctgagcctggagaagggctttggcgagcagcctggttgggccatgatgggcgggcctccccgtgcgcgcgagtgtgcctggctcggaagggctgcgtctccacgggcttggggcttccagggcgtggcacggcgctatcaccacaagctcaaggagagccgggcgtcatggggcggatgctcggcaccgcttagcgccattagctctcgtgtggatttccgtactcgacgcttagcatccctagccctcgtgtgggcttggcgacgagaatccacaagaggcctagtggcgctaagcacgaaggagctaaatcagcacgaggcctaggattgttaagcatgaaggggccaaatcaacatgaggcctaggggcgctaggcattgcgggatccgtacgatttctggagcgtgatgcttaaccctgccggtacccgtacgggttgtgcgtccttgatgcttaaccctcccggggcttgtatggatttgggagaaaaatgcttaactctcccggggcgcgtatgggtccggtcgtccgcaatccgcgcaggcaccgagttttctaagcacgtccccgccgcaatccgtgcgggcaccgggatttctaagcacctgccgccgttgacggaaatcatgcgcccgctggcttttccgtgcgtcccggcaggctcgcggccgcatcccgctgcctcgctcccgccgtacccgtgcgccacgccattcccgtgcggaggcaggccgctccgtccattcactgacttcctcgcatgggcggctggttagccagacgcgacgagttgcgctgccgtgtgccggagaggtgccgcttcctcgcatgcgtcagctggggagaggcccaccccccgctggggcgggcgacaagctttggcagtgcgcgtctctcccgttattggacgggaatcgtcgggcgtcccacgtcgccccggtgtcagccctcgtcgccctgcggcctcacgaggatggggatgttgtccagccggtccgcggcgtgctgggggaggtacatcgtcaggcgggcgccaccggtgggaaagtcggcccacccgtcgtcgccgatcgtgacggtgccgtcgcagccaaggacgcagcgccacgtctcgcccgcatgcccctctcccacgcacatgcgctttgtggcgttccccttgcgggtggaaagcagcacggcggcccccgaggacccgtgtcgcgccgtgccctcgcgggtccagcccaccaggtcgcgctcgtcgaaccagtcgcgctgcgtgccgtacgcaaagcgcctgcgaacctccatgaggagctcgagctcggggacggcagggatgccgtcgttggggaggccgaagaggtcgctcaggaacacgcaggggtagccctcctcgcgcagcaggatcagcgcgtaggccaggggcttgaaccacggctgcacggtcgattccagcgcctggtcgggctgggtgtcgtggttgtccacgaacgtcaccgcgtggacggggtcggcgcccaccaggctgccgtccaggatgtgtgccaggtcgatgtcgtcgcccgcggtggatgcgcggtagaagttgaagtgcagggggacgtcgaacaggctcatcgcgcgctcgttacccaggtaggccagcagctcccccaggtcggcggaccagtactcgcccacgcagaacagctcccggcccgtcgcccggcgcatgctgtccagccagcccaggtagaaggagcggctcatgtgcttgacggcgtccaggcgcaccccgtccacgccggtgagggagaggtaccacttgccccacttgtcgagctggcgcctcacgcgctcgtctcccaggtcgacgtccgcgcccatcaggtagtcgaagttgcccatctcgtggctcacgtcgcccgcccagtccttgcccaggaggcggaacacgcccgtctcctgcgtcgcctcgtcgtagtcgacgcccgtgaagcaggtgctgtcccacctgaagccgtcgagcctgcccgcgcggcccgggaagtcaaagcgcgtgtacgcctgtatctgccttggttcgcccacgggttgcgtgcggtcgtcgccgctgacctcctgggccatgaccttctgcgcgccgtccgcccccatgcggtggttgagcacgatgtcggccaggacgtcgatgccctctgcctgtatcgccttgatggcggagaggtactccctcctcggcccgtacttggtgcggacggtgcccttctggtcaaactcgcccaggtcccacaggtcgtagacgccgtagccaacgtcctccgagcccgcctggcccttgtatgccggcggcatccacaccgaggtgaagccctcctcgcggaggcgcggcgccatctgcgcaaggcggcgccagtgctgcccgtccgaggggaggtaccaggagaatgcctggagcatgagcccgttcttcgtgttgatggccatggcgacctcctcgtccgttccccgtgcctgtgctggcgcaaagcccagaggggatgatacccaagggcgagaggggcccaacacgcccctccggctcaccacatcccgtcggatgccgcattttccaaatacctacttgcaaggtaggaatattcgtggcaccctactagtcgcgagcagacggcggcatgcgtgccgcctatcaactcgcatccagtgaagagcgtcacagtctaggaggcaccaccatgcaggttgcaaaccgcgtcgagtccttgattggtacaacgccactcgtgaacctctccgccctcgtggacgggaaggccaccgtctacggaaagtacgaggccaccaaccccggcggatccatcaaggaccgcattgccaaggcgatgatcgacgccgccgaggccgacggctccctccagccgggtggcaccatcatcgagcccaccagcggcaacacgggcgtcggcctcgccatgctcgccgccgcgcgcgggtatcacatgatcctggtcatgcccgagaccatgtcggtcgagcgccgcaagctcgccgcgtcctacggcgccaagatcgtgctcacccccggcaaggagggcatgaagggtgcggtcgcaaaggccgacgagctcaaggcccagacgcccggctccatcgtcgccggccagttcgtgaaccccgccaaccccaaggcgcactacgagaccactggccccgaggtctggaaggacaccgagggtgccgtcgacgccatcgtggcgggcgtgggcaccggcggcaccatctccggcactgccaagtacctcaaggagaagaagccctccgtcaagggcgtcgcagtcgagccggccgagtccgccgtcctcgagggcaagcccgctggcgcgcaccgcatccagggcattggcgcgggcttcgtccccaagaccttcgaccgctccgtggtcgacgagatcgtgccggtgacctccgacgacgccatccagaccaagaagcgcctcgcgtccgagttcggtctgctcgtgggcatctcctccggcgcggccgtcgcggcggcggttgccctcgcccagcgcgacgagtatgcggggaaggtcatcgtcgccattctccccgacaccggcgagcgctacctctccatggacctgtagggagcgggcatgtctcaggcggattctttgagccgctccgagcacacgacggaccaggggtcgcgcgagaggcgcggctcctggctctcgcatatgcgcgaggacgtggccgcaatgaggaggagggatcccagcgccacctcggacgccaacgtggtcctcttctccaccgggctccatgcgatctgggcgtaccgtcgccagcactggctgtgggagcacggcgcaaaggggctcgcgcagttcctctcgcgtaggtcccgtcgtcgctatgggatcgagatccatcccgccgccaccatcggccgtcgcttctccatcgaccacggcatggggatcgtgatcggcgggacggccatcatcggcgacgactgcatgctgtaccagggcgtgaccctggggatgaccgggcatcacggcggcaagcgccatcccacgctcggcaacaacgtcatggtgggcgccaacgccaccatcctgggtgacatccaccttggtgacaacgtgaaggtcggtgccggtgccgtcgtggtgaaggacgttcccgcggacgtcacggtcgccggcgttcccgcgacgatcgtgaaggagcatcgctgctgggaggcctcccgtctcacgctcgtgaagctggaggacctggacaacgagaacgtccgctggtcctgcgcgttgtagccgccggatggcgggatggagaaatgacgggattcgtctcgcctgattagcgatcccgacgaggggaatacaagagtacgtgcacagggcaggtccccagagccgcgggtgtttccctcggcggggtccggtagcccgaaaaagtgggggctccgtggtttcgtccggggccctcgtccatatggacgattctctttcgactcctcccgttgcctttcatttgtgccgggtgcttagcatcgctagcctctgcacgggtgaaatgccgaaaactcgcgtgggggttgggctcgccaggcacctctccaggcgtctcccgttcccgcgggcctgttcccggccatgctacgaacttgctggcaccaggcttgctccctgggccatgccaaggcgggtctcgcctatcatcgttgggagaggcatcccgggacgcgcgtgccgcatgggtgccgcaggcaacgtcgatgggggaggggagagtgcccctctcgcttgggaggcccgtatggaccagagggacgtgagcagggggccgcgcgggacggcgaggatgctcctcgcgcttctcgcctttgtcggggcctttgttggcgaggcaatcctgggatacgccttctacgacctgggcatggacgagaacctcgcgttcaccctgggtggggccatcgccgcggcggtcctggtgtgcgcgctgggcgggcggaggctcctgcggccgacgcgccgcggggtgggaggcatcttccgcctggggtggtggctcctcgtcgtgagcgcgttcctgggcggcatggacctgtactcgttcatgcaggacccgtcgcaactctcgccgcactgggccgccaacgtcgccaacctggcgctgctctgcctctgcatcggcatcgaggaggagtgcatgttccgcgcgctcctgctgggcggcatgcaggcgcgccttggcggtcgtcgcggcggcctcgttgtcgcctgcgtgttgagctcactgctgtttggctgcgcgcacatctcgtttggcgatgtcgcgtggggagacccgctgcagtccggccaggcggtgctcaagatagcccagaccggcacctacgggttcgtgctcgccgtcgcggtcgtgcgtgacgagtcgatcagcggcgttgccatcttccacgggctcgacgacttcctggtgatgttcgtggcaaacggcctcctgggcgaggcaaacaccaccaactacgtgtcgagcggttcggatgccgcctacaccctcttcttctacggcctcgtgaccatcctctacctgcctgtcgtctggcgcgccgcgcgagagctgggccgcgtgcgcatcccctgccgtggcgccttctaccgtgcgggccatcgggccaacggccccgcggcacccgttccgcccgaggggatgggccttggagccccgatgccgcgacacctctcgccaggggagaagcccgtggcaacctcgatggagggcgcccccgcatggcgggacgagacgcgcgccagcggcgacgattggatgggctggtcggagtgaccccaggggtgcgccgcgccgccccgcgacatgggggtgccccgcacgccggcggaggcggacggggcaccgtgcgctcgggtctctcccgtggcgctagttgaacttgaagatcttggcgaccgttcggtagatgacgaccgttgcgagcttgccgcccctgccggggaggttcgtcgccaggccgcagatgcccaggcgtgcacgtctccacatgcggcggtcgtagtcgtggagctctgcccacaggtcgccgagctcgtccatggcgtcggggtggtcgctgagctcgctgaagaccgagcagatggccatcatcagcacgaagtagttgaccatataggcgcgcagcgcgtagctgtcgatgtcgtcgtacaggtggtaggcgtgcatcatgatgcgcgtgatgcgaacctgctggtcaatgcgccccgccatgaccttctcgttgacgctctggtcctcgcggccgatgaagtagtggtacaggtccacgtccaggtagtagatggccttgcagcgggggagagggacgtaggcatagatgttgtccacgtagaacgtgtgggccggcatgggcacgccaccgtcgcgcaggacgtccgcccggtagcagagcgagtgcatgagcaggttctgcgacatcatgaagtggcccatgtcgttccagcggaacgtcctgcccacggggagggcgtggcggtagttgaccgcgtgccgcttgccctcgaaggtgtggtcgtagatgtagttggtgatcacgaggtccacgcgctcgcccaggcggtcgaactcgcggagcttgtccatcagcttgggcagcgcgtccccgtctagccagtcgtccgagtcgaccaccttgaagtaggttccctcggcaacggagaggcccttgagcaccgcgatgccgtggcccccgttctcctggtgcacagccctcacgatgtccgggtaccgctgctgccactcgtccgccttggcgggggtgtcgtccttctgggatccgtcgtccacgatcacgacctgcacgtccttggcgtacgaggtcccctcgaggatcgactgtatgcagtggtccatgtactccgccgagttgtagcaggggatggcgaaggtgatgaccttcttcattgtgtgcggcctcctggtcgtgttgccggcgcgttgcgccgcgcttgcgagaccattatggcacgtgtgggcgaccgtgcaggtatcgcgtccgtctccgcacgaaggcccatgtctgcccgtcgccccgcggcgtctggtttgggtctgcagcgtttccctccacctcgtacctcgcacgctgcgagagaatggacgcgttggccaaacgacatgtgggggagagggagcatggcgacgtttctgcattccagtctggtgtacgggccggtccacagcaggcggctcggggtctcgctgggggtcaatctcaacccgacggacggcaagcactgcagctttgactgcgtgtactgcgagaacgggaccaacgcccagcggaggacgagcacgcccttcccgtcaggggagagggtcgtgggcgcgcttggggagaggctgcgccagatggccgccgagggcgtctcacccgacgtgatcacgctcgcgggcaacggggagcccaccctcaacccagactttcccgaggtggtggacgggacactccgcctgcgggacgggctgtgccccacggccaaggtcgccgtgctctccaacgctacccgtgcgggcgacccccgcgtgcacgccgccctcatgcgcgtggacgacaacatcctcaagctcgacaccgtggaccccgacgccatccgccacatcgaccgtcccgtgggtccctacgacgtggaccaggtggtctcgaccttggcatcgtttggcggccacgtgatcgtgcagaccatcttcctggggggagaggtcgacgggcagcccatcgacaacacgggcgagaggtacgtggggccttggctgcgggcgctcgagcggatagcgccgcaagcggtcacggtctacaccatcgcccgcgagaccccgtacccgggccttcgcaaggcgccgcgcgccacgctcgatgccatctgccagagggtgcgtgacctcgggattccctgcagcgcatcctactagccattgggtggcgttgggatggcgtttgtttgtggcagtcctgcgatggggagaatcccatcaggcacaggctgagaggggatgccatggacaagagtgacgcgcgcgagatcgacgaggccatcgctgccggcgaggacgccctggcaagcctcgaggaggcgcgcaggaccctcaagagcgcaagcaactggggcctggcggacatctttggcggtggcttcatcaccacggcaatcaagcactcccgcatcgacgatgcccgcgaccagatagagcaggctcgccgtgacctcgtgcgcttctcgagcgagctcagggacgtccgcaacctgaacctgcccgacatcgacatcgacatcgacgggttcctctcgcttgctgactacctgtttgacggagcaatcgcggacgtgctggttcagtcgcgcatccaggacgcgctcgaccaggtcaacgtggcgaaggcacgcgtcgaggagatcgtggcgaccctgaaggagcggcgccgctaggtgtgcacgatcaccttgtcgcccaccttgaccagggagaagagctccgccgcgctctggctcggcaggttgatgcagccgtggctcccgttccactggtagatggtcccgccaaacgagctgcgccacggcgcgtcgtgcagtcccaccgagttgcccaggaacggcatccagtagctcaccttgctcctgtagtcgggctccccgtccttgtcctcgtcggccccgatgagggtctggtcggtcatcttgttgttgatgctgaaggttcccgtgggggtcgcgcggccctcgctggtgtcacccgagacaaagtacgagcgccagatgaccgtgccatccgagtcgtagaaccgtgcgtactgggtggccaggttgacgtcgatgtggcgcccctgctcgcgggccccctccgactccgccgggcgcgtccccacgagcgtgcgggggatctcgatggcgtcagagctcgcgttgcacaccgcgtcgaagatgctgccggcaagcgagtcgccgtccagcgcccagtcgtgctcctcgtccgacgaggcgacctggtctgccagctggtcgctcacccagctggcgatggcgtcgcggctcacgtcgatctgcgtcccgttgctcacgctcacccagcccgagagttggtcggagcccaccgtggcaagcgtcttcccgtccagcgagagggggatcctgagggcgagcatctggtttgcgcgcttgagggtctcctgcagggtggcgtcgtccttccccagcgagggctgagccaggacggagtcgtccagcgtgacgtcggtggagagggacgcgaccccggaggcgacggccttctccaccgcatcggcgtcgagcgccgtccccaccgcctcgtccgtcgcgacgaacgccttctgatccgagctgtactcgatccccgcgttggtgggctgcgtggcgctggcgttgtacgcctcgaccgccgccgccacggccgccttgagtgcggcctcgtcgtagctggtcgcctccgtcacgtggacctgcgtcttctcaaacaggccgagcggccagcgctccgggtggttcttgtccatcgccccacgcgcgtacgtcgaggcgttcgccttgagcgagacgtccgacgccttgagggcgagggagaagccgttgggcccctggaccctctcctcccagccggcgatgccctggttgaccagctgctccagagtcgcctggtccatggcggagacgtccgtgccgttcacggtggtgccggggacaaagtgggtggagaagaacgcgaatccgatggcgtaggcaaccacgagggctccggcgacgatgcagagcgcgacgaggccgcgcctcctgcccctcttcggggtctgctcgggctgcttgctggggtccggggcggcgtgcttttgcaaggtgcacctctcaggggtggggcggaacattacgcgctccccttcccaccggcctcgcgagggggagagggactgggtgcgcacagttgcagagtgtagcgcatgggccggacacaacgcgcggccctccggcctgtggcctacctgaggagtgccgaggacgtggcgtcgaagacctttgcctcgagcccctcgagggagtccgtctcgtcctggtccatgtcgcgcgtgcgcgcggcgtcaaagtcgtcgagtgcgtcggagatcgccttgaggatgcctcccgagtccggggcgagcgtggcgccggtgaccttgcggggacggcccgttggcaggtacccgtcgtccgcggtggcgtcgtcctcctcgtcgtcgggcgtgggcgcattcgtgctaacgtagccgcgcgaccgcagctttgcgagggatgccgacaccgacatggggctcgatcccacgtagtcggccatctcccgggtggagccggccgtctcgcagtacatgaggtacaccagcaggcgcacgtccttcacgtcaaggtcgtactgcgacgcgacgttgtccaggtagcggtccaggagcttctgctccaggtacagcctgcccagcgggttgggacgcatctgggggtccacgtaggccctcgtgtgctccctccccagcttggtcgaccccggacccgggagcaccgccccgtctccggcggaggtgaggaagaagcggtagatgtcgagcctgcgccgctggtagtcgcgctcgtcgtagatcgcctggtagaacttcttgtagtactcgatcaccgcgagcttcatgcgcacggtgccggggaggctcgcgctcgttgcgacaagcgaaccctcggtcttaacgtagtaatagagggggacctgcagggggtagatgagacgcgtgtgcagcacgtactccatgttgaagatgaagtcctcgcaccagctgatgctggggtccatcctgatgtggaactcctcgacgatttgcctcttgaacagcttgttccaaacgaccccgtagtagaagtcgctcggggcctccatcatgaggtcggcgtactcctcgcgcgtgacgggacggtccacgtcgatgtcgcccttgcgggcggtgcgggagcccaccacgcggtagaagtcgcagatcaccatgtcggcgccgttgtcctccatggcgcgcaccaggagcctcgtggcatcgggtgcgatccagtcgtcggcgtcgaggaactgcaggtaggttcctcgggcaaggtccatcgcggcgttcctggtctccgagacgccgctgttatcgcggtgtatcaccctgacgcggtgatcctcctccgcatacgagtcgaggatggcgggcgaggagtcggagctgccgtcgtccaccaggagcagctcgaagtccgtaaagtcctgccgaaggatgctgtcgacgcagcgtcggagggtaccctctgcgttatagaccgggacaatgatgctgacctttggcatgtcgcctcccacgacgcccggggccatccccgggatgaccaaaacagtgtaacgcgcaccgggagtcgggacgattcaagggcgggggagaggaacgcccgacacagcctcggcggcccctcccgccggcatctacctcgccgcttggggccgtggttcgctcgaccagccatcgcggcggggacggtgggcgcgggtaaaagaagggggcccacaggtagggcgcagtggggcccggcactgcccgctctcgtaccccggctggtggcatgtgccccgtccggggtggcggcttgcgtcaaacgttccagggtgggggtggcgaaaaggggttggggagcaggcgggtgcccaggccactgcgggggcctccggaggatgccgccccgtgatgtgcccccgtccagcggagcgtgacgacctgcgaaggcgtacctcccagatgggtttcgaccccgtctgacacgatcctcctcgcgtcctttggctgtcacctacccgcagcgggatttcgaggacccgtcgcagaggcgtagcgatgaccttcgatagccaaagaaggagggggcacgctggcagatagcgccgccggctcaccgagcggctgtcgcaagcctcggcgggcccatttacgcatcaaggcctgaatcatggcagccaaagcccaacatgagtgccttctgaacttgcgctcggttcgcggaccgcgttgcgttagcgttccatcaggtagggtggatgggatgggctctgctctcttggctggcggcggcaaactccggatgtgcgcactcacttcgggagtcctctgccaagcaacccttcttccagatcaaagtggcaatagcctcctgacgtgagtgctcaccccgcgagcttcttgccatctctcagggactgcccggtcgccaactgggaaaacggtcagcaacgaagattgcgcccgcacaaatgtgctcacatcgggagatggcagacacgggtcggccaaacacgaggtcgagggccccgtgggggcgattgccccatgttccgatgggggcaagagcctcgcgtgagtactcgcacgtgcgacttgctgccaagctcactcaccaacggagtgctgatgctgtccattccctgactctgatgccccatcgtttgcggtagagcacgggctttccgctctccctcccgcgtgaggagacaccctacccgcagcgccgcgcgcgtgccttatggaacggatggcaactcgcccctccttgaccttggggacttacatcccgtggtggagcgtcggctctccctctctgcagcccctgttgccccgaaactccaagcgcccgcggcggcatcggtgccgtcgcgggcgctttttactctatgggggtcgagccctagttgccgctcgtggtgttcgtggtcgtggtggtggaaccggtgctcccggatgcaccggaggacgagccggatccgctggtcgagctgccggagccgttgtcggtggtcgaggacgagccggagcttccggagccggagttgtcggtcgtggtcgaggacgagcccgagttgtcggtcgaggacgacccggagctgccgttcgagccggagttgtcggtcgaggacgacccggagcttccggagccggagttgtcggccgtggtcgaggacgagcccgagttgtcggtcgtagacgacccagatccactgttagaaccaccgttgtcggtggacgttgagccggagcccttctcgtcctgcttcgccttggtgtcctcgggcttcgcgggagtgccgttgccctggtccccggtcgtctggtcggtggcctcctcgtcggtgaccgtggtggtctgggctgtcgtggtgccgatgcccttgccctgcgtggcgaccgagacgatcgcggcgtaggcgaggaccgccacgatcgagacggcggcaagcacggcgaccgtgcccttggcgacctttttgctgtgccgcttgctagcgcgctccctgagcgactcgggggcgatgggcgtgcccgtctcggctacgttcgtctgagagaggggttgcgtgaggtcgcgggtgagctcggtggcggcggggcgcacggtggtcgaccctgcgtcagctcggccgacctggccgggcatgggctgtgtgaggtcgtcgtccgagctgtttgccaggtccttgatcttcttggcggatgcggagagcatccccttgtacacctgcgtggcgatcgcggacgcggcggctgcgacgccgacgccgatgacggagccggccatgccgatcttcgacgagagggcaaacgacgtcgcggcggcaagggcgctggcgatcacggcggacatggagaagtcgctcaggatcccgcccttctcgtcctcctcgtcatcggtttggttcgagggggtgcctgtgggcgagaccggcgtggggttgctttgatagcccgagtaggcttgggtgcgataggccccgtagggatcgtccctcgaggtgtcatccccggtctgtcgctcgttctgcactcgcgatcatctcccgtcaggtcagtcgttttcagatgaggtaccccgtgactatagcgaggcgaacccgtggggacggcatttcacgaagactggacaagaccctcgccccactgacacgaccgcaatcttgcccgaccgggggagaggaccgacaatgtccagcgattgggatgcaaactttcgaagtcttgcatatctgggcccaaataccagttaattatggctgggcgggacttaatcggggttggacgcggtatcatccccttgtacgtgcgtttgcgtttccaccaacaagatggaggtaccagatgctagtcaacgccactgcaatgcttcagagtgccgagaagggccactacggaatcggtgcgttcaacaccaacaacctcgagtgggcctcctccatcctcgacgccgccgaggcgctccagtcccccgtcatcatccagtgcacgagcggcgccgccaagtggcagacctcgttcaaggtcgtttccgacatcgtgcatgacctcgtcgaggccaagaacatcaccgtccccgttgccctgcacctcgaccacggctcctacgaggcagccttcgagtgcatcgaggccggcttcacctccgtcatgtacgacggctcgcacgagcctgacttcgagaccaacctcaagcgcaccgccgaggtcgtcaaggcagcccacaacaagggcatctccgtcgaggccgaggtcggcggcatcggtggcaccgaggacggcgtgacctccgccggcgagctcgccgatcccgagcagtgcgccgccatcgcggacctgggcgttgacttcctcgcctgcggtatcggcaacatccacggcatctatcccgccgactggcagggcctctccttcgagcgcctgcagcagatcaaggccaagaccggcgacctgcccctcgtcctccacggcggcaccggcatccccgtcgatcagattcagaaggccatctcgctcggcatctgcaagatcaacgttaacaccgacctccagctggtcttcgccgaggccacccgcaagtacatcgagtccggcgccgacaaggagggcaagggctatgacccgcgcaagcttctgaagccgggccgcgaggccatcgtcacccgtaccgaggagctcatcaaggagtttggctccgagggcaagggctggaactagatcagttacagtacgtggcactttgcagggagccggccgatggttggctccctttcttgttagtgtcgagtcatgcagtggtggcgtagattgcgggaacgctgccaacttggactatccttgtgaggtctgaagtcagcaaagggccaagcgcccagacaatggagatgcacatgagacgcagaacagtcgccattgccctcgccctggcggtaggggggtcgggcgtttttgtcgccccggccgttcccgccctcgcggaggacacgacgacctcgtccagctcgacgagcagcctccagagccagcttgacgcggcgaacgagaagctcgacgagctgagcacccaggtggcgagtgccggcgagagtctgaacgacacaaagtaccagctccagcagacggagcagcaaatcgaggacaccaagactcagatccaggagaacaagcagaagctctccgaggcacgcgagacgctctcgaagcgcgtgagcgccgactacaaggcggggaagacctcgttcctcagcatcatcctcaacgcatccaactgggacgactttctcagcagggtctactatgccgacaaggtgagcgagtcggatgcggcggcaatcaaggaggtcaacgacctccagagctcgctcgaggagaagaaggcctcgctcgagaaggaccagcaggagcaggaacagctccagtcgcagcaggagcagcaggttagcgacctcaaggcaaaacagtccgagcagcaggactacgtcaactcgctgagctccgagctgcaggcggccatcaagaagcagcaggaggaggagatcgccaagcagaaggcggaggcggctgcacagcaggcagccgcaaaggcacaggcagaggcggccgccaaggcgacgtccaactcttccagttccagctccaagtcaagctcgggctccagctcaaagtcaagctccagctccaagtcaagctcgggctcgaactcaagctctaactccggctccaactcgggctccaacaccaacgtgagcgggggtggcgggctcaccgccagccagcgctccacgatcatcagcgcggcctactcccagctcggcgtcccctacgtgtgggcggggtcgaccccgggggtcgggctcgactgctctggtctcacacagtacgcctatgcctgcgcggggatctcgatcccccacagcgcagcgggccagtacagcatgtcgtctcacaagagcaagtccgagtggctgccgggcgacctcgtgttctggattggcggcgtcgccagtgggtctggcaaccacgtggcaatctaccttggcaacaacaagatcattcatgccaacggcacgctcgtgaccgtctccacgctcagcagcagctacaccacggggggcacgcccaacgcatagcccgcccacagggggagacgagaagggggccatccggagattcggatggccccctcttgttagaagaatctgccgacggcagacgatttcagcaggcggtgtttccgctcggccttctcacgcggctgtccttgggatgccagtccgtgacccccgaggtccgcgtcttgtcgctcacgatgtccgcgagcgtcttgctgtccaggtactgtgcggtgaccttgcccaggtcgcgccacaccgtcaccgtgggacacgagtcgattatgggacagatctctccattggtgcagtccaggcaggcaacgggagcgagagaaccctccgccgcgcggaggatctgccccagggtgtattcctcgggcttgcgggtcaggcggtagccaccccccttgccacggcagctctcgacgtaccctgccttgtgcatgagcgagatgacctgctccaggtacttgcgagaaatgttctggcgcctcgagacgtcaccgagggacacccatccgtcgtgcgtcgccaggtctgccatcgctcggagcgcgtactttcccttcgtggagaacatgccagccatgcttgggcctcctttcggcgttctctcaaaccctcgtcagcgggtctcgccggactgggggagacgagctagtccccgcagtcgcagtggtcgtggtctgggatcgaggccgtcccgctcgtctcgccctgctcgagcatctcctcaagcgtgcgccatgcaagctccgcgcacttgacgcgggcgggcatgtgactgatgtccttgagcatggcagcctcgtcaagctgctcgatcttctcggggtcggtctcctcgccacggaccatgcggccgaacagcttgcagagctcgatggcctcctggggggtcttgtccaccatgaggtcgctcatcatgtcggcggacgcctggctgatggcgcagccgtgcccctggtaggaggcctcctcgattctgccgtcgtcaccgatccttaccgagaaggtgagctcgtccccgcacgaggggttcacgccctcgtgggtcatcgtggggtcgtccatcacgtacttgtagtcggggtgcgagacgtggtccatgaactgggcgttgtagaggcccgttacgccgttgctagttgccattgaacacctgccaaaccgtcctgaggccctcgaccaggcggtcgatgtcctccttgtcgttgtagaacgccacgctcgcgcggcaggtgctgctctggccgagccaggcaagcaatggctgcgcgcagtggtggccggcgcggatgcacaccttggagccgtcgaggatgctcgcgacgtcgtgcggatgcacgccccgcacgttgaacgcgacggcgcccacgtggcgctcgccctccagggggccgatcacgtcgacaaagtcgagtgccgacaggctctgggtgaggtaggaggcaagaagccgctcgcgccgctccacggtgtcgatgccaatactctcgaggtaggtgaggtcggcgtcgaaggcatagctgcccgccgcgtcctgggtgcccgcctcaaacttctgtggcaccggtgcccacaccgcgtcggtctcggtgacggagtcgatcatctcgccgcccgtgaggaacgggggcatggcgtccaggatgtccgccttgccccacagcacgccgatgcccatagggccacccagcttgtgggcgctgaacgcgaggaggtcggcgcccagttcgtggacgtccaccttgaggtgcggcacgctctgcgcgccgtccacgaccatgtaggcgcccatctggtgggcacggtccgcgatctggcggatggggttctcaacgcccaggacgttggacacctgggttaccgaaacgatctttgcgcgcgggccgatcttctcctcgatctcgtcctgcgtgatgcggaagtcgtcatccgcgcgcaggtagacgaggcgggcgcccgtctggcggcagacctgctgccacgggatgaggttgctgtggtgctccatgatggagatgaccacctcgtcgccgggcttgaggatgcttgcaccgagggtgtgggcaaccaggttgagcgactcggaggtgttgcgcgtgaacacgacctcgttgccctgggggttgcccgcctcgtcgaccgcgccgatgaagctggcgatgtgattgcgcgcgtcctcgattgcctgcgtcgcctctacggagaggctgtagaggccacggagcggattggcgttcatggtctcgtagaagcgcctctgggcgtcgaggaccgccctcgggcgctgcgaggttgcggcgctgtcgaggaacgtgaggtccgggttgttggcgagcagcgggaagtccttcttgtacgggcttgccgtgatggctgccagctgggacgaatcgagcattactcctccttgggatcatccgcgctggcgggctcgatgcccaggccggacgcgaggtcgtgtgccatgtcgtctcccacgacggtcgccgctcggtcgagaacggctgcgagggactgctgctccggagcgtggatcacggcgtcgtcgaacagcgcgcgtgcgaacagcgcctcggcctcgccgtccgagagccccctgtcggcgaggtaggtcatctgctcggggctcacggagccgatggatgcgccgtggttgcccgccacgtcgtcctcgtcgcacaggatgaccggaagggtcctgttgacgatgtcgtccccggtcacgagcacggtctcgcgctcgttgcccttggagccgtgtccgccgtggcgcaggtcgatcgtctcgcgcatggtcttctgcccggcgtctgcgagcacgccagacgtctggatgtcgcagcgcgtgcgctcgccgcgctggagcacggcgtggttgacgtcgagaacctcgtgatgccgcacgatgtagcgggagtccaggttcagcgtcgcggcgtcgcccgcgaggtcggcctcgaagcccacggccacgcgaccgccgcccaggaggtactggcgggcgtcgaccctggcgccgtcctcggcggcgaggccgatgccctccaggtgctgtcgctcgtctcccatggcgacgacctccaccaggtgcacggtcgcgcccttctcggcatacacgcgtacgaggttcgcggaggtcgcgacgggggtgggggagaggggcgcgtcgccatcggagtcgcccgaaccgtgactcacgacgacgatggtcgccgtggcgccgccccggaccatgacgccgctgtcgcgcacctcgccggcatcggcgtcgcaggagaggacgatggggtcctctcgcacggtgccgcgcggcacctcaacgtagcgcgagtctcccgttgcggcctcgacccacgacacggcctcggcgcccacgcccgcaccgatgcgggagaagagtcggggtagcctcgttggaacggtgccggcgctcgcggggacgggcaccgagagggctatctggtcgatcttgaggtagttccaggtctgcgcggggggaacgttgacgtgggtgagggtcatcgccccggtggtcccctccaggccagttgaggttgaggccattagccgatcgccccttccatctcgagcttgatgaggttgttcatctcgacggcgtactcgagcggcagctccttcgagaccgggttggcgaagccgttgaccaccatggtgcgggcctcctcctcggagcacccgcggctcatgaggtacaggatcgtgtcgtccgagatgcgcccgatcgtggcctcgtggccaacggaggcggtgcggttgcgcacgtccatcgcggggatggtgtccgagcggctgatgtcgtcgagcatgagggactggcacgagacggtgcaacgcgcgttgtccgcatggcgccccacgaccacggagctgcggaaggtgttgaccccaccgtccttcgagatggacttggcgctcatggacgcacgcgtgtcccgtccgttgaggatgaccttgcaccccgtgtccaggtcctggtttgcgccggagaaggtgatgccggtgtactcgcacaccgagcggtcgccctgcaggatcgtggtggggtagaggtacgacacgtggctgccgaacgagccggacacccactccatcgtcgcgtctgccccgacgcgggcgcgcttggtgttgaggttgtacatgttcttggaccagttctcgatcgtggagtagcgcagcctcgcgccgtcgcccacgaagagctccaccgctccggcgtggaggttggcctcgtagtacttgggtgcggagcatccctcgatgaagtggaggtttgcgccgggctccaccacgatgagcgtgtgctcaaactgccctgcgccgctcgcgttgaggcggaagtagctctggagcgggtagtcgagcgagacgccctcgggcacgtacacaaaggagccaccggaccacaccgcatagtggagcgcggcgaacttgtggtcggtcatggggatgagggtgccaaagtacttgcgcaccacgggctcccactgggggtcgtggatggcgtcctcgatggtggtgtagaccaccccctgcttggcgacctcctcgcgcatgttgtggtagacgatctcggaatcgtactgggcgcccacgccggcgagcgagtcgcgctccgcctgcgggatgcccaggcgctcgaaggtgtccttgatgtccgccgggacgtcgttccagtcgcgcgcctgcttggtcttgggcgagacgtaggtcgagatgtcgtccatgttgaggccggaggtgtccgggccccagtttggcgccatgtcgatgtcgtggaagcgctcgagcgcctcgaggcgcatcttgagcatccagtcgggctcgtccttcttggccgagatggagcgcacgatgtcgggcgtgaggccatcggcgtagcgctcgtagccctcctcgctcttcacgaagtcgtacagcgagcggtcgacgtcctggacctttgacctgcccctctcgtccacctccgggcgcgtggtgaccctgtccttctcgtctgccaccttacgcctcgaccttctcgccctggctggcggcgaggctgtcctcgtaggtgccgaagccgttgcggtcgatgtcgtcgatcatggatgcggggccctctgccacgaggtgacccctcaccatcacgtgcgtgcggtcgacgttgaggcgctcgaggatgcgcgtgttgtgcgtgatcatgaggagcgcaccgtcgcaatcgcggcgataggcctcgatgcccttgctcacgatggagagggcgtcgacgtccaggccggagtccgtctcgtccaggatcgccagcttgggacggagcaggaggagctggagcatctccaccttcttcttctcgccgccggagaaaccaacgttgagctcgcgggtgaggaacgactcgtccatgtcgagctcggccataatctgccccacgcgctggcggaacttgcgcgcggtggtcttgagctcgggcctcatctggcagatggtgcgcagaaagctgtacaggggcacgccggggacctcgaccggcgcctggtaggagaggaagatgccagccagcgagcgcttgtcgggggcaaggtcggtcacgtcctggccgtcaaaggcgatggtgcccgagctgaccttgtagacggggtcgcccatgatgacgtggccgagcgtggacttgccggcaccgtttggtcccatgagcacgtgggtctcgcccgcgcccacggtgaggtcgatgtcgtggaggatgggcttgtcctcggttcccgccgagagccccgatatggtgagaagctcgcttgccatggtgcctctttcttgtctgcgcgaatgcgcttgcttagcggcgggggccaggctcccgcaacatatcctaccgactggggggtattttacccacagccgccgcgccaatcaatgcacttggcagatttgtgaagtcacggggcaggcaggtgagagggacgcgcaagcgtcgcagacgcgcgccgctcggggtcatgcgcgtttctggaaggctgcgtgtttgggtctgttgcgcattgccccgcccctgccggattgcgtgaccttacaatggcgcgcggagtcgtgggaggggatggcacatgcagaggtggaacgcgctcggggagttcatcgggtctcacatgtgggcggtgtcgccgctctgcgtcgccgccggcgtgctgtttccccgtgaggtgggcgtgctcaaccccttcgtcgtcgcgctgttcgcgttcatgacgtttcagggctcactctccaaccgcttctccaacctcgcccagaccgctcgccacccgcttcccatgttcgtgatcctcggcctctcggtggttgccatgcccgccgcctcgtgcgtgctcgcccggttgctctttggctcggacgcaaacctcgtgaccggcatcgtgctggagtactgcgttcccgtcgcggtggtctcgaccatgtggatcggcatgagttccgggaacatggcgttgggacttggcaccctactcgtatccacggtcatctcgcccgtcaccatcccgctcacgctcaaggtcttgctcggccagacagtgcgtgtcgacttcgccggcatgatgttcgacatgctcgtcgagatcgccattcccgcgctcgccggggttgccatcaacgacctcacccacggctgggggaggaggaccctctcgcccgccctcatgcccgccgcgcgcatcaccatcatgctggtcatagcgtccaactccacggggatatcgacctacatgcgtaacctcacgcccacgctcgttgcggttgcgttgttcatctgcgcctatgcgagcctgggatacgtggtcgggttcgtcgttgcacgcctgctgggggagagccgcgaggacgtcgtgacctcgaccttccaagttgggatgcgcaacatctccgccggtgcggttctcgcccagcagttcttccccgctgaggtcatgtttccggtggttgcggggacgctctttcagcagatcctcgcggcgatctgtggaatcgtcgtgagccgcgtcctcggtgagggaggggagtcctcgaccttggcggacgaggaggccgtgcacgccgaagccgtcgtggcggcgcagcctcgctgagggggcgggtgccgggacggtacgcgtaccatgctgtcgcatttctgccgcctggcatttgcctggctttcagcgactgggtaaatgcgctaacgtctggccctagggccatgcggggaggcgcgtgtgcgcccgactcgagggcaaagctgcggcggtgcaggagccatccatgcagagaacaccatcagccagggcagaggtgggctccttccccagcctcgcgccccgtcttaccgtggtggacctgctctatcagcttggcctccaggcgacgtacttcgtgggcatcgtggggtgcgccacctatgtgctcggtgccaatgcgttccaagtctcgtacctggttctcgcgttcaacatcgtcctcgtggcgggcggggtggcctgtggcccgctcgtcgatcgggtcggacctcgcagggcgctggttctcacgttccccgctatgtcgctgctggggctgtttggctggctcttccccctgagcatggggagcctgttcgtcaccgccgccctcctcggggcactctgggccgttgcgggtactgcggtcaacgcgttcccgcgctatttgaccgacagcccgcgggagctcctccgcatgaacagcctctgcaacaccgcgacgagcgtcgcggtcatcgcgggaccggtgcttggcggcgccatcagcatgctcgccccgcagcagtgcgtgttctcggtcctcgccttcgcgcctctcgcggcggaggcagtggtgatgggcatgccccgtgctgccctgggcaagccggggacgggggagacgggcgaacccgacgggacgggtcgcgacaggggtcgcggcgcgtttctccacgaactctgggagggtatcaggattgtcttcacgcacggtgaccttgcgttcctgttcttcctggggttcctgggcttcttctgctatggcgcgttcgactcgctcgagtcgctcttctaccgatacacgctccacgccagctcggactggatgggctggctctctgccatcgcgggcgtgggcggaaccctcggctccctcttcgtcatgcgcgttcccgagcgtaggctcacccccacgctgctctcggtgctgctcctggtgacgggtgttggctccatggtgtacgtgggcacgggctcggtcgccgtagcggcggttgggcaggccatcaccgggctgggctttggggccatggggccggttcgcacgaccctcacgcagcagtgctgcgaccagagctacgtggggagggtcacctccgtcatgcaggcgggcctcaacagcgccggcatcattcccctgttctttgccccgtttctggcggactccctcggcgtgcaggcagtgctgtttggtgccagcgcgatggtcgctctgattgcggtcgtgttcctcctcgcttcacttcggcgcaggtagtcgtgtgagtcgggtggcggagagggacttccgttctgtcgtcggaaccccgtcgagggcggacgtttgcctgcgggattggaaaagagtcaaagaaggggaagagggggttcagcggtgtcctctcgatcccgttgacggaagagtgacgtgttcgcttgcgtatgtggcggcgtgagtgccgggcaagcttgtgatgtcgggtgctcccgacatcagggcatgaaccatggcagaggaagactcgcgtgagcacttttccggtggccgggcggcggggtcctgtgaccccgtggcatctgcacaggtaaaagactcatagaaaatggggtgccccgtccctggcaccaaacggctcgcatgagtactcacgcgtacgagttgttgccaaacgggccacttttccgccccgatatgcgcggaagcctcgcgtgagcactcacgcgatgggctttctgccacggttggaacattgatgggacgccaactgggcaaatatgttctggcccctcgctgtgccggcgcgaaagtgctcacgcgaccgctttgctgccagccggcagtcttcccttccgtcgatggcagccgcttcccgacatgagtactcacttcgagagcttgctgccatggtttcctttctgatggagggctaactggggagacgcaactcgccgggacctccgtggcagcgggagccggatgtgagtgcacacacccggagtctgccgccagttggtcccctttctgggtcccgttggccgccgcttcccgatgtgagcactcacgaaggaagctctctgccatcgttgaccggctgatgaggaaccaactggggaaacgcgacgtggacgagcagacgtggcagctacggtcagggggaagtgcgcacatcgggagcttgctgccaattggccctccccgagaggtgcccgacccgccgcggtagctctcccttgcgggaaagagctctaagaggggggtcacggtgacccgccgcgcatggatgggccggcttgcccggaaggcgagcgaaccgcccattcatagtccaccgattcttcgccgtgatcgtagttgcctggagcctaaggccggaagcgtgccgaggggagcggccggtgagagcttgcccttctttgcgaggggtctgacctgtgatgacgcacttgcagggctgggcgaggggcgtcctgcccccactcatagccaatgaacttcctgtcgtgggcatcgtgggtccgggcgtctggatgtctggaggtgcccgtgtctaatatctcgtcccatgtgtacacacgatgagcaaattttgacgggggagagactttcggcagctttggagtgtgcctgacgtcaaaccctcgtcccgtgtgtacacgcaggacggaatatttggcagagggggcccttgtgagtggggggatgccagaaatcccctcccgtgtgtacacgcggggcgtggtattaggcagggaagccttccggtgccgcgtggggcggcgttgatgtcagaagttgcatcccgtgtgtgcacgcgggacgtacttattggcggcgaggagccactccccatcaaagttttccgaagggttgcgccttcgcgcgggcggagggccttcgcctagaatgttcacgcaagacagacgacagacgcgggcgcgaaatacgcacgtctcgcccgcaaggcaaagaaggctgggaggaacgcatgcccctgagccaggaagacgttgccggcatcgccgactacgcccgcatcgcactgacgggtgacgagctcaaagagatgaccacctacatgaacgaggcggtcgagctgctcaagcccatcactgagtacgacctcgacggggtggagcccacgttccatcccatcggcgacctctccaacgtgatgggcgaggacgttgtggacgactccgtccgcgcgctccccatcgacgtcgcgctcaagaacgcgggatcctccgagggtcgctacttccgcgtcccgtccatcctgggaagcgaggagggtgaccgctgatggcgaactttgaccagctttccgccgcccagattgctgccggcgtaagggcgggggacttctccgccaccgaggtcgcgcgcgcgtcgctcgatgccgtcgactcgcgcgagccgcaggtccaggcgtttctggaggtctcctccgacctcgcgcttgaggctgccgagaggaccgatcaggccagggccaggggagaggagcttggccccctcgccggagtgccctgtgcgttcaaggacaacatgcaccttgtgggcacgcacaccacctgcgcctcccgaatgctcgagaactacgagtccacgttcaccgcgacctgcgtgcggcgcatgctcgacgccggtgccacgcccattgggaaggccaacatggacgagttcgcgtttggctcgtctacggagtccagcgcgttccaccgcaccaacaacccctgggacaccacgcgcgtccccggcgggtcgtcgggcggctccgctgcggcggtcgcctcgggcgaggtcacggtctcgctggggtcggacaccggaggctccatccgccagccggccagcctctgcggcgtcgtgggcatgaagcccacgtacggtgccgtgagccgctacggcgtggtcgcctttggctcctccctcgaccaggtggggccgttcggccgccgcgttgaggacgtcgcccttgccatgaacgcgctcgtctcgcctggccgcgaccccctcgactccaccagccaggactgcccggtcgacttcctggagcacctggacgaccccatagcaggcaagcgcgtgggcgtcgtcccccagctcatggaggtccagggcctcactgacgaggtcagggatgccgtgaacggcgccgcccgcgcccttgagggccagggcgcccaggtggtggaggtcgagctccccaacatcgcaagcgccatctcggcatactacgtgatcgcgccctgcgaggccttcagcaacctcgcccgctttgacggcgttcgctacgggtaccaggagcagggctgcgccacgctggccgagcagacctcgctctcgcgcgcccacggctttggcgaggaggccaagcgccgccagatgctcggcgcctacctgctctcgagtggcgtctacgacacctactactatcccgcgcagcaggtgaggaccctcatcacgcaggactacgagcgcgcatacgagaagtgcgacgttatcctcatgccggcggccccccgcacggcgttcaagtttggcgagctgtccgaccccacccagatgtacgcgtcggacatgttcacgatctcgaacaacatcgtgggcaacggcggcgtcagcgtccccctgggcctcggtcgcgactcggggctgcccgtgtcggcccagctccagggccccgcgttcagggaccgcatgctcctgcagtttgcccgcgccatcgagcgcgcctacgacgcgagcggcatcgtcgcgcccgactttgccgggaaggggggtgacctcgcatgaggagcctccaggaggtgctccaggactgggaggccgtcatcggcctggaggtccacactgaactcaccacgctcgagaccaagatgttctgcaactgcaagctgagccacgacgacgagcccaacaccaacgtgtgcccggtgtgcctgggcatgcccggggcactgcccgtccccaacaagaaggcgatccagtccatcgtgatggcgggcctggcgaccaactgccagatccagaagcactcgatgttctaccgcaagcactacttctatcccgacatggccaagaacttccagaccacgcagggcccggtcgccttctgcatgtacggccaccttgacctcgaggtgtccggcgagggtgcctccgagcgccccgatggggtcgagaccggcaccgacacggtggccgcccacgacgtcgccgcgccggtgaccgtgcgcaaggcggaggacggctcctacacggtccccatccgcatcctgcgcatccacatggaggaggacgccgccaagatggtgcacgtgggcggcgaggagggacgcatcgccgacgccaccgagtccctcatcgactacaaccgctgcggcaccccgctcatcgagctcgtgaccgagcccgacctccgcacgccggaggaggcgcgcctcttcatggagaagctccagcagaccttccgcacgctgggcatcagcgactgctcgctcgagagcggctccatgcgctgcgacggcaacgtgagcctgcgccgccgcgggacccacgagctgggcaccaagaccgagctcaagaacatcaactcgttcaagagcctgcacgacggccttgagtacgaaatccgccgccaggcggaggtgctcgaggagggcgggatcatctaccaggagacccgccactgggagcccagccgcaagcgcaccgtggtcatgcgcgtgaaggagacggcggacgactaccggctgttccccgaccccgacctcgcgcccttcgacctctccgacgagttcatcgacgactgccgcgcccgcatccccgagcttcccgacgccaagcgcgaccgctacgtcgcgtcgttcggcctaaagcgcgccgacgcggcccagatcgccggagaccccgtcacggcgggcttcttcgaggaggcggccgacggcgccgacggccgcgtggtccccaccatcgcgaacgtgatggtcaacctggtccccgccttcgacgccctcacccctgcccaggtccgctccatctccacgctcctcgccggcgacgccatcacctttgcccaggcgcgcgaggtgctcgaggcggtcaacggcacccaggacgacccggagcgcgtggtggacgagcgcggcatgcgccaggtcaccgacaccggggcgctcgagcccatcgtggacgaggtcctgggcaggtgccaggaccaggtccagcagtaccacgacggcaacaagaaggtcgtgggctacctggtgggccagtgcatgaaggcgagcaagggcaagggcaaccccaagctgttcaaccagctgctcaggcagaagctcgaggcctaggcaggggagaggggcctccgtcccgcccgcggcgcctcccgacggtagtcggggcaccggtgccgcggcgggcgtgggacccgggaggtacccatggcactcacgatcaacccgcgcctgcgggggcttgcgccctcggggatcaggcgcttctccgcgcttgccgcggcgacccccggctgcgtctcgctcacgctgggcgagccgggcgagggaacgccgcccgccatccgcgaccgggtgggggaggacctcgcggcgggtctcacccactacccgcccaacaacggcttcccctggctgcgcgaggccatcgcgtcgtccgaggcggcccggggcgtctcggacgaggtcgcgacccccgacaacgcgattgccaccgtgggggccacggaggcgctgttcgttgccctctccaccatcctcgagcccggcgacgaggtcatcgtccccacgccggcgttctcgctctacggctcgatcgcctcgctcctgggggcacgggtggtcgagctcgacaccgagcctgccggctaccaggtggaccccgccgccctcggtcgtgccgtcacgccccgcaccaaggcggtcgtgctctgctcccccaacaaccccacgggctgcgtcctggacgacgcgagcctctccgcggtggccgccgccgcgcgcgaccacgacctgttcgtggtgtgcgacgacgtgtaccggctcctctcgtacgacggggaggcgccctcgttcgcacccgcccaccccgagctcgccgaccgcaccctggtggtggggagcctctccaagccctgggccatgaccggctggcgcatggggtggctcctggggccctcccgggtcatggggcaggcggccaaggtgcaccagttcgccgtgagtagcatccccgccttcgtgcagcatgcgggcgtcgaggcgctgggcacggacgtcgaccagatgcgcgagagctaccaccgccgccgcgaccgcgtggttgaggcgctggggcagatgggccttcccacccccaggccgcggggcgccttctacgccttccccgacgtccgggagtttggcctgacgagcgaggagttctgcgagcgggccatccgcgaggcgggggtcgccctggtgcccggcacgttctttgggggagagggacacgtgcgcctgagctacgcgtgcgacgaccacacgctggcggagggcctcgcccgtctcgcccgcttcgtggatgcgctgagggagggtggggcgagcgatggaagagcctgacctcgagctgctgcggcgctaccgccgtgacctccaccagatcccggaggtcgacttcgacctccccggcacctgtgcctacgtgcattccgtgctcgaccccctcgcggccgccgacgaccgcctgagcgtgctcgagccctgcgagtccacggtctgcctgctggtgaacgtgggcgccggagccaccaccgccatacgctcggacatggacgcgctgcccgtctccgagcgcacgggcgccccctatgccagccgcactcccgggcgcatgcacgcctgcgggcacgacgggcacatggccatggtcctgggccttgcgcgttacctcgcgctgcacgtggacgagctcccgcgcaacgtcctgctggtgttccagcccgccgaggagaccacgggaggtgcccgggtcgtgtgccagacgggcctgttcgacaggctgcacgccgaccgcatcttcggcttccacctgtggcccgacctcccggctggggtcgtggcgagcaggcccggccccctcctcgccgccagcaacgaggccaccttcgactttctcggccgcgccagccacatagccaaggcgtcggacgggcgcgacgcgctcgaggcgtgcgcccgcttcctcctgtcctcgtactcctatatgggggagagggaggcggaggagccgtgcctcctcaagttcgggcgcatggaggccgggtcggtgcgcaaccagatcgccgaccacgcgcacctggagggaagcctcaggatcttctccgtggggatgggggagaggtgccgcgccgacctcgccacccttgccgacggcgtcgcgggctcgctgggctgcgaggcgcggacgcacttctctgacggctaccccccggtggtgaacgacgacgcgctgttctccctcgtgcgcggggcgctcccggacctgcgcgacgtccccgagccgctgctgatcgccgaggactttgcctggtaccagaggagacttcccggggtcttcctgctgctgggcaccggcacggggatccccctgcactcggatgccttcgacttcgacgagtcagtgctgatgcgggggctccaggcgtacgagcgcctggtccgggtgccctagccaagggccctggctccgtcgccccccgtcttgggggagaggaacgttcccatcgtgttacgtgaccgccgtccgcccggcggcccgccatccgccggtgctactctcaccccactgatagaggagcggacacgaagggcacggtggagccggcgggctgcgagaccgtgcgaggcgaggtccgccgaactgggggtgggggcacccttccccggtgggcgtacggggaacacccgtgcgactgtccgcgcaccaccgcgcgggtgagctatcttaccggggtgccaggctcgcctcttccgtaaggtcgcaaactcgccgacacgccccgggagatgatttgcaggtgagcacatccgccacgaagaggcccttcgtcacgagggagcggctggagcagattgcccagatccatcccacgccgttctacctgtacagcgaggacctgctgcgagcccgcgcccgtgcccttaacgaggcattcgcctggaatcccggcttccgcgagcacttcgccgtcaaggcgacccccaaccccgccatcattcgcatcctggcggaggagggctgcggaaccgactgcgcctcgctcaccgagctcatgctctccgacgcctgcggaataagcggcgaggcggccatgttcacctcgagcgacacaccgctcgccgactaccgcctggcgcgcgacctcggcgcgaccatcaactttgactccctcgaccagctggggttctggcgcgacaacgtgggggagttcccgcggacggtgtgctgccgggtcaacccgggcggcgacttcgaggcggcaaacggcatcatcggcacgccgcaggactccaagttcggcatgaccgtcccgcagctgcgcgaggcgttcctcaccctccgcgacgctggagtcaaggtgtttggcatccatgcgttcctcgcgagcaacacgctgggggacgactactacccccgtctggcgcggcggctgttccatctcgccgcggacctctcccacgagctctgcgtccacgtggcgttcgtggacctgtccggcggcatcggcatcgcgtacgagccagggcagcgcgagaacgacatccgcgccatcggcgagggggtcaggcgagcctacgaggaggtcctggtccccgccgggatgggggacgtctccatccgctccgagctgggccgctggatcgccgcccccgccggcgcgctcgtgacccgcgtgatccaccacaaggtcacctaccacgactacctgggggtcgacgcctgctcggcaaacctcatgcgcccggcgatgtacggcgcctaccaccacatctcggtcatgggcagggaggacgagtccgtggggggcacctacaacgtggtgggcggcctgtgcgagaactccgaccagctcgcccgcgagcggcccctcccgcataccgaggtgggcgacctgctcttcgtccacgactgcggcgcccacgggcactccatgggatacaactacaacggtcggctgcgctcggcggagctcctgctccagagcgacggcgacgtccgcctgatccggcgcgcggagacgcccgccgactacttcgcgaccctggacgtgacgcccgagggtgcggctctcctctcggggatgcggcgaaagccatagccgcggggccagctcccccgcggcacccaagaagtagaggagacacgcaccggtgcgcaaacgcgcgccatcaccaggaaggaaccacccatggacgtacgtgacatcgagggctccatcgtcgccctcgtcacccccttcgacgagaacggacagatcgacttccccgcaatcgaccgactggtcgacttccacatccagaaccacaccgacggcatcctggtgctgggcaccaccggggagtcggcgaccatgaccgacgcggaggattacgcggtcgccaagcgcgtggtggacgacgtcgcaggccgcatccccgtcatcggaggctccggctcaaactccaccgccgagtcgctcgccaagtcgcgcggcctcgccgagctgggggtcgacgccctgctcctgatcaccccctactacaacaagtccaacgaggacggcatctaccaccacttcaccgcggttctcgaccaggtggacaagcccgcgatcctctacaacatccccgggcgcaccgggtgctccatcagcgaggggaacgtcgagcgcctgtgcacgcaccccaacgttatgggcatcaaggaggcgtcgggcagcatctcgtacgccacgaccgttgcccagtacctctcggacgacttccgcatgtacagcggcaacgacgacatggtcgtgcccctgctctcgctgggcgcctcgggcgtgatctcggtgtgggccgacgtccagccacgtgtggtgcacgacatggtgcgcagctacctggacggcgacgtgagggtggcgcgccgggcccaactcgacggcctcgagctggtgcactccctcttctgcgaggtcaaccccatcccggtgaaggccgccctctcgatgatgggcctgatcagcgagagctaccgccagccgctgtggccgctcagcgacccggcgcgcgagcgcctctccgcagccatgaggggagctggtctgattggctagcgtcatcgtggtaggggcccgaggccgcatgggcacgcttctctgcagggcgttcgacgacgcggacgacttcgagctggtaggcggctacgacgcgcaggacgtgggcgagcttgaccaggcggcgccggcggcggacctgctggtcgacttcagctcgcccaaggcgcttccccacgtgctggcgtacgttgacaggacgggttgcgcactgctgagcggtaccacgggactggaccaggggcagctggcaggcatccgcgagcggggcgagaggagccgggtcatctggtcgggcaactactcgctgggcgtcgcggtgctgcggcacgccacgcgcatggcggcggaggcgctccccggctgggacgtggaaatcgtggagtgccaccacggcggcaaggccgacgccccctcggggacggccaagatgctcctcgcggaggtcgaccccgagggcggggcggacgtcacgtacggccgcgagggcatcgtggggccgcgccccaagggccaggtgggcatgcactcgctgcgcggcggcaccgtcgccggcacccacgaggtccatttcttcggcgacgacgaggaggtctgtctcacccaccgcgccacgagccggcagatcttcgtcaacggcgccgtggcggcggcgcgaaggctcctgggccgagcgcccggcagctacgactttgacgacctcatgttctcgtagggaggatgcacgttggaggcacaggagatcatcgactacatcgcgacctcgcccaagctcacgccggtcaaggcgtacgtgagggaggcggagggcgcgcgtgtcgcctatcccgcggacgcgcacgtgtttggcgacggccgcagcaaggtggtgttcgcggactggggcgagctcggtcccgcgctggaggccgccggcgacgccgtggaggacctggtggtggagtgcgaccggcgcaactccggcgtccccctgctcgacgtcaggggcgtcaacgcccgcatcgagcccggcgccatcatccgcgagcgggtggagataggcgacaacgccgtggtcatgatgggcgcgatcatcaacatcggcgccgtggtgggcgagggcaccatgatcgacatgggtgccgtcctgggcggccgagccatcgtgggcaggcactgccacatcggcgcgggcaccgtgctcgccggcgtcgtggagcccgcgagcgccacgcccgtcgtgatcgaggacgacgtgatgataggcgccaacgccgtggtgatcgagggctgccgcgtggggcgcgggtccgtggtcgccgccggagccgtcgtcacgcgcgacgtgcccgcgggcgtcgtggtggcgggctgccccgcgcgcgtcatcaaggagaaggactcgggcacccaggccaagacggcgctggtcgacgccctgcgctccctgtagcgggggagagaagcgcgttgccttgggccctccccgtcccgtcggcggggagggcccttgcgttggcggcacacccatgcgagcggtccgcggcccgagggcgaggctcctctcgcctgcgtccaccccgccagggacgggcgtccccgttcgaatctccgacgcatgcgcccccctccccgaaatgacgcgggggcccttccgtgatggggtatagagagaggcggcagcggggcatcgcgcccccaggacacgtcgaaagggatttcgcatgggtgtcaatcgcttcgtcctcaacaccgtctcgtaccatggctcgggcgccatcaaggagatcccgggcgagatcaagcgccgcggcctcaagagggccttcgtctgctccgaccccgacctcgtcaagtttggcgtcaccgccaaggtcaccgacctcctggacgaggccggcatcccctacacggtgtactccgagatcaagcccaaccccaccatccagaacgtccaggacggcgttaaggccatcgaggagagcggggcggactgcatcgtcgccatcggcggcggctcctccatggacaccgccaaggccatcggcgtgatccacgagaaccccgagttcgccgacgtgcgctcgctcgagggcgtcgcgcccaccaagaaccacgcgaccttcaccatcgccgttcccaccacggccggcaccgccgcggaggtcacgatcaactacgtgatcaccgaccccgagcgcgtgcgcaagttcgtgtgcgttgacaccaacgacatccccgaggtcgccgtggtcgaccccgacatgatggcctcgatgcccgccggcctcaccgcggccaccggcatggacgccctcacccacgcgatcgagggctacaccaccaagggcgcctgggagctgtccgacatgttccactacgaggcgatcagcctcatcagcacgcacctgcgcgacgcctacgccgaggcgaaggctggcaagcccgcctcgggccgcgagggcatggcgttgggccagtacatcgccggcatgggcttctccaacgtgggcctgggcatcgaccactccatggcgcacacgctctcggcgcactacgacaccccgcacggcgtcgcctgcgccatgctcctgcccatctcgatggagttcaacaagccggtcgtcgccgagcgccaggccaagatcgcccaggcaatgggcgtggacaccacgggcatgagcaccgaggaggctgctgacgccgcaatcgccgccgtgcgccagctgtcccacgacgtcgagatccccacgacctgcaagggcctggtggaggaggacctcgaccagctggccaaggacgccctcgccgacgcctgctatcccggcaacccccgcgaggctacccccgagcaggtcaaggacatgttccgcaagatcatggcgtagcagtcgcgtcacctcgcacgccgtcgggaggggtctcgggttcgcccggggcccctctcctctcccatgggcttcctgcgcaaatgccccggcccccggccggtaggtcgtggcgggggagataatcgtggggcaccgaatgcgacggagtcgaaaggggagaggccttggcacggcactggaacgaggacgagagggactatcgcgacgtccaggagaacgcccgcggcgggggaatgcttgcccttctcggcctggtgctgatggccgtggcgctcgtcggcctcttctcggggcccagcgacagcctcgtgttcaccacgttgctcatggtcgccctgctcgcgggggtcgcgcttctctacgtcggcacgtcgctgcgccgcgacgcgcgcaaggcgacgctgcaccaccaggagacctcggacccctgggaggacgaccgccggcgccgctagtctcgccccgattcccggatctgtgagagaatgcgccatgtcatgaaggcgcgggacgttctggacgggttgcgatgaagctttccgagggggccctgaccccgctgtaccagcaggtcatggacgacatcaaggacaacatcgagagcggcaggtaccgcgagggggagaagatcccctccgagaccgagctctcgcaggcgtactccgtgagcaggatcaccatccgtcgcgcggtcgaggagctctccgaggagggctacctcacgaagcggcagggcaaggggaccttcgtcaaccgtcccaagctcgcgcgcaagatcttccagaccagcgaggtgcagagcttcacgcagacctgccgcgaggccggcagggttcccggtgcgaggctcctgggatgcgagacgaccgatgcgcgacccgccgagcgcgagttcctcgggctgtccgagggtgcccgtctcgtccacgtcaagcgcctgcgcaccgccgatggcatccccatcatggtcgagaacaacttcttcccgctcgacgggttcgccttcctcctgaacgcaaggttggaggactgctcgatcttcgacctggttgccagcgagacgggccgccgtcccgagggggacgacctctgcacgctcgagatcgtgcatgccggttctgacgtcgcccgccacctgggcgttcccatgggtgagccgctgttctacgagcacgtcaacttcgtggacggggaggggcggccgctcctcatcggcaagcagtacatcgtgggcagcctgttcgtcttcagcatctagcgggatgcgatgcgtccggcgccccgtccgcggtagcgtgcgcggattcggcaccgggatgcttggcgctcctaggccctgcatgggttttcaccatccagcccgtgcgagggctagaaagattaagcattacgctccgaatttcgtgcgatgactagcgccgctaggaagcgcgtcagggaaaccgtgcggggggctagcatgattaggcgccccgccctcgtccccttgtgagcccctctcgggcaatgcgccaggtggtgggtcggaggctccgcattcgccacaaccagagagctctcgaaggtcaaagaagggggagagggacattgccacgccggcgggcgcatatcggggaaggtggccgaaccgcctcggcgtgccataggcaccgtcggcgcagacgttagtggctggactctgccagaaacctcgtcccgcgtgtacacacgggacgaggtttccgacatggagactcgccccacttgtgcgttctccctgttggagggaggtcggggtctcgacgttgtcgaaaggtgcgccccatgtgtacacgcggggtgcgattttagacagggcgcccccttccgatgccacggatgccagaaagtccatcccgtgtgtacacacggtgcgcagtttccgacaagggatccgtgccgctgcaacgttttcccagatgtcggttgattgattcctcaccgttgccagaaacctcgtcctgcgtgtacacgcggggggagatttctgacatgggccgagtcccgacagacgtcagacggcggagacggttgccgagcgcaggtgatccgtccgggtaagctcgcgtggatctaagcccctactgacggaggattgtcgttcctgtcgtcggttgatgcccgatgctgcgtggcgccccctgtccccgtaggccatgttcctcctcttcgagctcttttcttccgtgtgccggtcgggtgatgggtgtgccctggcgtcggcgcgggcgaaaggccccaacggtcaaagaggggggtgcttccgctgtgagggatttctgaggcggactgcccttgtctctccccgagcctcctaaggcaatgcaagtgacataaggattcaaaacataacagcaggcagtcacggtccctccctactgccgatggcagctgcctcccgatatgtgcacccacgtcgggagttttctgccaatgcggcaatactgatggggttccaactaggggaacgctatacgccggggtctcagtggcagcaagtccctgatgcgagtgctcatttcgggagtttgttgccaggcaggtctcttttaccttccgattggcagcgagctcctgatatgagtgctcatttcgggagtctgttgccgaggttgaaaggttgatgggaagccaacaggggaacgcgaagcctgcggcgctgacgtggcggctggggccacatgaaagtgctcatatcgggcgtgcgctgccagtgggttcccgtgggaggtgctcgatccgcagctggtcctcttgtgggaagggcccaaaggagggagaccgaggcgaccttccatagatgaaggcgttgccgggttcaggcggggcaagcccgctgcattcttggcccattgacgtcctggcgcgaccgtcgtggaccggagcctgggcggcttgatgccgaggagccagctcgtgctagggaatgcgtcccgtgtgtatgttcggaacaggttccgacggggggtggcatcctaccagcggaagttggtccgatgccagaaggctcacgcctacgttttgcctacatggtgcgaaaaatgatgtacgccagacgaagagcgctgccagatggcggcggggcaccacgtatcccccaagcaggggaggtcggaaataatccctcgcggaggtccgactatgccggggcgccccatgccctgtgcgcttacggccggggagtgaccgctcggcggctttagacccccagtgtttctcaccaagaaacaagacgttatagaacgtaatataacgtactaaacacaccacggatttgaggaagcactgggagagggaggaagcgatggcggaggagacaaagggaaagggcaggaggcatcggttccacctgccgcacgtgtacacgatcatcttcctgctgatggtcgtgtttgccgtgctcacgtggattgttccatccgggtcgtacgagaggaagaccatccagactgctgccggcgagcgtgaggtcgccgtcgcgggaacctacgagggggttgacaagaactacaccgacccggagacgggcgagacgaccgaccttcgcgtgagcatccaggagctgctggaggcacccacccagggcattcaggcagcggcggacgtcgttgcgtttgtcctcctcatcggcgggtcgtttgccatcatcacgaagaccaacgccatcaacgcgggactctctcacgtcatcgggaagctcgagaaccgtgacatcgtgatcatcccggtgagcatggtccttctctcgatctgcggaaccacctttggcatgtcggaggaggcgctgcccttctatgccatcttcatcccgatcataatggcgctcggctacgactccatgacggcgttcatgatctgcttcatgggtcccaacatcggctacatcgcctcgaccatcaacccgttcaacgtcctcatcgcgcagggcatcgtgggcatcaagggcaaccctcagctgtggctccgctttggcgtgtgggtcgtgttcaccgccctcgccatcatctgggtcatgcgctacgcgagcaaggtcaagcgcgaccccaagagctccatcacctaccaagacgacatcgccaagcgcaaggagttctccgtctcggacgattccgtcgcgatgccgttcagcggcaggcagaagggcgtgctggtcgtcttcgcctgcggcatgggcctcatcgtgtggggccttgtgacccagggctggtacatggacgagatctccgccgtgttcctgggaatgggaattctctcgggcatcgtggggggactctccgagaaggagatggcggaggagttcgtgagggggcttgccgacttcgcctacgctgccgtgatcatcggcctcgcccgctccatcctcgtgatcgccgagaacggcatgatcatcgacaccatcctcaacgcgctcgccacggcgctctccggcgtgccgaccgccgtgtacacgaccttcctgtacgtggtcctcgggctcctctcgctccttgtgcccagctcctctggcctcgctgcgctgacgatgcccatcctgggacccctcaccgagctcatgcacgtcaaccccgaggcggcggtcaccgcactctgcctcgccaaccagacggtcaactccgtgagccccacggcgggcatgaccgtcgccggcctggcggtcgccaagatcagctttggccagtggtggaagacgtgctggaagttcatgctgctcatcatggcgctgggcatcgcggtgacggccgtctcggggatgctccctgcatagcggtaccccccgtcgccggtcgccggcggcggggaactggaggagacgtgcggtatcccattgccgctgacgaggggagttgtggaatgggtcagagggacgagaggctcgtggtgctctcgaggtgcgtcttccccgcgacgggagcgagggcgttcgacggcttcgtcgcaaccgaggggaacaggatcgtcgcggttggcccccgtggcggagcggagaggtacattcgcgatgcgacgcgcgtcttcgatgcgggggacaggaccgtcatccccggcatgacagacgaccacaccttctttactgggtgggcgctcctctcgctgggggcggacctctccggcgtgcggactcccgcggagggcgtgcaggcactgctctcgggggtgcgttcgggcgggccggactccccggtgtttggacatgcggctccggaggggctggtctcgcccgagggggaggcggcgctggacgatgcgttccccgaccgccccgtcgtcgcgttcaccgcggatcgggggacctgctggatgaacggggtagcgcggaagcggtatgggttcaccccgcaggagtgccatgcggaggcgacgtggcgcctgatgcgcgactacctgcggcttccccagatgcacgacctgtatcgcgcgtacatgcgcctcctcaaccgccgtggcgtcacgcagatcaaggagatgtcgtttgacgactactacggcttcgtggacgtaatggggcggatggaggagaacgacgagctcacggtgcgcgtctcccttatgagccagcccgtggggcgcggaatggacctcgatcacggaaagcgcatgcgcgagcggctccgtggtccattcctgggcttcagcgggttcaaccgcatgaccgaccggtccattgcgtctgggatggcggagctgaagagcccctacctctccaccccaggcagcacctgctccgtgcccgtggagtgggacctcatcgagcgcgagctgggggaggcggacagggagggctttcgcttctcgctccactgccagggtgacggtgcggtggggcacgtggtggacctctacgagcgctgcaggcgtgacgcccacggacggctcgtcaaccgccatgcgatcaccgacatggagctctctgaccccggggacatcgacaggttcgggaagatgggcggcatctgcgagatctacccgcagattcagtccctcgaccgggagggcgacctccttgccgtggtcgaccgccaggttggcagggagcgctttgggcgctattggatgcgacgcaggatgtgggacagcggttgcgtggtgtgctgcggcaccgacctgccgctcatgctcccctcgatcggggagtccctgtggtgcggcgtgggaggccacttcgcggacgggggaggcgccaacctgcagaacatgctcacggcgcccgagatgctccgcgcctggaccgccaacggggcgtacgactgctacgacgaggaccggctcggcacgttggagcccgggaagctggcggacctcgtcatcctcgaggccaacgtgctggagtcggaccccaaggaccttcgcgatgtcaacgcggccctcacggtctcggacggcggcgttgtttacgacggcctgtgacgcccgcgctgaaacaacgattcaactaccctttgcgtcttggacgcacgagagagaaagaggaagaacatgaacgcgcacgactacgctcggcaggtgctcgaccaggcggagaacatcacgcacgtgtattgggtcgcctgcggcggctcggtcatcgacctgtatcccgcgcactgcctcatcaacgccacgagcccgagcatgacgagctccatccacacggcagcggagttctgcgcccttccgccggcggcactcgggagggacagcctggtcgtcacgtgcagccactcgggaggcacccccgagaccatcgaggccacccgcctcggacgcgaccgcggcgccttcgtcctcaccatgaccaaccgtcccggctccgccatcgacaccggcgagtggccgtgctgggcctaccagtgggaggacgacaccccgcagtccgagcgcccggcgggcttctcgctcgccctcgccgcggacctcatggcggcacaggacggctacgagggcgtgggggcgctgggccagggcctccgccagctcgacgggatcatcgcctccgcgctgccgcgcgtccaggccgaccttggcccccgcttcgtcgagatgtgccgcgagcacgacttcttctacgtgctgggctccggccccacgttctgccagacctacggcctcgccatctgctccctcatggagatgcagtggcagaactgctcgtacgtcaactcggcggagtacttccacggcccgttcgagtgcacccaggacggcgtgttctacctcctgcagaagagctccggcgccagccgtcacatcgacgagcgcgcggagcggttcctctcgacccacaccgactccctcatggtcctcgactcgctcgactacggcatgggcgacgtggaggagtcggtccgcaccttcctcgaccccatcttcttctacgagaccaacgtcgccctgaggaacgtgcgcggcaaggcgtttgaccacgaccccgactatcgccgctacatgggcgtcgtcgagtactagggactgccaacggcgggcgagaggagaggcgcatgagcgagctggacgtgagcatctgcgggtttggcgacaacgtggtggacgtgtacgagcacgtgaggacggagtacccgggcggcaactgcgtgaactttgccgtgtacgggaagaaggcgggcgtcaggcgggcggcctacatgggctacttcgggagcgacgaccgcgccgagcgcgtaatccaggcgcttcacgaggagggcgtcgagaccgtaaagtgccggcagctcctgggcgagaacggctacagctgcgtttcgatcgccccggacggcgaccgcgtctggggcgactacaaccagggcggcatcaggggagagacgagctacgtcctcgaccgcttcgacatcgagtacctgaggcagttcgacgttgtccacagcggcaactactgctacacggagcggcagctccacaagatccacgaggcggggatcgacctctcgtttgacttctcggacgactccagctgggagtactaccaggaggtcgcgccgaacgtgacctacgcgttcctctccgcctcagacctcacggtcgacgagaccaaggaccgactgcgcaaggttcacgagcttggcccccgctgggtgagcgcgacgaggggcgtggagggctgctacgcgtttgatggcgagaggtactaccgccaggagtccacgccggtggagaggatggcagacgccatgggtgcgggcgactcgttcctcacgtcgttcctggtcaagtcgattgactgccgaaagaggggtgcgagcgaccaggaggcctacgccgagggccttcgctatgcatcgtggttcgcgtccaacgtgtgctgcgcccaggatggcagctggggccacgggtaccgctactaggcgcggttattcacgcgcctcggacgagaaggctaacgagcaggggagacaagcaaagacacgccccccgaccgcgtgacgtcgcggtcggagggcgtgccgttgggggagagggacgctgcgacgtgctcccctggctattccgccgcgccgtccgggacgcgcatgagggggagcgtgctcccgccgtggggcatgaccaggaccctcggtttgcggcccaacctctcgcgctgccccgccatcgcggcgtccaccgcctcctgcacggtggggaagggcaccatgaagcagtctcgcacgaggtcgtccggcaggtcgctcaccaggtagatgctcgcgcgcagcaggatctgcgccaccgcggcggccttgtgcccgcccagcctgaactcccggcgaaggtggtcgaccacgtcctgtggcgtgctcgcctcgagcatccagcgctcgaacgtctgctgccccaggccctccgcgcacgagcccaccagcacgatgacgccgccgtcccgcacggggtgcttggcgttgtccagagccttctggagctggtacaggttgaggtccttgggcgcaccaccctggctcaccacgaccacgtccgcccgctcgtggagctcgcacccgtacaggcggtcgagctggcggcaggcgtccctctgcgcccgcacgaagtcgccgctcgcgcagtagaccacgtttctcttctcgtccagcaccacgttggcgatgaagtcgaggccgaccatgcggcaggcctcctccaggtccaggcggacggggctctccatgttccccgaatgggccgccgggtccaccatcatggagtggttggcctgtatcgcctcgaaggtgctcacgccgggcatgattgccttggcgccgccggagtagcccgcgaagtagtggtactccacgttgcccagcgcgacgcgcacgtcggcgtgggccacctcctccaggatgtcgacgggggtgccgtgcgaggtggtcccgtagtggacgagccccttggagtcgccgttgagcacctgcaggcgaccatagtagtcgcccatgatgcgcctgagctcgtcctcggtctgggggcggtggctccccagggcgatggcgagaagcacctggtcgtcccgcacgccggcggcgtgcagctcgtccatcacgggcgggaggagcgtcgcggtgggaagcggcctcgtgacgtcgctcgtgatgacgcagacgctcccggcaccgcgtgccacgtcacgcagccgcggcgtgccgatggggctgcgcagggactcctccacgaccgtgcgacccgtcgccccaaacgagacgtcgtttgcgtgcatgacctcgatcacgttggcggcggggagcgagaggcgctgggtcctctccccaatgcccaggtcgacctcgacggtctgggcggagaagcgctccctgccctcgtccccgacggtcttcatcgctcccaccctggatggcatgcaaggctcccttcacgccgtgacggggcaccgcccccctgaacagttgcccctaggatatccccccgagcctgtcgacgcgctcgagcagctcctgcccgcgctcgtggagcatgaggccgtgggcgtggcgcgagaggtcctcgcccgcccagtcggccgcgaaggccatgaactcggggtcgacggctaggtgcgtgacaaacaccagcatctcgcgaccgtccccaaagcaggcgtccaggaagtccagggcgttgtccaggcgggacgcgagcccgcgcgcctcgtcgtccgcctggcggtccctctgccccagcagcgagagggcgagaccctctgcctcctcgggagagccgcccgagagcatggcgcgggcgacgtcggttcgcaggtcgtccgccagctccgcacgcatcgcgaggcgcagctggcgtgacgcagaggcggagcctgagcctcgcgcctcgtccagctccgagcgcgcctcgcgtgcgagggtgtcgagcgggccctcggacccctcgcgggaggggcctccgcccatggcggtgacgcgcccgcgcacccaggagagggcgtctcgcctggcacagagcgaatgcgcctgcgagaggagggcgtcgaggaggaggttgaccagggcgacgcgctcgtcgaacggggcctcgcgcgcccgacgcgcgatgtcgtcgcccgcctcgccctggagtatggcgtccaccttgtagtcgtcctggtacttctcgaacagctcgaggtacagggagaagtcctcggcgacctcgcggtcctggaggtactgggacacgagctccgtccccacgtggagcccctcctgccggtatgccacgagcatgcgcgagaggtcctcccagccgcgtgcggtgacaatcttggacccgttgacgctcgcgcgcacgcggtagaagttctttggcttgctggagaggtacgtggtgatcgcggggtgcaccccatgggtcacggcgtagtccatccacacgtcgaggtccggctccacgtcgatgcgcttgaggcggtccatcatggcggggtcgaactctcgggcggcgcggttgtactcgggagggttgccggcgcacacgatgacccagccctcgggaaggcggtgctggccaaaggtcttgtactgcaggaactgcagcatggagggcatgagcgtctcgctcgcgcagttgatctcgtccaggaagaggatcccctcgctcacgccggtgcgctcctcctcgtcgtagacggcggcgatgatctcgctcatggtgtagcggctcacgcgcacgctcctgccgccgtaggttgcctcggcgatgtaggggaggcccagcgcgctctggcgcgtgtggtgcgtgatggagtagctcacgaagttgatgcccaggcgctcggcgatctggctcgctatggcggtcttgccgatgccgggaggccccatgaggatgatgggtcgctgcatcatgggcgggacaaggtacaggccgtgggcgtcccgggccaggtaggcgcgcaccgcgccctcgatctgctccgttgccgagcgaatgttcatagtgccctccttggtggcgcccgcgcggacggcgggcgcacaggcgtcagtacactgacatcgagcggaactcacccggccgcagggtgagctgtatggcccagggcggcacgagctccggcctgtggtcctcatcgtagaagacgaaggcggtcttgtagggcggcatcctggtgggatagatcccccagccgtccgtgaagtagatgaggcccgcgaggtccgagaactcgcccgcgcccgcgagctcgctcacgtagcggaacgcggggcgaaagtccgtgccacccaggccgcggagcttgacctgccgcctccagcggtcgaggtcggcgagcgaggtgatcttggtgtcgctctgcacgcgctggtccgcctggacgatgtgcacgttcacccgctgcgagaagctcgactcgcttgccaggacgtcgtaggtcgcgtctacgaaggcctggaccacctcgtgcgtgaccgagctggaggtgtcgatcacgatcacgaagtcgcggatcctccgctcgtcccggtactccagtggctcgatgagcggggtgtccccgtacagcgagagcccgtaggtgtagaagacgtagtcaaactcgtcgtccgagacgtgcagctcctcgctgctggtggcaaactgccggaggaactcgcggtagtccacctgctcgtggtccgagacctcgagctggtggacgagcccgcccagccgcgtgccccgcttgcgggagagcgtctggaggtccacgcgaacggatctgcccgcgcgctcccagcgctcgcgtgccgcctggagctcggactcggtgggggtcgatgccgcctggtggccgtccggagtctgcggcgcgccgtccgtctcgcctcccgccccgccctcgcccggggcgtcccgtcccgctccggcttcgctgggcttgccttcggcgttgcgtccgtcctcgggtacgcgaccttctcccttgccctgcggaccggattggggagaggcgccgtccccctcgccccggccgctcccggcggcgtcctggtcacggtcccccgcgcggtgccaggccgagtggtcgtccaccaggaggatgcgcgcccagcgctcgcggctccccgcgaagccgccctcgacgagccggcggtagattcgctccgcgctcggcgagggacccagctcgcgtgcgacctcgtccagcgcctcgtcgacctcccggccccgctccccgtgccggtggcccatgagctcgcgcgccatgtcctcggccaccaggtcgcaggcaaggtcccagcacgccgggtcgacgccgcgccccacgaaggggtggagcagcaggcagtgggccagcacgtgcgcgtagtcgtgcgagggcgccgtcctgttccgggcgaagtcgtggaggagcacgtcggggtctgccaggagggacgtcccatcggtgcggaaggggagcccgatggcggcgagcgaggtgggcgagaggcccacggcacccgcgaggaagggatggcttgcgatgacctcgctgcgcgcgaggtcgagcacctggagggcaagcgcgtctcgctccgaggggccgccggcgtcgcactcgtcgcccgcattcgcctccggcgccgtgtcgcgcgtcgcgtcggggtcgcccgcgcggctcagcgtcgccgtgggggagaggggcgcgacggcgttgcccccgccccctcccatggcagccggcgagtgcgtggcgtcgtccgtctcccctgcggcgggggcgtctgccctacttccgcgcagcctccccaggagccaggctgcggcctcggcgtgacccgccttgctcgcgatgcccagggcgcgggtgacattccctctccccatggtccgcggccacgccgagatggcccgcagtccctccatgtcgccctcgcccgcaaggatgccgagcagcctcccgttcagccgctcgtcggccgacggggagagcgtcggcaccagcgacgacaccaaggcagggtcgtcctgcagccaggggcgctcgtccaggcagcggaagaagacctccggctcctccctgcacacgaactcgaccatccgcctgctcgcccgtggcacgaccaggttggacatgacccgctcgaagcggtcgtcgcccatcccacgcgagaggtgcaggtcaaccatgcgcgagcacagctccaggcaggtgcctgcgaccccctcgtcgatctcgccggcgtggcggagcgcgtgccaggccctcacggcggccgcgcggaagaggtcgtcgaacgccacggggtcgaacaggccctcgcccgcgagcctccccaccaggtcgcaggctgccccgaggtccgtcccgcccccaaacggcacgccctcgagctgctcgccctcgcgtgcctccccaaacacgtcggtcgacagcgtggggtccatgttgttcaggaacagggtggggctcctgcgggtgagggcgaagcgcgtcaggcgcccctccggcgggaggagccccctgcagcggcgtgggacgcgcacctcgcccagcaggtcgaccccgcgggcgagaaggtcgcgggcaacgtcttcgcgcgcatgccgcagcgcgaggcacagcgcgaaggaggggtacgcaaagtcgccgtcgaacgcgtcccacagggcgtcgaggtcgtccacgcccccaagacaggcggcgcgctcgaggaggtcgaccgcctgcgtggcggtcacgaggtcgcgcaggggagagagccgcgccgcgagcgagcggaacgagccgccgcccccgtcacccagggcgtcgcgcgcccccgcgacgagaccctccgcaacgtcgatgccgtccctctcgcccatggcagcctcctcacggcaatcgtacacgagccgctccgtgccgcgttcctctgctccgccagtcgcacgggtgtccagcgggtgggcggtatggcgattattgtgggctgagcatggcgtatgtggagtgggggtatcctgaatcggttccaagcgaagggagaaggatgatcaagctcgtgctcagcgacatggacgggaccctggtgccctttgggcacacctccgtctcgagacgaaccctctccgcgatagcggagctccgcgatgccggcatcgagtttggtcccgcgagcggccgcgagccgtttgacctcatgggctacttcgacgacgaccagaccatgggggacacgggcatcttcgccaacggcaagctggtgcgcctggacggcaaggacatcttcaagctcccgctcgaccgcgccggcgtccaggccctcgtggatttcagcgcgcgcagcgacgacctcgccacgctcgtctgcagcagggagcaggcgcggcgcggccttcccgcgttccaggtgtttggcaccacgcgcgagcgctttgccgagtacaccgacgaccccgacaccctcagcgtccccatgacggtgggggaggagctccctgccgaggacatcctcacggtcgacctcgtctgcctctcgcgagacccggcgcggtttgcggaggcgcgcgaggaggtcgtggcggagctgccgcagttcgacttcgtctcccccggcccgggctgcctcgacgtgcttccccacggctggaacaaggggaccgcggtggaggtcctctccgatgccatgggcgtcgacgtggagcagatcgccttcttcggcgactcagagaacgacctcgccctcatggcgcgcgttcccaactcgttctgcgtgggcaacggaacggaggacgcccagcgcgcggcccgctaccacatcggtgactccgccgacgactccgtcgccatcgtcatggagtccttggccagaaaccacgggaggatcatggtgcccccggagacctcgcgggactagtcggctgcccaggccgaacgtccgggcgagaggggcgttcggtgccgggccggggagggctcccgtcgggatggggagcccccgagctggcagtttccgtcgcatgacccgcagcgttgccgagtcgttgcggtccctctggccaaaggctcatgggatagggtcaaagaaggggtgcgataggttgggtgccgcggcttcgtggtggttcttttctgcggtgttgtccgaggcgtgaccaggtcgtttcggcaacgtttgccaagggcattaggataggcctaagaagggtgcgatagaccgagttccgcggctttggagctgttcgctcccgcgacgaggccccggtgtttctctgccgtggggggcacctctgccctgggccaacgggatgggtcgaagaagggatgtgcgagtaggggggcgccgggtgtcggatgtcaggtcgtcccgaagctcttccagagggcgggcgtggccggtacgatcggagaaacccgtcatcttagaggaccgggtgtccgcacggcaggctgacctaatggcttaaagtttccggtgcttgaacggattggagggtcgggctgcttagagattccggtgtgggaatggattttgaggacagatgcttaaccccgccggcaccagaacgagcgcgacgccggtaaacccatacgagccccaggaactttaagcacgcaggaggcccaacccatacgggccccaggaactttaagcacgttggagccccaatccgcgcggggtccgggagcgttaaggaaacgtcggataaaccggaggagcgaatcaagggacaggggtcacgtgccgtcccgattgattcggtgtttccctaagcgtcctactccagcagggagaggggctttccaccccctgcgtctaaggcggaggggccccgcggcatccgcgagacccctcttggaagctcgtgccctcgctgccggcactcgtgctcgcgcaatggctacgaggcacgctcgcgcgagtcgggcgtcttgagcatgaggacgaagccgatcacgaagagcaccacgatggagaggacgcccagggagccgtttccagtgagggcggtcatggtccccacgatgaaggtgcccatgatggcggcgtacttgccaaagatgtcgaagaagccaaagtactcgttggcgtgctccttggggcagagcttgccaaactcggagcgggacagtgcctggagccctccctggaacaggccgacgaggagcgccaggatccagaactcgcgggcggtgcgcaggaagaacgccgcgaacagggtgatgaacgtgtagccggcgatgcccacgagcagcatcctcttggtgccgaccttggtccccagctttccgtaggcgatggcggaggggaaggcgacgaactgcgtcacgagcagggcgagcacgagctgcgtgccgtcgatccccaggtcggagccatagctcgtgctgagcttgatgatggtgtgcacgccgtcgatgtagaagaagtacgagaggatgtaggtcctgagcccgcggtcggcccagatcttcctcaacgtggtgccgatccctcgggtggcgttgcgaagcgcatgcgcctggaggggcttgtagtgggtctgctgcacgttcctgagcatggggatggtgaacgcgacccaccatgccgcggtgatggcaaacgagatctgcatggccgtctggagcgagatgccaagcgacttggtgttgagcacgacggcaaggcacgcgatgaacggcacgcagctgcccacatagccccaggcatacccctggctcgagacctcgtccatgcggtcgtcggtcgtggcgtcgatcaggagcgcgtcatagaagaccatcgacgagttgagcatgatggagctcaccacgtagatgacgagaaatgccatcgcgctggtggggaagcccatcgcgacggtggcgaccacgcccgtgcccacggtgccaacgatgaacttcttcttcatcccctgcatgtcggcgatggagccgaggatgggcatgagcagcgcgatcacgagcgatgcgaccgtctcggcatagctccacgccacgagggcaggcccgtcggcgagcgacttgaagtagatggggatgacgctcgtcgcaaggaggacgagcgcggagttccccacgtcgtacatgatccagctcttctcggccttggtgaacttggtacgcacggcatcccctctcactttggacagaacgcacacagattgtatggttgcgaaatctgtggaaaggtaagggtctcgtaagcggtgccgcccgacgggatggacgcgcgccccgccgcccatgcggcatcacctctcgcctgcatgacgtttaagggatttgtctggtgacatttgcaccttgcatcttgggggaataagctcgaacatctaggacgaggactgtgaagggagacgccttgcctgcgatcatgacccatgacttctttgggaaggatgcgtactccagcgcctcgactcagctggggctcctctcccttgccgagcacgacgcgttcctcctgggcaaccaggggccggaccccctcttctaccttctcgcggacccacaggtccccgcatccaaccgcattggcgacctcatgcattccgtgcggccggcacgcctgctcgtctcgctccatgacgcgctgagcatgctgtcgcgctccgaggcctccgtggggcgtgcgtacgctgcgggcttcctgtgccactacgccctcgacagcgccatgcaccccctcgtgtacttcaacgagtacgccatctgcgacgcgggcgtggaggggctggaccgccgcgacggggggttggtgcacgcggaggtcgagcgcgactttgacgagatggtgctctacaccaagctccacaagacggtggcggactacaagccgtacgaggaggtcctggccgccgacgaccccacgctcgccgtgatagacaagctgttcttctacatggcgttgtggacgtacagccgcaccctcgacctcgactgctacacgcatgccgttaaggcgttccgcctggtccagcacctgttctactctcccggccagaggaagacggcagtgctctcgccgcttgagcgtgccttcacccacaaccgctactcgctctaccatgccatggcccatcgcgacagggctgagctcacctcggacttcgacaaccacgagcaccaggtgtggaggaacccgttcacgggggaggagtccaccacgagcttctgggacatttacgaggacgccctcgagggcgtcacctccctgcatgaccggttcttcgaacgcgacttcgacctggaggacgccgaggagataacgggcaacctcaacttctcgggccagccgaccgacccggacgacaccgaggagcctcacgagccgccggtgggggtggccctgtagccgtatggtcagcctcgccacgcaccacgtgatgcaggcatacaagagcaaggacaccaagcccgagctcaaggtgaggagggccctacgcgaggcgggtctccccggctaccgtctgcactggaagaaggcccccggcaagcccgacatctgctatcccgggcgcaaggtcgccatcttcgtcaacggctgcttctggcatcgctgtccccactgcgacctcccgctccccaagtccaacgtggacttctgggaggccaagttcaggcgcaacagggagagggacgagcgcgaccacctcctgctcctccagggcggctggacggtggtcgtggtgtgggagtgccgcctggggaaggaccgcttcgaggggaccatgcgccaggtggtccgcgaggtggagcgcgcgggtgacggctctcgctccggtgggaggctggtggaggcaggggcgcccgagccatggaagctcgtcatctaccacgagcgcctgaggcgcatcagaaagtgacgcgtgccacgatccccacgagggcgattggcgtcaggggcgggtgcaggctacactgtgcttgcgcaatcacccacaggacgggaggaggggcgctatggcaacctatgcgttctctgacgtgcacggacacaaggccccgctcgaccgcctgctcgagcgcgtgtccccctcggactccgacagcatcttcatgctgggggacatgatcgaccgcgggcccgaccccgtgggtgtcatgcagctgtgccgcgacctgccgggcgcaaccgtgctcatgggcaaccacgaggacctcatgctcgacttcttccgcgacccgcgggacgacatggcgtcgtacaactgggagatcaacgggagccagaccaccgtccgcgggctctccgagcttggggacgcggggatgaccgacctggtggagtgggtcgcccagcttcccgtctgcgcccatgcgagggtgggcgagcgcgcctatgtctttgcccacgcggggatacggtcctcctcggtcaagtctcgcgactcgtgggacgacgagtccattgagcagatgctcggaagccagctcgtggacgacctcatctggattcgcgaggagttctgggggcgtcccacggggctcgtggacaaggacggcagggggcccatcgtggtggcgggtcacacgcccaccgcctacctcgacgacatggcggaccaccccgatcgtcccggggtgggcgaggacggcctgtgccgcgtcgtccgcgtgggtgcctgcgaccagacgggcggcgtcgccgaccggtgggacatcgactgcggggcggccggcggccacggctttggccaggtgggcatggtgcggctggacgacggcgcggagttctacgagcccatcggcgagggagagtagcgtggctacccgcagggatgcagtcccgacgcacgtggagtcgcctctccccgcggtctttgaccagtcctcgcgcgtgctgctgctggggtcaatgcccagccccaagtcacgcgagaacggctttcactacggcaacccgcagaacaggttctggcgcgtgatcgcgtcgctctggggcgaggacgttccacagaccatgggacagcggcgcacgctcctcgcgcgccgccacatcgccctccacgacgtgctggcgagctgcgacatcgtgggcgcaagcgacgcgtcgatcgagaaccccgtgcccaacgacctggggcccatcctgcgggtggcacccatcaggggcatcttctgcacgggctcggcgtccgcccgtctctaccatcgctacatcgagcccgacctgggcatcccctgcacgcggctcccttcaacgagccccgccaacgcctcgtggacgctcgagcggctcgtggaggcgtaccaggtggtgcggcaggtcgccgacggaacggacgagggatgacctcgggaggggagaggggcgtgtcttccaagggctgtgggatccgcctggtggcggtggacgaggacggaaccttcctccgcgaccaccagggttacgacgtcgagcggttcgagcgcatctgggggcggatggcggagcgtggctgcaggttcgcggtcgcgagcggcaaccagtactaccagattcgcgacctcttccccgcccacgagcacgagatggggttcgtgagcgccaacggggcctacgtcctcgacggcggcgaggaggtgttcgccgcacgggccccgcgcgaggcggtcgaggccatgatcgactacgcccacgcaaacccggaggtgcccttctccatgctcggggtccgtggcgcctacgtggagcggggcagctcccagtggttcttcgacgacaccgcggtgtactgccaccgcctcttttgggtggacgacttccgtgacgtggacgaccaggtgttcatgttctcgtccgttgtggacgggctggacgaggccatggtccagatcgcgcgggtgagagacgcgctgggcggctccatggagcccgtctccagcggtgacggctacttcgacgtcgtgacgcccggggtgcacaaggcctccggcctgcgcatgctcatggacaggtggggcatctcgccctcggaggtcgcggcctttggcgactcgcacaacgacgtcgagatgctgaggatggcgggccgctcgtacgcgatggcgggtgcccccgacgacgtcaaggccgttgcgggccacgttgcgcccccgtgcgaggaggacggggtgctgcgggtcctcgagggactcttccccgagtagccctgccctgccaggggtgcgggtcgggggtggagcgtgtggattctctccccagcggtggcgcaactctgccagaatgtcaggtgcccaacgacacacgaagcacaaacggagaagacgtcgatgaggcttcgagacatgacaaggggccccgccggccagggcatgctcgcccaggcggacgcccgcaagctactgcacggctcggtgcgcgtcaccggcgagcgcgagggctggttcaggccgtggcgcgtgacggatgcccagatgcgcgcgctcggcagctgcatggcctggcaccccggcctctaccggcagatgggccgcaccaccgccggcatctgcctggagttcgagacggactcgtccgaggtcgccatcgaggtcacgctcgaccccgagccctccggcacggctgcgatactcgaccacgcccacgaggcgcccgccgacgtgcgcgcaccctcgcatgacccccgggagggcgaggccacggagtttgccgccgcggacggcgagcaggccgtctcccccggcggcgcgggcggcgaacgtcccgcgttcgacggcctctcgtgcgacgtggacgggcgtcacctcctggtccggcttcccgccgcaggcgacgacttcgttgccttctcgatcgacgaccccgactccgcgcccgcggacggcatcatgcagcttcccggcatgggggagacgcaccacgtgcgggtttggctgccctgcctgcgcggctgcacgctccgctcggtggtgggcaacggcacccacatcgaccccgtgccgcagcggaaggcgcttctggtgctgggggactcgctggcgcaggggttcacggtgggcgaccctgcgctcgcctggccgtccgccctcgccacggggctggggctcgacgtggtcaaccaaggtatcgggggccaggtgttccagcccgggacgctgtcgggcctggcgggcaccgtcgacgtggcgcgcatcgtggtggagctgggggccaactaccgctttgagccctgccgcgagcgcctcgtggcgcgcgacgtctacggcttcctctcggaggtctcgcgcctctggcccgacgtccccacctgggtcaccacgagcacctggcacagcgaggacgactggcactcccacccgctcagctgctggcgggaggtcgacccgctcgtgcgtgcccaggcggagtcgcacgggcagatgacctacgtggacggctcggacctgatggaccatcgcgtctcgctcgtgaccgacccctacggacatcccgggcgagaggggaacgcccagatcgcgcgcaggatgcgcgtggcgatggacgccctcagggggactgatgacgagcgtcgccgccgtgccctggacctgcttgccaagggcccgcgacgctgcctgcccatggccgagatgctcaggcgcggcatcggggaggtcacctatgccgaggagggctgcgtcctcgtgcgcgtggggaggtggcaggagatctgggcgagcgaccgcgacctcgcgcgcgacgtcatcgccatgctcgtgacgtccgacctggtctgctgcctggaacccgcctgcgtcagggacctggagctgctccgcggactcaccgtggtggagcccgagcacgtgtgcgtgtacgaggggagggaggcacccaggcttcccaaggcattgcaggggagagacgtacgcccgctcgacccctcgtggctgcgcacggtgcgcgagcgctactcccacccgtcctatgtcaccgacgtcgagctgctggggctcctccgtgacgggagggtcctcggtgggttcgaggacggggagctcgtgggcttcgtgggcgagcaggacagtggcgccatggggatgctcgaggtgcttcccgagcaccaggggggcggatggggggccgtcctggaggccgcgaagatcgccgacgtgctgtcccgggggcaggtgccctgggccgaggtgtgggcggggaacaaggcgtccctggccatccagcgcaggctgcacctcaaggtgctcccctccaacgaggtctgctgggtctctcgcccggtgcagcactcgccgctcgagggcctgctccgcggggacgacgaggtggcccctgcgccggagggcgagcgggagagtggcgaggcgccggagaaggacggcactccagaagagtcgaagccaggcagcgcgctcgaggcgccgaagccggacggcgtgcccgaggcggaggaggcctcggcgggcgagacgggctgaccccctcccccgctcccgggctgccgtcgcgtcgcccggtcgggccacagacgaacgctcgtctcgccctcgtcctatactgttggccccgaggcaacatttcgaggggcggcgacggagtgatgagccgcctgcgggggaggtctccgtggctgtggtttctgcgggcatcgacggcgcgcgtggcgaggggcgagacgcctctggcggcgccatgaccggccgcgagatggaggacgagttcgtctccatcgcgcggtcgctcggtggcgacgaggacggtcgccgcgggggcagtgcctacctgcggcagacccacgccctctatcacggcgggccctcgccctgggcgttcacgcccaagatcttcgacgaccgcgaggctgcggtgctgcgcgacgccgcggagcagatggggcggatcatggaggcggtcaccgcccggtttgtggaggacccgcacttcaggtcgctcttcgccctcccgccctacctcgaccgcatctgccaggtgcccaccggctactcgcggatgatccccctggcgcgcgtggacgtcttcctcaacgaggagacgggcgacttccagttctgcgagctcaacaccgacgggtcggccgggatgaccaacacggtcgagatcacccgtgcgatcgagcggagcgcgacctggcgcgagttcgcccgccgccatccccggtacgaggcgttcgacgtcacgtcggcctgcctcttcgcgctgcttgacacctacgcggagtgggcgcgcggccaccgcggcgccccatgcctggcccatccctcgctcgtggtggtcgactacgccgactccgtctctgccgacgaggtggacgacttcctggggcgcatgcgcgacctggggatagacgcgcgcttctcggatgtccgcgacctccgcgtgggggagtgggacggcgacgagctgctcctcgacgaccagggccccattgcctgcgtgtggaggcgcgccgtcaccagcgagctcgcgcagaggcgctgcgccggtgcggacgcgctggtggacgcgacccagcgggggctcgtgtgcaccgtgggcggcttcaggacctggccctgcgccaccaagaccgtgttcgcggtgctgagaacgcccgagtgccgcgccatcctcacgcccgagcagaacgagttcgtggagaggcacgtccctctcaccctgatactgggcgcgcctggagccaccgacctggcgcggttctcccagagggagcgctggatcgtgaagccctccggcggttacaactcggtgggcgtcacggcggggatggacgtgaccgcagaggagtgggaggagcgcctgcgcctcggcgcgagggaccacgacgtgatccaggcgtacgcgccccaatacgcgacgccggcgatggcgggcatcctggacggcggcgatgaccccatggaggcggaccccgccaacaacatggagggcctctacctcttcaacgggcggttctgcggcgtctacacgcgctgtggccgcaacagcacgatcggcgagttcacgggaaggctcaacatgggcgccttcgtggtccatggcgatgccggggcgacgtccgccgcgaggggagatgagtagcgtgaggctctcgaacaggctggcccccgacctcacgggggagctctccccccgtgccgaggagctcgtggggcagcagctcaagcggggagggctctcgcactacgcctgcgccaacgcctccgtcatccgccgagacgacgagcgcgaccgcgacacggtcctgcgtcccgcgttcgtgcgcgatgccgagaagatcgtgcacacgcccgcgtacaaccgcctcaacggcaagacgcaggtgttctccttcaggcccgacgacgacctctgcaggcgtgggctgcacgagcagctcgtgggtcgcgtggcgcgtgacatcggcagggcgctggggctcaacctcgacctcatcgaggccatcgcgctgggccacgacatcggccacacgcccttcggccatgcgggcgagaggttcctcaaccaggtgttccacgaccgcaccgggcgctggttcttccacaacgtccagagcgtgcgcgtgctcgacgtgctctacggccgcaacctgtcgctccagaccctcgacggcgtcatctgccacaacggggagttcgagcagcaggagttccacaccagcgggctcacgagcttcgacaccttcgaccgcgtggtgcatggctgctgggagtcgggcgacgaggccataggcaagcttaggcccatgaccctggagggctgcgtggtccgcgtgtcggacatcatcgcctacgtgggcaaggaccgccaggacgccattcgggcgggactcgcggacgaggggagcttcgacgacgggcttggcggggcgtacaacgcatgggccctctccgcgttcgtagcggacgtcgtggagaacagcgtcggcaccgaccacatcgccatgagcgaggaaggctttgccgagatgcgccgtgccaagcgggagaactacgagaagatctatggttcgagcgaggtcaacggcgacttcccctccagggtcggcgagctctttggccttctgtaccagcacgagctcgacgccctcgcggagggtgacgagtcgagcgcaatcttctcccaccacatcaggccgctggagcgccaactgggccattacggtggggagtacgactgggagacggaccccgaccagacggtggtcgacttcatcagcgcgatgaccgacgactacttcgtcgcgacgtgccaggcgctctttccccaggcacgcgagctattcccgcgccggagctacttcgatggggtgcgcccctagccgcagcgcctcgcgacggcaactggaccgggccccagccttgctaagcgtgacggcgattggctgcctgagcctcatcccggggttcgccgtttgagccccttgcgttggccagtgggcccgtggagaagagatctgccctagggcattgatgacaatcgccatgggtgagcgaccctgtcgaaagtaggctgacgaggggtacccctggtaggcgcctggtcgccgtgggacgagtccttggggccaaagaggggggagaggacatgagcctgtgcctgcgccgccggggcgacggttgccaaccgggttctctcgagcgtccgccctgtccgcgcatgagactgtgagccttgcggcgggagccacgcgtgagcactcgcgcgggtgagctcccaccatatgacttatcctcgatggtcgcggtggcgaccaaagcccgatgtgagtacttctccgttggaagatgacccagggaatcaggtcagacggacgttttaccaggcggaaagtaccacggggtatgcctgccttcccgcccatggcggcaaactcccgaagtgagcactcatatcgggctcctgctgccatttgagtccaatacgtgagtgagttggcagctaactcccgaagtgagcgctcacatccggagctagctgccaaggttaaagacctgatgaaaacgcaacaggaaatacgttgattccgaccatatcccgttgcagtgaggggcgtacgcaagcgcacacatcgggctattgccgccagggttggaagattgatggcgtatttgcgtcaggccgctgcgcgagggccacggatgcggggccgacgagcgggtgcgctgccgtttcggcactgacggccccgcgcctccgtcttcgggttctttcaagggacccttcgtgcggcagcgtgagtgcctcggaacctattttgctgacgcgtggaggagggccaggggtggtgaaggccgagaccaacgtggcgcgagaatcgggcctcccgcatgcgtgaggtcccagccggggggttgtcccacgtcccgctgggattgccccctctcgccagcatcctgacagcggattgcacgaccgatgacagtcagacctcgggacgcgaccttcacgagccccccacgaggggaccgccagggcgccgcatagtacaatcggggcatggacaccctcttcagcaacatcgagcgctccaagcgcagggccaacgcccctctcgccgtccgcatgcgtccccagaccctcgaccagtacgtgggccaggaggaggcggtgggcgaggggtcgtggctccgtcgcgccatcgagcacgacacgctctcgtcggtcatcctctacgggccggcggggacgggtaagaccacgctcgccaggatcatcgccaacaccacgcacgccgagttcgtggaggtctctgccgtcacgggcacggtcaaggacctcaggcgagagatcgacaacgccaactcgcgcctcctcgcccagggccggcgaaccatcctgttcgtggacgagatccaccgcttcagccgcacgcagcaggacgccctcctccacgccgtggaggatcgcaccgtggttctggtgggggcaaccaccgagaacccctacttcgaggtcaacggggcgctcatcagccgctcccgcgtcgtggagctccatccgctcggcgacgacgacatcagggcgctcgtgcgacgcgccctcaccgctgaggaggggctgcggggcgccttcaccatcggggacgacgcgctgcgcgagatcgtgacgctcgccgggggagacgggcgcgccgccctcacctccctcgagctcgccagccagatggcactccccacgggggacccgtcagaggcggacccggagcaccccctcgccatcaccgtccagaacgtgctggaggcaaaccccaggcacgggcttccgtacgacaagtcgggcgacatgcactacgacatcatctcggcgttcatcaagtcgatgcgtggcagcgaccccgacgcggccctctactggctcgcgcgcatgatcgacgggggagaggaccccaagttcatcgcccgccgcatcatgatctgcgcgagcgaggacattggcaacgccgaccccaccgccctcctggtggcggaggcggccttcagggcggcggaggtcatcgggtaccccgagtgccgcatcaacctcgcccaggcggcgatctacaacgcgctggcacccaagtccaacgcctgcgaggcgtccatcgaccgcgctctcgccgaggtgaggaacggcccccggcgcgaggttcccaaccacctgcgcgaccggcatcgcccgggctcggagacatacggggcctacctgtatccgcacgactacccgcaggggtgggtgccgcagcagtacctgcccgacggcctcgagcccgggtccctgtaccaccccggcccgcgcggctgggaggcctggcgcatcgaggccaccgcgcgcgaccgcggcatcggtcgcggtcccaggcggggcacggatgcgggcgagaggggtggcactgtcggcgacggggacggcgtcacgccgggagaggggtagcctgggcgacacccccccgcgcctgcgtaggatattcgacttgtgggggtgaccggtgcatcaggcagtcgtcggcaacgttcctcttgccgccatcctctgcgtccccgtcggcctcgcgcttgggaggcccgcatgccttgccgccgcatggatggagtcccgccgcgggctcgtcccctctcgcccctctccggcgaggtcgctcgcctcgggtgccgcacttgccgtcgagctctcgtcgctcgccgtccgcctcgggccgtccccgagcttcctggggctctcgctcctcgccgcgtccctcgtcgtggcatccctcgtcgacctcaactgtcgcctcatacccaacgggtgcatcctcgctggcgtcgcagcccgcgtcctctccctcgcgctcgcgggcgcatccggggagctcgcgtcaggtgacctggcacggctccttgcccggtcgggcctctccgcgggcgcggccttcgccctgctctcattcctcgcgctcgtgatggaccgcatcctgggaggcgcgagcgtcggcgggggagacgtgaagctggtctcggtcgtggccctgcacctgggcctcgcgaaggcgatcgtcgccgtactcgtcgcgtgcgccctggggatcgcgtcgtgggcagcggcgaggcgcgtgcgtggcggcgaggggagaggggacgggacctttgcctgggggccgtccatcgcggtggcctcctggctctcggcgctctggggcgaccgggtggtggcgtggtacctctcgctcctcgcctaaggtcggagccaccccgccgcggcgggtctaagcggttgcaaaacggatagaatcagcctagggcgtctcgtcaccgccccgcccgccgaggggtggcaagcggtgcggaggcccggctcgccctgtgccggctggcctcgccaccggcatgcgccacccatgcacccacgttggagggaaacccatgagtcctctcgatctgctcctcatcgcgctcgtagccgtcgcaatctgggccgtcgtggagcttgcgctcaccatccgccgcgcacgcgcctcggtcgacgaggtcaccaagacggcgaacgagaccatcgagcaggttcagcccgtcatcgccaagctcgacggggccatggacgacctccagcccagcatcaagcaggtggaccccctggtggagaaggccggcgtcgccgtcgaccaggccaacgagagcctccggcgcgtgaacggcatcctgggcgacgtctccaccgtgtccggaaccgccgcgggcgtcacggaggccgtgaacaaggtggcgggcgaggcggcgaactcggtcggcgccgtggtctcgaggatcgcgggaaagcccgcgcagggcgaggcaaagcacctcgagcccgccccaggggcggagcgcgaggacgacgccccgcgcgaccgcggctacgtcacctacggtgaggcggcggcagacgcgcccgccgaggaagagaacggacaggacaggtaggcgtccccgcggtcgtgtgggacggaacgaggaacccgggagagagatgtcagagagcaacgtgagcctcagcattccggcagaggcaggatacgcgcgcgccgtccgcatgatggcggcaaacctcgcggtcatgtgcgacatgagcgtcgacgacgtggaggacgtccgcatggcggcggaggagggcttcgtctacagctgcgccaccgcccccaaggcgtgcgacgtgagcttctcgatgggcgacggctttttctccatggacttctcgcttggcgagcgcgacatcgaggacgccgagtccacggaggacctcggacttgtggagctgctgctccaggcggtctgtgacgagtgcgaggtggcggggggagccctccacctcgtgaagcggaacggcggtgcgcatgcctaacgcggagggtacggaggagcggagggccgcgcgccgccgcctgtcgacacgcgcccccaaggggaagctcgcgtgggacaaggagcgcacgcgcgagctgttccgtcgctacaaggaggagggggacgaggaggccagggagcagctcatcgtgagccatctcaacctcgtcaggttcctcgcctcaaagttcaagaacaggggagagccgctggacgacctcatccaggtggggaccatcggcctcatcaaggcgatcgaccgctttgacccctcgcgcggcctggagttcacgaccttcgcgacgcccacgatcctgggcgagatcaagcgccacttccgcgacaaggggtggtcggtgagggtcccgcgcaggctccaggagctgtccgccaaggtcaaccaggtcacggacgagctcaccaaggaactccagcgcagcccctcggtcgaggagatcgccaacgccctggggacctcggtggacgaggtcctggaggccatggagtcgtcgagcgcctacagctccgtcccgctcgaggggacgggctccaactcggacgacgacgcgccgtcggtgatcgaccactacatcaccgaggacgagaacctggcctcgtcggacgaccgcatggtcatcgaggacgccatccgggacttctcccctcgcgagcaggacatcatccgcatgcgcttcatcgagggcatgacccaggtcgagatcgccaagaagctcgggatctcccaggtccaggtctcgcgccttctccgcaggaccctcaagaaggtacaggagaagattgaccctgaaggtcttatgcactagggcgtgtaaaaaccgcccggcactcccctgctgctacaatgacttcccgtcaaacagcgggggagtgcttctattggttcatacgtcacgggactcaggcgagtcggaaacgagctatcgcaaggcgctgcacgtgggcgcccatgcgtgggccctcatcggcgtcctcgtcgccgtggcgctcgtggcacaggtcgccgggctcgtctcgcaggccctcgagctgctcctcgtcggcgtcatcctcggcttcatctgcagtcccgtcaccaactggctcgaggaccgcaacgtcccccgcgcgctcgccgcgttcctcgctctcgtgttcgtgctcgcggtcttcgtcctggtcgtcgtcctgctcgccccgccgttcgtgagccagctcatgcaggtcctccaacgcgtcccgtactacgttgagcaggttcgctccgccatcgccgacttctggacccagtacggcacctccgagaccgccgacgtgaaggagagcctggaccaaacggtcgcctcgctctccaacctgggcgtcaagatggcatcggatgcaacggccaagctctcgaacggcctcatcagcaacgtcgtctccacggtcaacaacgtcttcaccatcttcctgggcctcgtcgtggcctactggcttgccaaggactacccgggcatcgtccgcgaggcgacggtcatcgccgggccccgccgccgcgacgacctcctcgtgctcctgtccatcctcagcaggtcgatgggcggctacatgcggggcatcgtgatcacgtccaccgtgggcgggctcctctcgttccttgggttctccctcatcgggcacccctttgcggggctcatgggcatcgtggtgggcatcttccactttgtccccgtcgtcggcccctggctcgccgcggccatcgcggcgctcctcgccctctcggtcagccccatgctcgccctcgagtcgatcatcgtctcggtcgtggcgcagaacgtcacggacaacctggtctcgcccctggtcatgcagtctgcggtcagggtccacccgatcctctcgctcacggggatcatcatcggcaacgccctgggcggcgtcctcggcatggccctcgccatcccgctcaccgccgcggcgcgcggcatcttcgtgttctacttcgagaagaggacggggaggcagctcgtctccgaggacggaaggctcttcaagggggaccgcttcgcaaatgacgatgggtctcccaagcccgcctccgacgccctggacgacgatgacttcctcaagggcagccgcctggtgccgcccggggaccccggggggagaggggactgacctcccctcgccatcacgccgaggggcatttgtccgtctcgcttgggacgcaagcacgtatcattgaacggcatgacaacgggcgccgctggcgcacgcaaccaaaacgcaaggagaagcatgagcaccgctgacttcaagaccatgaccacggcacagatccgcgaggacttcctcacgttcttcgagggcaaggggtgcaagctctacccgtcctcatccctggttcccgaggacccgtcgcttctcctcgccaacgcgggcatgaaccagttcaaggagtactaccagggcaccaagaccatgcgcgagatcggagcgtgctcctgccagaagtgcctgcgcaccaacgacatcgacaacatcggcgacgccaggcacctctcgttcttcgagatgctcggcaacttctcgtttggcggctacacaaaggccgacgccatcgcctgggcctatgagttcatcacgtcccccgagcacctcggcctccccaaggaccgcctgtacatgaccgtgttcgagaacgacgaggaggccatcgagctctggcacgcccagggggtggagtacgaccacatcagccgcctgggcgaggaggacaacttctgggccgccggtcccaccggcccctgcggcccgtgctccgagatctactttgaccagggccccgagttcgagggcgagaagcccggcgacgacggcgaccgctacctggagttctggaacctcgtgttcacccagtacgaccgccaggaggacggctcgatgccggagctcccgcaccgcaacatcgacaccggcatgggcctggagcgcattgccgccatcatgcagcaccagggctccaactacgagggcgacgtcctccgctcgctcatcggcgtgggagagcgccttgcgggcgtgacctacaagcaggacccgcgcgccgacaagagcctccgcatcctcgccgaccacagccgcgcggtcacgttcatgatcggcgacggcatcctgcccagcaacgaggggcgcggctacgtgctgcgccgcctgctccgccgcgccgtctaccatggtcgcctgatgggcatcaagggccagttcctcaccacctacagccacgaggtcatgcgcctcatggcagacgtctaccccgagctcacccagaacaaggccctcatcgatggcatcatcagtgccgaggaggagcgctttggcgccaccctggacgccggcgaggccatgctcgcccgcgagctcgacgtcctgggcgagggcgagcccctctccggcgaggtcgccttcaagctgcacgacacctacgggttccccatcgacctcacgcgcgagatctgcgccaacgacggccacggcgttgacatggacgccttcgacgccgccatggaggcccagaaggagcgcgcccgcgcgacggcgaaccgcgacgcctggggtgcctccaacaacgtgtgggctgccctctccgatcgcctcgacgccaccgagttcctgggctacgacctagactccgttgacggctgccgcgtgctcgccctggtgagggacggcagcgaggtgcaggaggccggcgtgggggagaaggtcgaggtcgtcctcgacaagaccaccttctacggcgagatgggcggccaggtgggcgacaccggcaagctcacgtccgacagcgcgagcctggcggtggacgacgcgaagcaccgcgagggcgggctcgtctcgcatgagtgcgaggtcaccgcgggcaccatccgcgtcggggacaccgtgaccgccgcgatcgaccacggccgccgcgagctcatccgtcgcaaccacaccgcgacccacctgcttgatagcgccctcaagcgcgtgctgggcgaccacgtgagccaggccggctccctcgtcgcgccggaccgcctgcgcttcgacttcacgcacttcgaggcgctgaccgccgaccagatcgagcgcgtcgagggcatggtcaacgccgagatctttgccgccgagcccatcgtcaccaaggtcatggggctcgaggaggccaaggcctccggtgcggtcgcgctctttggcgagaagtacggcgacaccgtgcgtgtggtctccacaggcgactccgacgagcccttctccagcgagctgtgcggcggcacccatgcgcgcaacacagccgagctgggcttcttcaagatcgtctccgagagctccgtgggctccaacgcccgcaggctcgaggccgtgacgtcagcgggcgccatcgagtacgtggacgagcgcctgcagaccctgcaggaggcctcgcaggccctgaagtgccgtccctccgagctcgtcgaccgcatcgcctccctcgagtccgacctgagggatgccaggaaggcgctcgaggacgcgcgctttggctcctccagcgaccagatctccgacgccatcaagggtgccgtgagcctggacgggtactcctgcgtggtcgcgcggcttgacgggctgaccggcagggagatgcgccaggcgtgggacagcgtccgcgagggcgctggcaccgactccgtggcgtgcgtgctcgcctcggcgacccccgacggcaaggtggccctcatcgcggcggcgaccgaccctgccgtcgcagccggtttcaaggccggcgacgtggtgcgcgaggtcgcccagtacgtgggcggccgcggcggcgggcgccccaacatggcgcaggccggcggctccgacgcctccgggatcgacagggctctccaggcggcccgcgagcttctcggcgcctaggccatatgcgtgccctcgcgctcgacatcggggaggtcaggatcggcatcgccgcgagcgacctctccggcaccgtcgcctcgcccgtgaaggtcctccccgcgcaggaggtgctctcgcacgcgcggagcttccgtctcgtcctccaggactacgagccggaggtcctggtgtgtgggcgccccatgaccctctcgggcgaggaggggccgcaggcgaagaggattgaggctcaggccagaagcatcgcggccgcgtgcgggcttccgctggagtttgcggacgagaggctctcctctcaggaagccaagcgtatccttcgtgagcagggatacaacgagaggtccatgcgcgggagggtcgacatggtcgctgcctcgctcttcctccaggcgtggctcgactccaggcggaacgactagttaggtttcacatggcagacaacgcacgtaggcaaggttcccacttctccggtcaggcgcagccccggcgggggagcgcgccctcccggcgggagcggccccgcccggcatcgtcggtacgaccggcggcgcgaggcgaggggaagggacagccgaagcgcgcgcactaccagggaagggtctcggagcgcaccgctcgtgcgacccagagcgcccatcacaggacgccaggcgagagccacgagcgccgcacccgccaccgctgggtgggcgtggtgctcgtcctcgtcgcgctcgtcgccgttggcggggtcggctacctcgcctaccgtcacttctccaatgccggccagggcagcacgcagcaggtgcagagcggccagcaggtgtcggtgaccatccccgagggctcggacgcgtcgagcatcgccaagattctgatggacgcaggcgtcatctccgactcctccgccttcttcaaggaggttcagtcccagcaggccgagtcgagcatgaagagcggctcgtacgacctcatgactggcgccaacctctcggagctcgtgcgccagctcgtcgccggccccaactccacctccaagcggatcacgttcgccgaggggctcacggtcgcccagaccgcgtcaaaggtcgagagcaccctgggcatctcgtcagacgacttcaccaaccaggccaaggcgtccaactacgtgagcgactacgacttcctctccggggcggccaacgactcgctggagggcttcctgtacgggagcacctacgactttggcgacaccgacatgtcctctgacaccgtgatccgcgccatgctcgaccagtacaaggcaaacgtggcgtctctcgacttcgccaccgccgaggcgagtatcaaggagaagtacggcgtcacggtgagcgactacgacatcctcaccatcgcctcgatcatcgagaaggaggccctcaccgacgacgaccggaccaagatcgcctcggtgctgtacaaccgcctcaaggcggggatggcgcttcagagcgacgcgaccatgggctacgtgacgggtggcacggtcacggcggacgacctcaagacccagagcccctacaacacctacctcaacaagggactgccgcccacgcccatctgcagtcccagcctcgcctcgatcaaggcggcgctcgcgccggcggacaccaactactactacttctggatcaccgagagcgagcacgtgttctccgagacgtacgaggagcaccagaaggccatcgccaatgcgacgcaataggcggcttacgccgaggggcctcctctcggcggaccgctacattgcgtccgtcgacctcatcgacgtgggatggctcctcgacgaggggatacgctgcgtcctcctcgaccgcgacaacacctgcgtgccgcgcgacagctgggtcaccccatcagccatcctggagtggctcgaccgggtgcacgccgcgggcatctccacctgcctcgtctccaacaacttccacggctcggacgtcgagcgctctgcgagggcgctgggcagcgacgcggtccatcacgccatgaagcccctgccgttcgccgtgtgggcggcgctcaggagggagggcgcgaccccggaggaggcggttctcgtgggagaccagctctacaccgacatggcggcgggcaacctcgccggggtcaggaccatcctcgtgaggccgcagtccacccgggacctgtggtacacgctcatactcaggctctttgagcgactggtgctgggcgatcgccactttgagggggaggggcggccggaccggcgctgagtccctcgctctcccgcgaccgtcccggcccatccgcgtgccccggtgggaagcgcgtcgccagatgctagaatcgtctgcggcaaagtcggctgacttcgttgggacgcaatggcgcagtgcggacaggacgagaggggctatgtggtgcaccaggggtgcgaccacatcttcttcgtgggcttccacggcgccggcaagtccacgctcgcccgcaacctgggctgcctcttccatcgcgactacgtggacaccgaccgcctcgtggagcgcatggcgggcaagagcgtgtgcgcggtcttcgccgaggagggcgccccggccctgcgcgcccgggaggcggcggccctgaggtgcctcgccggacgcaagtcgctgctcgtgagttgcggcggtgggatcgtcgagggcggggagagctgccggctgatgcacgccatggggacggtggtgtacctggacggctccttcgaggactcgctcaggcagatccagcaccccgagatccgccccgactttgcgacggtcgagggtgcgcgccgcctgtaccggctccgcaggccgctctacgagcgcgaggcggacctcgttgtcgacatcaggaacaagacgttcgagcaggtgtgctccgaggcgggccagctgctctgggagaagggcctactatgagcgaagagaagagccaggtcgtgaggcagtgggtgtccatgcccggcggctcgtgcgacgtgcgcattggggccggcctcgtggaggggctcgggtcgctcctgcgctccgcagtcgggaccccgcacgcctgcgcgctcgtgaccgcgcagggtggggacgctcgcctggaggagaggctcaggaggcagctcaccgacggcggcttcgccgtgagccagatccacgtggcctccgggcgagacgcgcgcggctgggatgccctcgggtctctcctcgacggccttggcgaggcggggatcacctgcgacgacctgctgctggttgcgggcgacgtcgacatgctctcgctggggagtgccgccgcctcctgctggtgcggcggcgtgccgctggcgggtctgcccaccgacctcgacgcgatggtcgagtccccctgctccccgcgctccatcgccgcaggtgggagggaccgcatggtctcgctcaggccgagcatgcgctacctgctgtgcgaccccgaggagatggacctcgacctgggatccgagacgtccctgctcgcgcgtgcgatcttcgccgcctcggccgtcgccgagtccgacaaggcgttcgaggagctgtgggacggcacgccgcagtacatgggcggcggcgagggcgccggtgacgcgatcctcgcccaggcgctgacgtcgctcaagacgcgcgggtacatggtgtcgtcgacctcgctggcaacccgccaggcctcgacctacgccttcgacttcgcgtgggcgatgtccgctgagctgcccgacgtccccctctccacgctcgtcgccgagggcatgcgctttgccggccggctctccgttgcgcaggagaagatctcggtcgacgacatgctctcccaggacgagctccttgagcgcctggggctcccgtacctctcctgcagcatggagccctcgcgtatggtggaggcgctcaggagggagcggttccagaggagcggcaggttcctcctcgccatcccccagaagctggggcgcgtgaggctgtcgtcggtcgacgacgacctgctgctggagcacgtcaccgcctggtgccagacgcaccagccgcaggagggcgccgaggcctgaggccgccggcaacggaactattggtaacacgtcattgggaggaaccatggcagacgcacaggcatgcgcgggcagggtagcccgcttccgcgatctcatggcccgcatgggctacgacgcggcgatcgtcaggaacaacgcggacctgaggtggctcacggggtccgagaggaccttcgacgacgaggtggcgcacaccgccttcatcacggcggacggcctttggctgcacaccgactcgcgctactacggcatctttctcgaccgcatggggaaggagacgccctggcagatcgacgaggacgtgatcgaccccgcccagtgggcggcggaccacgcccgcgacgcccgctccagggtcgttgccgtcgaggacacctgcgacctcgcgttcttcgacgccttcggggctgcgtgcctggccgacggcgtcgagtgcctgaccccccgcatgcacgggttcatcgccgacctccgcatggtgaaggacgacgaggagctctcgctgctccagagggcgcaggacatcaccgacgacgcgttccgccacatcgtcgagtacatcaagcccggtctcaccgagcagcaggtgcgcgcggagctggacaactacatgctcacgcacggggcggacaacgtctcgttcgagacgatcatcgccgccggccccaacggcgccaacccgcatgcccgcccgagcgagtacgtgctgcgcgagggcgacatggtcgtgatggactacggcgccctgtaccacgactaccacgccgacatgacccgcacggtgtgcgtgggcaaggcgggggaggagcagcgccgcgtctacgacgtcgtgtgcaggaccaacgaggagtgccaggcggccgcgcacggtggcgtcaacggcctcgacatgcagaaccttgcggtcaagatcatctccgacgccgggtacggcgagtacttcggccacgggctggggcatggcgtgggactccagatccacgagaatccgggcttcagcaggcactacgaccgcgtggtcccctccggctccatcgtcaccatcgagccgggcatctaccttccgggcaagttcggcgtgcgcgtcgaggactgcggcgtggtggcggaggacggctaccaccccttctccaagatcccgcacgacctggtcgagatcccctgctagccggaggctggcgcgtctctcccctcaatcggtcgctaaacgaggcccccgtcactgccaagtgccgggggcctttccgtccgtcaggagtgggaggaaatgccgaaggcatgagcgtatgaggcgcaagatgcacttgacgcagcgtgagggtcaacccagtgagtgggggagaggtaccgcttatggttaaaacgcgaccgctcaaaccgaaagctcctacatgtttgaacaattttacccgcgtttacccaaatcctgaaaacgctcgctatactagcttttgtggatgaaaggtggaggacttgttcaagtgctgtgaaggggtccgacgtctcttccgcgtgtcctaacggtgcaagggaagcaaagtaaggaggaagttggatggtcggtattgttctagccagccacggcaagttcgccgagggcatcaaggagtcgggcagtatgatcttcggcccccaggaagatgtggctgccgtcgtcctgacgcccgacatgggtcccgacgacatgcaccagaagctgcttgacgcgatctccaccttcaacgaccaggagcatgtgctgttcttggtcgacctgtggggagggacgcccttcaaccaggtttcccgtctcatcagcgaggaggggcatgaggactgggttgccatcaccggtctcaacctgcccatgctcgtttccgcgtacggttcccgcatgggcgccgaaaccgcggtcgacgtgatgaaggaggtctatcccgaggcgagggacggaatcaaggtcaagcccgaggagcttcagcctgccagcgcagaggctcccgcagcccccgctcccgcagcggcagccgtcagcgccattcccgagggcacggttctcggcgacggccacatccactacgcgtacgtccgcatcgatacccgcctgcttcacggccaggttgccacggcatggaccaagcaggtccagcctgaccgaatcctggttgtctcggatgccgtctcgcacgacgacctccgcaagaacatgatcatccaggcggcccctcccggagtccacgtccacgtcatccccatctcaaagctcatcgaggtcgacaaggacccgcgcttcggtgccaccaaggcgatggtgctcttcgagacgccgcaggacctgctgcgtgccgaggagggaggcgtcaagttccccgaggtgtgcatcggctccatggccgctaccgcggagaagactgtcatcaaccaggcgatagcctgcgacgaagacgacgtcaagacgctgaaggcgatccgcgacaacggcacgcacttctacgtccaaaaggtcccctctgatcacgttgatgacatctgggctcttctcaaagagaagaacatggcctaagggccccgatagggagaaggaggaagttcatgaatcctatttcgaccgtgcttgtcgtcatagtggcattcctggcaggtatggaaggcatcctggacgagtgggagttccaccagccgatcgttgcctgcacgctgatcgggctcgtctgcgggcaccccaccgagggcatcatcctgggcggcagcctgcagctcatggcactgggctgggccaacatcggcgcggccgtcgcgcccgacgcggcgctcgcctccgtcgcctccggcatcatcctgatgctggcgctcaacggcggcaccaccgacgtcaccggtgccatcaacacggcaatcggcgccgcgaccgcgctgtccgtcgcaggcctgttcctcaccatgatctgccgtacgctcgccatccccatcgtccacgcaatggacgccgcggccgagaaggccgacttcggggccatcgaccggctccagatcggcgccatctgcatgcagggtgcacgtatcgccatccccgccgccgccctgtgcttcatccccgcggccgctgtcacctcggtcctgaacgcgatgcccgcctggctctccggcggcatgaccgtcggcggtggcatggtcgccgcagtcggctacgccatggtcatcaacatgatggccacgaaggagacctggccgttcttcgtcctcggcttcgtcctggcaaccctgagcgagctcacgctcatcgcccttggcctcatcggtggctgcctggccatcctctaccttggcctcaaggaccttgccaaggagggtgccggcgccgctggctctggcgatcccctcggtgacatcctggacgactacgagtaggaaggggagtgaatagacatggcagaagacatcaagaacgctgaggcccagaccaacggcatccacctgaccgtcgctgaccgtcgtgccgtctgcaaccgtcaccagtacctgcagggctcgtggaactacgagcgtatgcagaacggcggctggtgctacgcaatgatcccggccatcaagaagctctatcccaagaaggaggaccaggccgcggcgctcaagcgtcacctggagttctacaacacccatccgtacgtctccgcgccggtcatgggcgtcgtcctcgcgatggaggaggagcgcgccaacggtgcgcccatcgacgaccaggcgatccagggcgtcaaggtcggcatgatgggccctctcgccggcgtcggcgatcctgtgttctggtacacggttcgaccgatcctcggcgccctcggcgcgtcgctcgccctcagcggtagcatcgtcggcccgctcctgttcttcattgcctggaacatcatccgtatcgccttcctgtggtattcgcaggagttcggctacaaggtcggaacggacatctccaaggacctctccggaggcctgctcggtagggtgaccgagggcgcctccatcctcggcatgttcatcatcggcgcgctggtccagcgttgggtctccatcagcttcaccccggtggtctcctcggtcaagctcgactccgcggcctacatccactgggacaagctcccctctggctacaagggcgtccagtccgcgtttgaccagtacttcaaccaggggctcgctctgagcgacaccaaggtcaccaccctccagcagaacctcgactccctcatcccgggtctcgcggctgttggcctgaccctgctcatctgccacctgctcaagaagaaggtctcgccgattgccatcatccttggcctcttcgccatcggcatcatcggccgtctcctcaacttcatgtaatggcggtatcacagcccctcttgcagggctggacccagggggtcgcacccgttacgctaatctggtcgcaaggcctggcggcgtggggtgcggccccctccgcatgaccgcaaagggagaaatgccatggtccaatccatgaaccacaccgtggacctcaccatcaaggcgacgtcattaatggggctcacctccgtgggcaatatgatggtcggcgactgtgccctcgagtactacaacgagagcaaccccaacgacttcatccagatcccgtggggcgaggtcgaccacatcgccgcagaggtcctcttcaaccgcaagatcgcgcgcttcgcggtcttcaccaagaggaacggcacctacaagttctcgacgcgggacaacatcaagaccctccgtgccgtgagggagcacttccccgaggagaagatgctgcgctcccccaacgtgatagaggtgatgaagagggggatcctctccattcccaaggcggtctcgggccatcgcgcccagggtgggggagagtagccgcccccctggctgttgccttcgtgaagtggcatggcagtccctcgcaatgaactgctcgcgcgcctataatacgcaaggttttacgtctttatgtccgcggcacgcgccgcgtggcgcgtgagaggagtgttcgaagtggcaacgatcagcaccgccgatttcaagaacggcatgggcctcaagatcaacggcaagtactacaccatcgtggagttccagcacgtcaagcccggcaagggcggcgcgttcgtccgcttcaagatcaaggacctcaagagcggccgcaccatcgaccagacctgcaacgcgggcaccaagttcgagaacgttcagctgatcacgcgcgagatgcagtacctgtacaacgacggtgccgcgtactacttcatggacaacgacacctacgagcagattcccgtctcgcccgacttcatcggcgacaacgcaaagtggctcaaggagaacgacaactgcaacctcctgtacgccgacgatgagctgctgggcgtgaacccgcccatgttcatcgaggtcgagatcaccaagaccgaccccggcttcaagggcgacaccgtccagggcggcaccaagcccgccgagatcgagaccggcgccaccatccaggtccccatgtacctcaaccagggcgaggtcatcaaggtcgacacccgcgacggcaagttcgtctcgcgcgtctagccgcatccacagcatgtcaggggagcccgagcggcagtcgccgccgggcttccgtcgtttttcgggagacggccccaggcgcccgttacgtctatacttgggtagaaaacgccgagcagcgcagcgcgtctcgcccgtctcgaaaggaaaccgcaatggcagaacccgaactcttcatctctggcatcggaatatccaagagcgtcgtctcggccatcgtctccgcggcagcggagaaggtcgagggcgtggcccacgttggcggcaacgacatcgcctccaacctcgtctcggtcttcacccgccgctccgtctcgtcggacgcagccgtggagtcccgcgtcgaggacgggcagctgagggtgaccgtccacctggcggtcttctacggctaccccttcacccagcttgccgcggcggtgcgcgaggcagtcgcctccgccgtcaacgagcaggtgggcgtggaggtcgccgccgtggacgtctgcatcgacagcctcgtcttccccaaggagtagtccccttgtctcagcacactcactttggtccccgcaccaacgcccgcagccaggcgctgcagctcctgttccaggccgaggcaaccggccgaaccgtcgaccaggtcctggagggcggggagtacagtctcagcgacggcccgctcgatccgtttggcgagaggctcgcgcgcggcgcgggcggcatgctggacgagctcgatgcgatcatcgacaccacgtcgacaaactggagcctccgccgcatgccggcggtcgaccgcaacctgttgagggtcgcgctctacgagatgctcgaggtcgacgaggtcgccgtcgccgtgaccatcgacgagtcggtggagcttgcgaaggcgtatggcaccgacgagtcctcccgcttcatcaacggcctcctgggcagggtcgcgagcaacctggaggcgggcaacgacgtcgtggcggacgcgatggcggaggaggagcgccgccatcccgccgaccggcaggaccaggctgacgacgggttcgaggagtaccacgccggcgcgtgggacgacgtcccggagggcgatgcgacctcccaggaggaggaccgggctcccgtcgcgggcgaagaccccgaggacgacgccgaggccgacgatgcccgggcgggtctggagtagcccgtggcaaagccagacacctccgcctacaagacctttgaccagataacgggccgcctggaccagatcgtggaccaggtgcgcgacaaggacacctcgctcgagcgctcgctcgacctcttcgacgaggccatagcgctcggctccaaggcggtcgacctcgtcgactccaccgacttctccgccgaggagagggacaagctccgcgaggcctcgggcgagccctccggcaagggggattcctccgaggcgggcgagggggcctagcgtggcgcgcaggcgcctcgacgccgagctcgtggcgcaggggttgttctccaaccgggaggatgcgctccgcgccgtccttgccggggaggtctcgacctcggaccgccggctcacctcgcctggcgagcaggtgaggccaggcatacccctccacgtgagggggcacatcccgtacgtcagccgcggcggcctcaagctggagcgtggcctcgacgcatttggcgtggacccggaggggctcgcctgcctcgacgtggggtgctcgtcgggcggattcacggactgcctcctcaagcgcggcgccgcaagcgtcctgtcggtggatgtggggtatgcgcagttcgactggtcgctcaggcgcgacccacgcgtgacgctgctcgagcggaccaacgtcgtcgacctgcccggtacggggcgcgacggcaccatccagctggcggtctgcgacgtctcgttcacctcggtccagacggtgctgcccgcggtgctgagcctcctctcgcccgcggggtcgttcctcacgctcgtgaagccccagttcgaggtcggtcgcgaccaggtgggggagggcggcgtggtctcggaccccgccctgtggctccagagcctccgcagggtgtcggatgcgttctcccgcggcggcctggttccgtgcgcctgctgccccagccccatcacggggcacaagggcaaccgcgagttcctcctgctcggcgtgcggggggagcgcgattcggtcgaccatggcgacctcgagcgcgtggttggggacggatgccccgtcgtgcgctgatgccggcgcggccgccctgcctccgcagggggccgtgcccctctccgcacgtgctagactcaggggacgtcagggaaccgagtccggaggggtgtgttcgcatgagggtccttcttgtgcccaactactcgcgccaggatgccgtggagggtgcaaaccggctctcggactggcttgagggccagggggtcgaggtgcgctgggcgcacgacaagaagctctttcccaacaaggtggtcgacacggagggcgtggggctcgtggtctcactgggcggggacgggaccctgctgcgcgccgcccgcatcgtggggtactccgagatcccggtgatggggctctcgtacgggcaccttgggttcctgacctgcgggggtcccgacgagctcatctcgtcggtgtcggatgccctcgcgggcgagatgcacgtgtcccaccgcgccacgctggacgtggaggtcgactacgtgcggcccgacggcacggaggggagcgagaggcgcttcgccctcaatgacatctccctcacccatggcgtgaggggcgacatgatcgagttcgacgtctcggtctcgggccatcacgttgaccggctgcgcggcgacggcttcgtggtctccacggccacgggctcgaccggctacgcgctcgcggcgggcggccccatcgtcacgcccgagttcacgggcatggtctgcgtccccgtggccccgcactccatcagggcgcgcgcgttcctcaccgcctcgtccgacgtggtcgagatagagatcagccccgagcgcaaggcggagcggctgttcttcgcggacgggcagcccatctgcgccggcagcacgtgcgttggcgcgagggtgcgccgcggtcccggcgacatcctcctcctcgacaggagcgccaagagcttctacgagtcggtgtcgcgcgtcttctacggggagcagggccgatgatcgacgagcttcgcgtgcgcgacgtcgcgctcatccacgatgccaccatcgacccctcgcccgggctgaccgtcctcacgggcgagacgggaacgggcaagtcggcgctcctctcggccgtgaagctgctgatgggcgagagggccgatgcctccgcggttcgcgagggggcggactccctggaggtcgaggggcgcgtcttcctgcgtggcggagaccccgacggggtcatcgtgaggaggcgcgtggaggcctcgggccgtggtcgcgtcgacctcaacgggcgcatggcatctgtccgcgagctcgcctcgggcgtgggggcgagcatcgacctctgcggccagcacgagcaccagcggctgcttcagccgcagtcccacgtggagctgctggacgcctgggcgggcgattcggtcgcgcaggctcgcgaggccttctcgcaggcgctcgcgtcggcgcgtgccgcggagcgcgagctcgagcgcgtgagcgagatgagcagagacagcgacgagcgcgtggacgaggcgtcgttcgtcctgcgccgcatcgacgaggtgagccccgaggagggggagtacgagcacctggaggagaccctccccacagccgagcacgccgagacgctcctgcgcgccgccgcggacgcccacgagggcgtcgtgggcgacggcggggtgtcggacacgctctcgtcgatggtggaggagctgcgcgacgccgcctcgtacgacgagcgcctggacggctacgccgagcgcctggagagctcgctgatcgacatcgaggacgttgccggcgacctgcggcgctaccaggacgggctcgactttgaccccgagacgctggggcggatgcaggagcgcatggcgcagctccagggcctgctcaggagctacgggccgcgcatgcaggacgtcttcgagcggagggcgaaggcccaggagctcgtggagtgcgcgcgcgacggcgggaggctcgtggccaaggccaaggccgcgctggacgaggccgaggggcttctcgcccggcgcgccgacgagctcgacgcggcgagggcggaggcggcgccgcggcttgcggacgccgtgaccgagcagatggcgttcctgcagatggggaccgcgtcgctcgggatggcccagcaccggctcccgcgtgcgcagtggacctcgtcgggccccagctcagttgagctgatgtaccgtcccgccgcgggcctctcgccgcgcccgctccgccgcatcgcctccggcggcgaggtcagccgcgtcatgctcgcctgcaaggtggttctgggcgaggcggaccataccgagaccctcgtgttcgacgaggtcgacgccggcgtcggcggcgccactgccgtctcgctcgcgcaggtgctcgcccgcctggccaagacccaccaggtgatcgtggtgacgcacctcgcgcaggtcgcggtggtcgcggaccggcactacctggtcagcaagaccgggggcgaggttccccagaccaccatcaggcgaatcgggggagaggagcgcgtcgccgaggtcgcgcgcatgctctcgggcgaccagagcgaggagtcgctggcgcacgcgcggcagatgctcgagtcggccgccgaggagggctgaagcgggggaggaagggtttgccatcattttatgagcctcaaccgcaagcccccgcgcacctctcgcccgaggtagtatgaagacccgtagagcagtcagcgactcatacgggaagggtccatacatgaccaaacacatctttgtcaccggcggcgtcgtctcctcactgggcaagggcatcaccgcggcttcgctcggtcgcctcctcaagtctcgtggctacaaggtcatgatgcagaaggcggatccctacctcaacgtggaccccggcaccatgagccccttccagcacggcgaggtgttcgtcaccgaggacggcaaggagaccgacctcgacctgggccactatgagcgcttcatcgacgagaacctcaccagctcctccaacttcaccacgggcctgatctaccagtcgctcatctcgcgcgagcgcgcgggcgacttcctgggcggtaccgtgcaggtgatcccccacgtcaccgatgccatcaaggcgcagttccgtcgcgtcgaggagcagaccgacgccgacgtggtcatcaccgagctgggtggcaccatcggcgacatcgagggccagtccttcgtcgaggccatccgccagttccgcaaggagaagggccacggcaacaccctcgtcatccacgtgagcctggtcccctacatcgccgccgcgcacgaggtcaagaccaagcccacgcagcactccgtgaaggagctccgctccatgggcatccagcccgacttcatcgtgtgccgcagcgaccacgaggtggacgcctccattcgcgccaagatcgcccacttctgcgacgtggacgaggattgcgtgttcgagaactccgactgcccctccatctacgacgtccccatgcacctggccaaccaggactttgacctcaaggtgtgccagaagctcggcctggacccccacaagcgcgacatgaacgagtggaacaggttcaccgactacatgcacgaggccaacgccaaggaggacgtgaccaccatcaaggtcgtgggtaagtacacccagctgcccgatgcgtacctctccgtcatcgagtcgctgcaccactccggcgtctactacggccgccacgtgcagatcgacctcatcgacggcgaggagctcaccgccgacaacgtggacgaggtcctcgccggggcggacggcatcctggtgcccggcggattcggcctccgcggcatcgagggcaaggtcctctccgccaaccgcgcccgtgtcaacaaggttccctacctgggcatctgcctgggcatgcaggtcgcggtaagcgagttcgcccgcaacgtctgcggcatggagggcgccacctccacggagtttgacgccgagtgcaagtatcccgtgatcgacctcatgaaggaccaggagggcgtcaccgacaagggcggcaccatgaggctgggcgcctatccctgcaagctcgccgagggcaccctcgcccgcgaggcgtatggcgaggagctcgtctacgagcgccaccgccaccgcttcgagttcaacaacgcctaccgccagcagctcaccgacgcgggcctggtcctgagcggcctctcgcctgacggccacctggtggagatgatcgagctgcgcgagtccgaccacccctggttcgtggcgacgcaggcgcaccccgagttcaagagccgtcccaccaagccggcgcccctgttccgcgagttcgtgcgcgccgccatcgccggtcacgagggggtcggccgcaaggaggtcgtccccgagcacggcgtggtggagtagccgccgcgggccatggacctggaccaggcacgccgggagtaccttggctacctcgcggttgagcgggggtactcgcataacaccatagattcctacgcgcgcgacatcaaacgctacctggcgtttcttgccgcgcgcggcatatctcggcccgatgacgtgtcgaggggcgacgtggtcgaccacatccaggggctcgaggagtccgggctcgcgccctcctcggtcaagcgcgccgtctcggcaataaagggcttccaccggttcatggtggtggagcagatctgcgagaaccaccccacggcggacgttcctctccccaaggagcccgagcgcctgcccgacgtcctctcgcgcgaggacgtgttccgcctcctcgacgtcccctttgccgtggagccaaagcccaagccccgcaagggaggggagcccgaccgcaccaacgtcgcggcattccaccgggacaaggcgatcctggaggtgctgtacggctgcgggctgagggtgtcggagctctgcgggctggaccttgccgacgtctcgtttgaggacgagatgcttcgcgtgatgggcaagggctcaaaggagcgcatcgtccccgtcatggggaccgcgctccgagcgttgcggctctatgtggaggagtggcggcccatcctctgcgcacacgggagccgaccgtgtcccgcggtgttcgcgagtgcccgtgggacgcgcatcacgcggcaggcggtccactcgctggtggagcggtacgggcggatggtggggatagagggcctgcacccccataccctgaggcacagctacgccacgcacctcctggagggtggcatggacctgcgcgtggtgcaggagctgcttggacacgcctcggtcgcgaccacgcagctctacacccacatcgaccgcacccatgtgcgcatgacctacctctcggcccacccgcgggcgaggctggggtagcggcggcggggggcgcgtctcccacgaagtccgcgcgtcccacgggaggaggtcgcgtctccgtccgcacgtcccacagtgaatggtcgtgtctcccacccctacgacaacggggctccatggcggacgttcgcaccgtctcccgatgggacgtcctcccaccggcacgacgtcggccccgcgctggcggacggctggtggcatcgatttggtgggggagaggttccgcgtcagggctttgggggaatccgactgggttcggccccattccttggcgcactgcatgcatctcaccgggtgggcaaccggactggggaggatcgggcgcatgtgggggactaggggcaaagaagggcccaggtgtgccccatgccccacgcgggtgccacatctgctttcgctgcggcaagggtagttggcatcggggctcgaatatggcgggggacgcgcgaagacctcggtcccacgctggtcccccggaggcacgcttaacgcctccccgcctcatgcggttttggcccacgcctgcttagcgatgctaggcctcgtggattttgggggtcccgtctgcttagcgatgctaggcctcgtgcaggttctcggcgaaaaacccgcgcgagggctagtgcggctaagcatcccgtcccggaatcgacaagaggcttagcggtgctaagcatctcgccccggaaccggcaggggacgcagtgggactcggcatcgggcgcaacctcacggtgggacatcctcccacccggtgtgggaatccctcccaccaaccgaaagagggcctctcccgccctcccacattccctcccaccggcgtcccacaccgcgccacgcacggcccccagaggtgggccacaatgcctgcaagtgagatatacaggcctatttacctgcggaaataacgctgacctgcggtttcaccaacccttcacaatctccttttcaacctagcggacgggcggtcgctcccttgtggtgcgaacgtctgtttccacgagatgtggggccgcctggcgaccctaccagacccccgggacgaaaagttgccgttgggtgggacaatgtgttgcgaagtgggggacttgccctattattagactcacgttttcgaggggagcacactccctgcaccaagggaggaggggacatgtaccttactggcaccttccagcacaatctggatgccaagtcccgtctgacccttcccgcctcgtttcgcaagcaggtgggcgacacagtctgcctggtccccctcgacgacgcgatctacggcttcacccccgagagccacaaggcttgggtgtccagcttcttcccccaggggctcaacccccgcaacaggagggacgtgcagctgcacagcctgctcatgcgtcgcaccgtcacggtggaggtcgactccgcggggcggatcgcactgggcaaggtcagcgcggaggcgctccagaagctggggatcgagcgcgaggtcacggtcatcggaaacgacgaccacttcgagatctggtccgccgccgcgttcaaggcgatggacgagcagatcgagagcctcgacgacctcatgttcgacgactagccaggagggggtgagggtcttgacagcagaatatcggcacgtacccgtgatgctcgaggaggtcctctccgccctcgacccacagccgggcgaggtggtctgcgactgcacgctcggcggggccggacactcggtggagatggccaggaggatccagcccgacggcctgtccattggcatcgaccaggacgacatggccctctccgccgcggccgagcgcttcgcgcgcgaggtccccggggcggagcaccgcttcctcaagggcaacttcggctcgctcgacgaccttctcgtcgaggccgaggtccccggagtggactgcttcctcttcgacctgggggtctcctccccgcaactcgacatccccgagagggggttctcataccacgaggacgccccactcgacatgcgcatggatccgggcaacaacaccctaaccgcagctgaggtcataaaccactacaacgaagccgacctcgcccggatactccgcgtctatggggacgagaggtacgccagctccatcgcccggcacatcgtccgccggcgcgagaaggagccgatcgagaccacgctccagctggtcgaggtcgtgaaggaggccatccccgccgccgggaggcgacatggggggcatcccgcgcgcaagaccttccaggcgctgcgcatcgaggtgaaccacgagctggacgtcctggaccaaggccttcgcgcggcggtccgctgggcaaacacgggcggtaggatctgcgtcatctcctaccactccctggaagaccggatcgtcaagcacgtgttctcggagctctcgcagggttgcacatgccccccggacctcccggtgtgcgtgtgcggtcacgtgccgatagtcagcgtcaagaccaagaggcccctcaaggccagcgagggggaggtgcgacggaaccctcggtcgcgcagcgccctcctgcgcgtggcggtcaagctcgacgtcacgcacgagggggagaaggaggcacaaccggccgcgaggccgcgtgcataggcaacgaacgaaccaacaaacgcagcagcaggcaccaccaacgcagaacaccgcagctcaaacgaaccaccatcacaccaccaacgcagccgggctcgcccggctgccttcagcaaagaggggcaaaccatgaggtacgcagggtccgaggcacgtgtcctcgacgccgccgagaggcgtacgcaggaggcagagcgtcacgctcccttcgaggtcgtcgagggcggcgggctggacgcccgggccaggcagggggtctcggggaggttcctccgcaggttcgagatcttcatggtctgcacggtcgcccttctcgcccttggggccgtcagggtcgccatgaccagcgcgacggtcgccaccctccagcagaacgttgccctggagcagaagatctcgaactccgaggacgacaacggcgagctccagatcgagcactcggtgctctccagctcgtcccgcatcgacctcatcgcaaccgagaactacggcatggtccgccccacctccaccgacacgatcaccctggggagctcggaccagtcctccgccaccgcttctgcagatgatgcgcaatccgcccagcaggctcaggccgcggcctcggagtcgtagacttctctctcgtgagaagcacacgagacaacagccgacgcgggaggaatcccggtccggaggcctcctacgacgaggcgtcacgacggcgccgcatgcggtcgctccgccgcggcggccctgacttcgactcaaacgccaagatcctcatggtcatcgccgccgtcctggcggcgatcgtggcgggcaagctcgtctacctccaggtgttcgaagcctcgaacctgagcaggcaggccgaggccatgcgcaccaacaccgtcaccatccaggccaagcgcggcaccatctacgaccgcaacggcaacgtcctcgccatgagccaggactgcaccaccatctactgcaaccccaacgaggtccaggcgggctccatcgaggaggccgccaagatcctcgccgaggacaccggtgccgaagagagcgacttcctctcgattctcacccaggacaccaccttcgcctacctcaagcgcaaggtggacaactccgttgccgaccaggtgaaggaggacctcgccaaggccaacatctcgggggtctactacctcagcgacgtgcggcgcgtgtacccgtacgggtcggtgggaagccaggtcctgggaatcgtgggcacggacggcgacggcctcaccggcctcgagctctactacaacgacatcctcaagggcacggacggcgagatgatcttcgagaccggcagtggcgggacgcccatcgccggcgagaccgcccagaccaaggaggccaaggacggcacggacatcgtcatctccctcgacatcgacatccagaaggtcgcggaggagacgatcgcccagggcgtcaaggactactcggccgactcgggctcggtcatggtcaccgaccccagcacgggcgagattctggccgcgtgctcgaccccgatgttcgacgtcaccgacacctcgacgatcgaggacggggcgaccagcctcaagctcgtctcgtcatcgtttgagcccggctccatcttcaagctgctgaccatggcaatcggcatcgacaacggcctcatcaccccggacagtacgttcgacgtccccgcaaaggtgcgggtgggcagcgactgggtcggcgacgacgacaaccgaagctacgagatgaacatgtcggtgcgagagatcctcaggcgctcgtccaacgcgggaacggccctcgtggcacagcaggtgataggcgccgacacctttgccagcggtatcgagaagtttggcatcggctccaagacggggatcgacttccccggcgaggtcgccggcatcgtcaagacccgcgagcactacgacaacgcgagcctgggcgccatgtcgtttggccagtcgctggccatcccgctggtgcagatggtcaaggcggtcgactccatcgcggacgacgggacgctcaccacgccccacttcctcgtgaagaagggtggcgagacggtggagtggaagagcacggggacctcggtctcgaaggagaccgccgaccaggtcaccgacatgatgcggaccgtcgtgcaggagggcaccgcgaccgccgcccaggtggacggctacgacgtggcgggcaagaccggcacgggcgagcaggcgggcgagacgggctcctacatagccaacagctacgtgagctcgctcatcggcttcgccaacgcggacgaccccaaggtcctggtgtacgtgggtctcaacggaactccatatctggccacctcatctgccgcccccctgttctcgactatcatgagtgctgctctctcggacctgggcgtggaacccacgtccggcacgagctcataggccccaagtgggagaggaatcgatgttctcaatcagcgtttctgccatggcgggggccaccggagcctccgtcgagcttggcgacgggtccatcgtcgcctccaccgtccaaaccgactccaggaaggtgggggagggggacaccttcgtgtgcttccccggcgagagggtcaacgggaacaggttcgcgcccggcgcgatcgacgcgggggcatccgccgtcgtgatgaccgaggagcccggcgaggacgtcctctccgccgcgagggcccacggctgcgccgtgcttcgcgccgagggcgacgacgcgacggagttcatgctccgccttgccgcctggtggcgctctcagaacccccagtgggtcgtggtgggcgtcacggggtccgtgggcaagaccacgaccaaggacatgctcgccgccgcgctcgcgacgcgctaccgggtgcatgccacggcaggcaacttcaacaacctcatcgggctgccgctcaccgtgctctccgcctcggaggacgaccaggtgctcgtcgccgagatgggcatgaaccacaagggcgagctcacgcgcctctcggccgtcgcaaggcccacggtcgcgctcatcaccaacgtgggcacgagccacataggcctgttgggcagcagggagaacatcgcgcgcgccaaggccgagatcctctcgtccatgggaccgagcgaccgcccgcagaacggcgtcgccccctgcctggagatgacggcggacaacgacttcgcccgcctcatcgagggcgagtacgccaagccgcgcggcgtcgacgtgacctatgtgggaaccgcggggggctgctcccccagggcgctcgacatcgagctcgatgcggagtccctcccctcgctcacgctctcgttcgccgacggttgggaggagcgcgtctcgctccccatccccggccggcacgtggtgtgggacttcctgcttgccatgggcatcgccgacaggctgggcgtcgaccgccaccaggcggcttccgccatcgcctcgatgccccagacgcacatgcgcatggaggtcgtgaccgccccgggcaagccgcggctcatcgacgactcgtacaacgcgagccccagctccatggcggcggcgctcgacgtcctctgctccatggcgtgcgagggccgcagggtcgccgtgctgggcgagatcggcgagcttggcggggaggggcctcgtctccacgggtacgtgggcgcctacgccgccgccaagccgctcgacctcctggtcctcgtggggggcgagggcgccgccgagatgcgcgaggcagccctcaccatgggcttctccgaggacaggctcgagctcctccccaacgtgggcgaggcgctctcggtcatcgcccccatcctcaggccgactgacctcgtgctggtcaaggcctcccgttccgtgaacctcgaccagttcgttaagggggtgctggagtagatgttcggaaacccgagctaccccacgtaccagatcttcctgtccattggcatcgcggccctcatcacgggtgcgatcatgccgttcttcatcaagatgatgcgccatgagggggtgggccagcaggtcagggccgacggcccgcagcgccacctcgtcaagcagggcacgcccaccatgggtggcgtgatcatcctcctggggatgttcgtgacctgcctgatccaggcaaagtggacgcccggcctggtgctcgccatgctcgcgacgctcgccaccggctcgctcggcctgctcgacgacatcgagagcgtcgcccacaggcgctccctcggcctcacgccgtcgcagaagatggccggcctcatcgcgatctcggtcctgttctgccttggcgcggtcaacctctgccatgtgcagcccacgctcgagttccccggtggcggctacctcgacctgggggtcctcacctccaccctgcacgtggggggtgcgaccatccgcatcccgtggctctacgtgttcttcgtgttcctcctcatggcaggcctctccaacgccgtcaacctcaccgacggcctcgacggcctcgcgggcggctgcatcctcgtggtgatgctggccatgtccatggtcgccttcagctttggcgagaggaacctcgcggtcttcgccgcggccatcgccggtgcgtgcatcggcttcctctggttcaactgctatcccgcctcgatcttcatgggcgacacgggctcgctcgccctgggcgccgccttcgcggccctcgccgtcctcaccaagaccgaggtgacctcgctcgtcatgggcggcctgttcatcatcgaggccctctcagtcatcatccaggtggtgagcttcaaggcgaccggcaagagggtcttcctcatggctcccatccaccaccacttcgagaagaagggctggagcgagacgaaggtcgtcatccgcttctggatcgtctccgccgcgttcgccaccctcggcttcgccctgtacttccagcttgggtaggtaggtgtcgctatgtccgatgagaacagcaacctcaggcccctcggccgcgtcctcgtgctcggcctgggcaagaccggccgcgccgtcgccggctaccttgccgcgcagccgcgctcgcgcgtctcgtccgtgacgctgtacggcggcgccacctcgagcgagggggaggcgtcccgcgccctccggacggccggcgtcgacgtcgtcctggggaccgaggacgtccgcggggagtacgacctctgcgtcgcctctcccggcatatccgagttctgcccgttcttctcggccgcctcgaggtgctcggcggaggtcgtgagcgaacccgagttcgcgtggcgcgagagcccccagaggtgggtcgccatcaccggctcaaacggaaagaccaccacgaccacgcttgcgaccgagctcatctgcaaggttgtccccgccgtcgcggtgggcaacatcggcaacctgtgcattgacgaggtggccaggaggcccgagggcgagtggttcgtggccgagctctccagcttccagctcgccgtcaccagcaggctccacccgcacatcgcctgcctcctcaacgtcacccccgaccacctggagtggcacggcaccatggagaactacgccgccgccaaggagaaggtcttcgccaacctcggcgcgggcgacctcgccatcgtgagcgaggacgactcatggaccctcgcggtcatcgacaggctcgaggcgcgggggctgcgcgtgctgcacctcaacgtggcgggcgaccccgggacggcgtgcgccgccttcgcgcgcgacggcatgctcgtggtcaggctcgacggctcggagcacgagctcgtcgcggcgtccgacctccgcatcaaggggctccacaacgaggagaacgccctcgcggcagccgccatcgcgctcgaggtgggcgtgggggacggcctggtgagggaaggcctcctcgagttccagcccctggagcaccgcatcgagccctgcggcgaggtcgacggcgtccgcttcgtcaacgactccaaggcgaccaacaccgactccgttgagaaggcgctcacggcgtttcccgcgggcagcatcgtcgtcatgctcggcggccacgacaagggcaccgacctcacgtcgctcgcagcggcggtctcgcgcgactgcaaggcggccgtgtgctttggcgcggcgggggagaggatcgcccgtgcggtcgaggcagccggcggtggcgtgcgcgtcatcaggtctggtaggctcgccgatgcgttcgagagggccgtcgaggtcgccgagcagggagacgtggtgctcctctcgcctgcctgctcctcgttcgacgagtttgccaacatggcggagcgcggccgctccttcaagtccatggtcaaggccctctcgcgtggggagagccactagatggcccgctccgcgaacccctccgtggggggtcgggcgtcgcgctcccgacgccgcggcgacggcgaggaccgcctgatcctgggcgttcccgcgcgcttcatgaagccgcgcctcgtcttcatcgcggctgtcttcgccctcgttggctttggcctcctcatgatctactcgtcgtcgtccatcacgtcgctcatctcccaggactacggcaacgatcccgcgtactacgtggagcggcagctcatgttcgttgccttcgggaccgccttcgcgcttgccctcttcaaatgcgactaccacctgctgagcgggcggctcatgcccgtgatctgggtggtcatggtcctcgcgttgggcctcatcttcctgcccttcgcgggtgccgacgcctacggcgcgtcgcgttggatcgccatcggtcccctccacctccagccgtcggagtttgccaaggtggccatcgtggtcatctcggcaggcctgctgagcgactacatggagaagcagaggctcgacaccggggagctcctcaagaggtcggcgctcctcgtgggcgtccccctggtgatgatcctcctgcagcccgacaagggcaccatgatgatctgtgccgtcacgatcctggtgatgctgtggttcgccggggttccccgccgctgggtcgtcgggctgttcgccgttggccttgcgggcatggtggtcctctcgctcagggactcgtactcgcgggcccgcatcatgacggtgctcaacccctggagcgacccctatggcagtggctaccagctcatccagggcttctacgccttcggctcgggcggcctcttcggcgtgggcattggcatggggcgtcagaagtactcgtatctccccatggcgtacaacgacttcatctatgccgtgataggggaggagtgcggcctggtggggacgctcggtgtcctcgccggcttcggcgtcatgctgtgggcggggctcaagatcgcacggtatgcgcccgacatgacggggcagctgatcgccaccgggtcggtgaccatgctcgtggtgcagctcctcctcaacgtgagcggcgtcgtgggggtgttcccgctctcgggcaagccggtcccgttcatctcgtacggaggctcctcggtcatgtcgtgcctcatgctcgcggggctcgtgctgtcggtgtccaagcagtccaggctcccggtcaccgagcacgaccgagcgaggatggactggagcgtgacccaggcacccagggtggaccgcgagggggtctcggagcccatgccgcgctctgcgcgtggctccgcggatgcgtcgggcagcggcacgaggttcagggtcatcggcgggggagcgacgcccaacccgctcgccgggtcgcgcaccccgcgctcgcttcgggcagaacgcgacctcgcgtctcgccatccggagggccgagtgagcgtagactctaacggtcgacggagaatcgacctcgggccctccgcgggcgagaggctcaggaagagggacgagggtccggacgtgcgaggcaggcgtcccggaaacggaaggaacggtgagaggcgtggcagataggctcagggtcgcgattgccgcgggcggcacggcgggacacatcaaccccgcgctcgccctggcggaggagctctcctcccgcgggcacgacgtgcgcttctacggccagccaaccaggctcgaggcgacgctcgtgccgcaggcgggcttcccgttctctcccatcgacgtcacgggcttcgaccgctcgcgtccctggacgctcgtcagcgccctctggcgcatgaggaaggcgcagagcgtgctggggcaggacttctcccgcgacggcgcgccggacgtggcggtgggctttggcgcctacgtcgagctccccctgatcaactggtgccacgaccacggcatcccgtgcgtcatccacgagcagaactcggtccccggcctggcaaacaagtcctctgcccgcaaggtcaagtgcgtgtgcgtctcgctgcccgtcgccatcgacgcgttcaaggaccgcgtgtccgccgacacccagatcgtcgtgacgggcaaccccgtccgccgcagcgtcatcgaggcgagccgtgcgagcggcagggaggcgctcggcattcccgacggagccaccatgctgctggtgttcggcgggagcctgggcgcccggcacgtcaaccagggcgtggagcggctgagggacgagctcctctcccaggacgacctctacgtggtgcactccacgggcaagagggactacgacgacgtggtgcgcgacctggccctcaccgacgagcaggcgaagcgctggagggtgctcccctacatcgacaacatgggagaggcgcttgcggccgccgacctggtgctctcgcgcgccggtgcgtcctcgatcgccgagatcgcggccctcgccgtcccgagcatcctcatcccataccctcaggcgacggcggaccaccagaccaccaacgcccgctacctcgtcgacgcgggtgcggcctggctggtgagcgacgaccagatcgaccagcccgtgttcgaggagacgctcatggggctcctgggcgacgcgtccgagcgggcccgcatgcgcgagtgcgccaaggggttggcacaggacaaggccgcctcggccctcgcagaccaagtggagagtgccgccgccctcaggtgacgcgtcccaatcgggtagagtatatgggtggtctgcccatcgggcgggccactcatgctgtctttaaggagaaggtgcccatggccgattccgtatccgcctctaacatccacagcgctcacttcatcggcatcggcggtgccggtatgagcggcatcgccctcgtgctccaccagcgcggctgcaaggtcaccgggtccgacctcaaggcgtcccgctacgtccgcgacctcgaggccgcggggatcgacgtgcgcgtgggccacaaggccatcaccatcgacgaggtctcgccggaggtcgtggtgacctcctccgccatccccgagaccaaccccgaggtcatccgtgccagggagcttggcatccccgtctggccgcgcgcgaagatgctctccgccctctccgaggacgccaccaccgtcgccgtggcgggcacgcacggcaagaccaccacgtcgagcatggtcgccacgatgctcgaccacctgggcatggacccctcgttcctcatcggcggcatcgtggaggagtacggcacaaacggccgcaacggcaacggaggctacttcgtgtgcgaggcggacgagtccgacgggtcgttcctctacctcaaccccgacatcgtggtcgtcaccaacatcgaggcggaccacctggaccactacggcaccctcgagaacatcgagcggaccttctgcaagttcatggacctggtgggtgacgcggggaccatcgtgatctttggcgacaacccccactacgtcgagcttgcgcgctccacgggccgcagggtcctcacctacggctttgacgagggcaacgacttcgtgtgccttcccgaggacaaccaccacggtctggagagccacttcgtggttcgcgcccccaagggcgaggtgcccgtcaccatccacgccaaccccggccgccacaacatggcaaacgcgactgccgccatcgccgtcgcctacgccctggggtgcgacctcgatgccgccgctcgtgccgtgagcggcttcaagggcgcccatcgcaggtttacgcacgtgggcgacatcgacggcgtgaccgtcgtggacgactacggccaccatcccaccgagatcaaggcgaccctcggcgccgcgaaggaccttgggttcgatcgcatcgtgtgcgtgttccagccgcatcgctacacgcgcacccaggccctccaggacatgttcgcccacgccttcgacgacgtggacgtcctcatcgtcactgacgtgttctccgcgggcgagacgcccatccccggcatatcgggcaagacggtctcgggcaaggtcgaggaggcgggcgtcgttcccgacgtgagcttcgtccccaaccgcaaggacgtcgtccgccgcctggtggaggttacgcgccccggagacctcctcatcacgcagggcgcgggagacgtcacgtccatcggcccggccttcatcaaggcgaagcgggagcaggacgaggaagcagagcgctaggttgagcgtctacaacgcctacatggccctctcgggggcccttgacgccgacgtgaggagggacgagcgcctctccatgcgcacgaccttccacatcggcggtcccgcggcgctctacgtcacggttcatagctaccctgccctgcgcagggtcatcgagcggctgggggccgaggacgtcccctgggtcgtcctggggcgcggctccaacatcctcgccgccgacgccggttacagggggtgcgtcatccgcctgggacgcgagttctcaaagatctcgttcggccaggacggcgtcgtttccgccggcgctggagccacgctctccaagctggtgaccgagacgctcgcccactccctctcggggctcgagttctgcgtgggcatccccggcaccgtggggggtgccgtgtcgatggacgcgggtacccgccacgagtggattggccccctggtgagcgacctcgtcacctacaagcccggagaggggctcaggcgctatcagggcagcgaggtcgagtggggctaccgctggacaagcctccccggcgacgaggtcatcctcgaggccaacctagcactgcagccgggcgacaaggcccagatcggcgaggagatggacaggaggctctcgcggcgccgcaccaggcagcccctggggagcccctcctgcggctcggtgttccgcaacccgggcgaccgctccgcggggaggctcatcgaggagtgcgggctcaaggggtatcgcgtcggcggcgccgtcgtgtccacccagcacgcaaacttcgtggtcaacgacggcggagcgactgcggcagacgtggtcgccgtcatccgccacgtccacgacgaggtcgcggcgaggtttggcgtggagcttacgcccgaggtgaagtgcctcggcttcgaggagtaggacggtagctggtggcttcaaggcaaccgacacgtaggggtacgccacggggctccgggtcccgcccgaccggtggcggcagggcgtcggccccgtcctcgcgcccgtcttccgggcgaccctcccgcccccgtggggggcgcgtctcgcagcccaaggtctccaccgtcccctcgacggcccggcttcgctcccccaagcgggaggtaccggttcggaagcccgccaagccctcccttccctccattcccctccccaggccagggaggggggagcagacgcccgcggaacgccgctccgcccggcgggacaagggaggcaatgcggcgcgcagactcatcgtggcctgcatcgccgtcgccatcgcgctcctggtggcactcgttggcttcctcgtgctctcgtacacccccgtgttctccatcacctcgatcgagaccacggcgaccgagcacgtgagcaaggacgacatcgccaagctcgccgccatcccccagggcacgacgctgctcaacctcgacgaggccaagatcacctccaacctgcagaagaacccctgggtgggtcaggtcacctacgtgagggagttccccaacacgctgaggatcgaggtcacggagcgttcggttgagtccctcgtggtcatgtcgtcgggaagcgtggtgtggtgcctcggggacggaggggtctggatcgagcccgtgtccgtcaccacctcggatggggagtccatcgacgacgccgccctcgccaaggcgcaggagatgggcgccctcctcatcaccgacgtccccgccaccgtgagccccgtggccggctcaacggcgagcgactccgtcatccaggcggtcgagacctaccagagcacgttctccgacacgctcacctcgcagatagtgagctacagcgcccagagcctcgacagcatctcgtgcacgctcaagagcggcgtggagatctcgctggggtccgccaccgacgtgagcaccaaggaggaggtcatcgagcagatcctctcccagtactccggcaagctcacctacatcaacgtgcgcgtcccgagcaagcccacctaccgcatgatcgactccgacaacgtgggggagggcacgggggccctcgtggggaccgccacgtcgtcgacggacgcctcggactcctccgccacggactcggcggcaacggcctcctccgccgcggcggactcgtctgccgactccactgcggtgccagggcagtgacgagccggtccaggtggttgagggaacggggggacagagggttttggagccctaaccctaaagctccgcttaagactccaaaccaactaaaatggggcctctgagcaggggaatccacaattctgacaaagttgttgactccgtcggcaaaagtgtgcgaatatagcgcgctttgaacgtggcatagggttctacctgaggtttagggttttgcccggtccgattcaccgcaggaagctaggtaccagagaaccagagacgaaccatggcagacaggcgcaagagtcagcagcaccacaggaacggtaccgcagggcacaccatctctggtggggcggcacccgtacggaaaccggcggaagctccccagaccgtcgccaagcgaggaggaaccatgatggacaacgagatccccagcaactaccttgccgtcatcaaagtggtcggcgtcggtggcggcgggaccaacgcggtcaaccgcatgattgaggaggggatccgcggggtcgagttcgtcgccgtcaacaccgacgcccaggcgctcgcgatctcggacgccgacatcaaggtccacattggcgaggacatcacgcgcgggctcggcgcgggcgccaaccccgaggtgggcgcggaggccgccgaggactcccacgacgagatcaagcaggcgctcgccggcgccgacatggtcttcatcacggccggcgagggcggcggcaccggcaccggcgcggcgcccgttgtcgccgacatcgccaagaacgacgtgggcgcgctcaccgtgggcgtcgtgaccaagcccttcaccttcgagggccgtccccgcaccaagcgcgccgaggagggcatcagcaccctctccgagagcgtcgacgccctcatcgtcatccccaacgaccgcctgctcgacctctccgagaagaagacgagcttcctcgaggcattcaggatggcggatgacgtgctgtgccagggcacccagggcatcaccgacctcatcaccgtccccggcctcatcaacctcgacttcgcggacgtctgcaccatcatgcgcggcgccggcaccgcaatgatgggcgtgggcatcgcctccggcgacaaccgtgcggccgacgccgccgaggaggccatctccagccgcctgctcgagaactccatcgacggcgccacgcgcgtcctgctctccatcgccggcaacaaggacctcggcatccaggagatcaacgacgccgccgacctcgtggccaagaacgtcgaccctgacgccaacatcatctttggcacggtcgtggacgagagcctgggcgaccaggtgcgcgtcacggtcatcgcgaccggcttcaacgacggcaacgtcaacgtgcagcagtccatccccacgctgggcacggaccgctccagccgctcctcgcgcggctcccgcgtctccgccccctccgcggcgccccagacgtccgccccgcgcccgtcctcggctccctccaacaacgacaaggagttcgacatccccgagttcctgaagcacagccgcatctaggtgctcgacgatgacgaccccgtgcctttccaggttcgtctcgcatggcgtgaccctgctcggtgaccagcgtcaccccggcggggtcacgcttgcgttcaccgagcggacgggtggcgtgtccgcgcctccctacgcgtccctcaaccttggggaccgctgcggcgacgacccgcatgcagttgccgagaaccgctttcgcgccatccgcgccgtgggggcgggggactgggaggcgcgtctggtcaacccccatcaggtccacggcgaccacgtgatcctcgtctcgagcgaggacgaggcctccatcgacgccgccaagcgcgcggcctcggccggcgctgacgcggtggtctgcgtggcgccccacgtcccggtcctgctctgctacgcggactgcgtccccgtcgtgctggtggtggggggcggcttcgcggtcgtccactcgggttggcgcgggacggcggcgaggatctctggcaaggccctcgacgtgctcctctctgcgacgggacgccaggcgggcgaggccctcgcctacattggcccccacatcgccgggcccgactaccaggtctcccacgaactgctccagaggttcgtgggggagtttggccccgaggtcgactgcgggggagacaggctcgacctcgcgcgggcaatcgaggccaccctcgaggcgcgcggggtcccgtccgccttgatcctcgactgcggggtgtccacgccacggtcgctcgaccgtttctactcgtatcgtgcggaggggggaacatgcggacgccacggcgccatcgccttcatgtcctgaccacgctcgtcctcgcggcagccgtcaccctgccgatcgcggggtgcggcacgaactcggatgggaacagcaagaccatcacggtcgccggctccaccacggtgcttcccatagccgagatcgccgccgagaagtttgaggaacagaccggcaaccaggtcctggtctcgggcctcggctcgtctgcgggcatcgaggcggtcatcaacgggaccgccgacatcgccagctccagccgcgacctcaccgacgaggaggcgagccacgagctcgtctcgaccgtgatcgcccacgacggcatcgcggtcatcgtcaacgactccaacccggtcaaggacgtcactctcgaccagctgagggacatctacgcggggaagatcaccaactggaaggagctcgggggacccgacctcgccatcgagctggtgaaccgcgacgaggcctcgggcacgcgcgaggcgtttcgctccatcgtcatgcgcggcgaggactttgaccgaagcgcggcagtccttcccggcaccggccaggtgcgagacgtcgtgagcaggtccgagggtgccatcggctacatctcgatcggcttcgtgaagagcgactacgccaccaccacggtcaagacgctcagcgtggacggtgtggaggccacgaaggagaacgtgagctcgggcaagtaccccatctcgcgcgacctgtacttcttcaccaacggcgacccccagggcgtcgcctacgactacgtccgcttcgtcctgtctgacgagatgtcgcagaccatcgaggacgcgggctacatccccgtcgactgggaccagtcggcaagtggtgacgacacgacgacgggaggggaggggaaatgagcgagcgcgacgacagggaccagctcctcgagggcttgcaggagcctccccagataggccagatagagcccaacagggacgaggcgctcacgcggagcacgcgcgagctcaagctcatggaccactcgacgtacgtgaaggaggggattctcaagaacctcttcctcgcgtgcgccctcattgccgtggccgccgtggcgctcatcttcgtcttcacgctcgctcgtgcgctgcccgtcttcaccgacatcggccttgcggggttcttctcctccgtgtgggcgccgtccgaggggcgctacggcatcctcgcgctcctggcgggctccgcgctcgtcaccgtcggcgccctcgtcataggcgtgcccctcgccgtcggctgcgcggtgtacctcacgcagatcgccacgcgcagggtcacgcgcatcgtgagcacggccgtcgaccttctcgccggcatcccctcggtcatctacggcttcttcggcctcgcggtgctgaggccgctgatcgcaggcgtctccggcggcctgggctttggcgccctcaccgcctggctggtcctcgcgatcatgatcgtccccaccatcaccacgctctcgatggacgccctcaactccgtcgaccccggcgtgcgcgaggccgccttctccatgggggcgacccgctggcagaccatctacaaggtcgtcctgcccgccgcgaaggtgggcatcgtcaacgccatcgtccttggcatgggacgcgccataggagagaccatggcggtcctcatgatcgtgggcaacgcgccggtgttcccggcgtccgtcaccagccccgtcgcgacgctcacgagccagatcgccctcgacatgggctactcgtcgggcctccaccgcgcggcgctctttggcatgggcgtggtcctctacgtcatctccgcgggtctcgtgggcatcgtccgaatcatcacgggcaggagcgagaggagggagcgcgaggcgtctcgccccgccacccccgtgaccgaggaaggcgcgcgctccgtcgccgagggtccctccagggcggactcctctgccgccaaggcgcaggagggctccgcgcagctcatcaagagccgcctcgccaacgccaggaagccgcgcgtctccaagcgcgccaccgactccgccatgacgggcgtgttctccgccgcgggtctcgtgaccaccgccatcctggtgctgatcatcggcttcgtggtcgtcaacggcgccccgcagatcacccccgccttcatcttcacctggccccagggggtcaacgccgagggcggcatcttccccacgatcgtctcgacgctctacgtcaccgccctggcgacgctcttcgccacgccaatcgcggtgctcgccgccgtctacctggccgagtacgcccaccaggggaggctcgtcaacttcatccgctacgcaacggacaccctggcgtccgtcccctccatcgtcatgggcctctttggctacgcggtgttcgtggaggcgtgcgggtttgggctctccatgctctccgcggcgcttgccctggccctcctcatgctgcccctcatcatgaggaccacggaggacgccatccgagcggtgccgcgctacatccgctggggcgcgtacggcctgggcgccaccaagtggcaggtcgtgagcagggtcgtgctgcccgcggccttcccgcgcatcgccacgggcatcgtgctcgccatcggccgcgccatcggcgagaccgccatcgtgctctacaccatggggcaggcggtcaacctgccggtcacgccgctggactccgggcgctccatgcccgtgcacctgtaccttctcgccaacgacggcatcaacatgggggctgcctacggtacggcgctcctgctcatgatcatgatcctggccttcaacctctttgcgcgccacatctccaagcgcggtgccaggcaaaagggagggaagtagcatgaccgtctaccgccatgcgccccagaaccccaaaggggagggcatccacgtcgaggacttcaacttctggtacggcgacttccatgcgctcactggcgtcaacctcgacatcgccccgcgcaagatcacggccttcatcgggccgtccggctgcggcaagtccaccttcctcaggtgcatgaaccgcatgaacgacctcatcgagggcacccgcgaggaggggctcatgtccctcgacggcaacgacgtctacgccgtcggcgtggaccccgtcgacctgaggcggcgcgtgggcatgatcttccagcagcccaacccgttccccaagtcgatctacgagaacgtggcgtttgggccgcgcctccagggcgtcacctccaagggcgacctcgatgacatcgtggaggagtcgctcaagcgcgccaacctgtggaaggaggtgtcgggccagctgggcaagaacggcctggcgctctccggaggccagcagcagcgcctgtgcatcgcccgcgtcctggcggtccagcccgacgtgctcctgatggacgagccctgctcggccatcgaccccacgagcgtgcagaaggtcgaggacctgatggccgagctcgcccccacggtcacgatcatcatcgtcacgcactccatgcagcaggcagcccgcgtgagcgactacatggcgttcttcctgcaggagcgggcgggggagcccgccacgctcatcgagtacggcgacacgagcgagatcttctcccgccccagggaccccaggacggagagctacatcaccgggcgctttggctagcgcgcccgccacggcaggacgacggaagacagagggaggccatcatgcgcgaacaatttgacaggcagctggtcgacatgcgccaggaggtcgtggcgatcctcagggacgtcgacgtcgagcttcacgacgccgtcgatgccctggtcgagggcgaccgcgagaaggcgaagctcaccaagaaggcgacgcgcaagatcgaccgccgctgcgaggagctggaggacaaggcctaccaggcggtcgtgctccagcagccggtcgcctctgacctccgcctgattcagttcatcatctactccgacttcaacctgcagcgcatgagcaaccacgcgcgcaacatcgccaagacggccaagcgcgcctccaaggtggaggtcccgggccagctgctcgacctcctcgcctccatggcgcacctggtctaccgcgtgctggggacgctcgccgaggccatcgtcgagggcgacatcgtgaaggcggcgaccctgcccgagctggacgagccggtggatgacctctacaaggagttctaccgcgtgtttgcccagctgcaggatggcgacgacatcgacgccgccatccgcgtggtcatggcggcccgcatgctcgagcgcatctcggacaacgcggtcgagatgggggagagggccgtgttcctcttcaccggcaagcgcgtgcacctgagcgacctgcccgacctggacgagggggagctgcgccacatgtacgttgccccgggccgtaccatcacgctcgggctcgacgaggaccggcgcgtcgcggagcagatccccgaggtcgacctcgcggacgagggcgaggcgcccgatgacttccgcgaggcggcggcgcggagcctctccgagctgcatgagcagcgcgagcgccgccgggccgagctcaaggcatggcgcgagcagatgcggcgcgagtgggagatgaacgtggcttcccacgcggcacccctcccgggggaggcgagccctgcccccgggcaggacggcggggagccccctgcgaggacgggggacgacggcgaggtcaccgagagcggcaagagtggggagagcgactagggtggacgagagcgagcaggagcggtacctggcatttctcggggagcgcagggggcagatcctcgagcgcatggcgacggcgtgcgagaggtccggcagggacatgggggaggtcacgctcctggcggtctcgaagaccgtagacgtggacagcgtcgccctcgcctggcgcgcgggctaccgcgccttcggcgagaaccggccgcaggagttcaggcgcaagctggagggcctctcctctcaccccgagatggacggcgtccgctttgacatgatcggcaacctgcagaccaacaagatcaacatggtcgtgggcaacgtcaccctgatccactcgatctcgtcgctgcacctcgccgaagcggtctcgagccgctcacagacgcacggggtgacctcgagggtcctgctcgaggtcaacgtctcgggcgaggagtccaagtccggcctcacgcccgacgaggcgcgccaggggctggagcacgtgctctctctccccgggctcgacctgcagggcctcatgaccatggcgccccgcaacgagccggacgtggcgcgcaggaccttctcggggttgcgcgagctgcgcgacgagctcgcgaccaggtccgggagggagcttcccatcctatcttgcggaatgagtgatgatttccaaatcgcaatcgaggagggttcgaccctcgttaggcttgggagaaccgtgttcgacccaggctacgagctcaaatagtggaataaacgcaacagtgccacacgcaaccgggcagcgcccggcgggaaggacggtgtcagcatgggattcctcgacaacctcaaggacaggttcgggtccaaggacgacgactactacgacgacgactactacggtgacgacgggtatgacgagcccgcggagccggtgaggcgtcccgaggcggacacctccggcgtcctgggcaacacccgcaggcccgaggcggagagcgtctcggtgtacacccgctccggccgccccgttggcgacaacgccggcgcggcgtcgagcgcctacggctcggcgacctccacgtatgccccgcgcagcacctatgcgcccgcgcagcagggcggctatgccggctacgacgacgatgccacgacctccatcgggcagcactcctacgcgtcccacgactcggtcctgggcaacaccaccggtggcaacacgccggcggacatcgggctcaaggccgtgccgcgcgtgagctcgggacagcttcccccctacgtgctcaagcccgtctcgtacgacgacgtgcagatggtcgtccgtcgcgtccgcaccaaccagcccgtggtcctcgtgttcaggaacaccaacatcgagaccgccaagaggattctcgacttctgctttggcctcgcctgcggcctgggtggcgtggtcgacgagctgggcgatcgcgtcttcgtcgtgatgccgcagggcgtcgagctgtcggactccgacatcaacaagctcgtcgccgacggcacgatccagaggtagcgcgatgggcatgggcagcgagcgcctggacttcaccgtgggcgtcgtgggcgcgggctcgatgggggcggccgtcgcctcgggcctggttcgctccggagccatggacgcctcgcaggtgagcgtctctaacccctccgagggcaagctcaggccactcgccgagatgggcatctcgaccttccggagcaacgcggatatgctcgagggcgacgtgcaggtcgttgtgcttgccgtcaagccccagatcctcccctccgtggtgggcgagatgggcgaggccctcaaggggcgtctcgtcatctccatcgcggcgggcatcccgctcaataccctcgagggcctcatgccgtcctcgcgcgtggttcgcgccatgcccaacttgcccgtgcaggcgctctccggggcgacggcggtgtgcgtgggccccagcgcgaccgaggaggacgccaggcacgcgctgggcgtcttctcctgcctgggcgtggcgaagctgatgagggaggaccagctcgacgccgagggggcggtcgtctcctgcggccccgcgtacgtggcgctggtcgcggacgcgctcacccgccggggcgtcgaggcgggccttcccgccgccgactgcaggcagatggtcctctcgaccatgcgcggcgttgccgagcagctccttgagtcgggcgagaacccccgggcctatatggagcgggtcacctcgcctggcggcacgaccgccgcgggcctgcgggccatggagcccggcctggtcgactccctgtgggtgggggtcgacgccgctctccgcaggaccgcggaactctccggaaagtaggtttcatgggcaacgttcgctatttcctgagccagatcctctacctctacgagtgggtgatcgtgatcgagtgcatcctctcgtggctccgcatgaccggctcaaccgtgatcgaggacgtctaccaggcgacgaacacgctggtcgagcccgtggtcagcctgtttcgccgcttcatcccgcccatcatggggatggacttctcgcccatggtcgcgctgctggtgatcgaggtggtgcgaaatctggtctactgacgcaggcacgcgaaacccatgtggggatatactctaacaagtggtcttccgcaccagtgaaccagcggtgcgcaacctaattcgaagggaacacagatggctatcacaccagcagacatcgagcagatgaccttctccgaggccaagaagcacggttacagcaccgaggaggtcgacgccttcctcgaccagctggcgagcgaggttgacgccatgctccagaagatcgcggacctcaagggccggctcaacaactccgagcagcagcttgcagccgcccaggcgcaggtcgcgcagctcaaggagcagagcgcgtcctctgccgccatcgagcccgctcccgtccccgccgcgcccgtcgccgactacggcgcgtccgagcgccagatctcgcaggtcctcatcgtcgcccagcagagtgccgacaagctgctggcagacgcccgcgccaacgcggacaacatccgcaacgaggcggatcagaaggcgcgcgaggtcattcgccaggcgctcgccgagaagcagaacgagctggacgagatcgatcgtctcaagcagtcgcgcgaggacttccgcagcgagtacaagaagatgctgcagcacttcatggatgacgccgacagcgtctttcccgagaagaccctgagcactcccactggctctgcgaagggctccacctcttccagctcctcgttcgtcgcgccggctcccgtggcgccgcagcccgcggctcccgcggtcgatgcgcaggcgaccacctttgccccagctcccacggacacggacttcagcgacctggactagggcgcaatctcctgtggcacccaaagaggcggccgactccctacggggtcggccgcctttgcttgtgtgcgcgggggatggtgacgggcggcaacggttcgccttcccgcgcggacgggctttgcacgacagaccgttggcactctccgtttctcaggagtcgccgatcctctgttgccccactgccccctgaggcttcgatgcccatccggcaaaggggctggaaggggcctccgcgagctctggaagcgagtcccacagccgcttgggcatgaagcgcgccctgaggtcgtatcccctgcccgtggcatccctgccggggagctccatcgagcggtagaaggtcgcccacatctcctggaacctccgctcctccgtgtcgacgtcagacgccgcctcccttgcctggcgtgccatccccgcatcgagccgcgccacgcgcgccgagcgatcgccctcctcgtggaagaccgcgatcccgtggatggggtcgagcatgcagaagcggtcccctctcattctcctcgagaagtgctgggcacagagcgggagcgtgtttgccttgggggagagggagcagaaccagccgccgctgggaaggtgcgagaatcgcgcgaactgcctcgtcttctcgcactcggaggagacctgccgcgcgagggcgtcaacggccaggacgtctgcatgggcaaggctgctcgtgacgtttgtgccgagggagaacgagagcctgacgtagcggttcacgacctgcggcatcccagggtcgtcggatgcgcaggcgtacaggatccgattggtgcatcccgacccgcagcgctgcccgagcgactgccatacgcggcgggcgagggggaccaagtccccctcgctttcctccgtgaccaggagcaccctttcgagcagctctggctgcagcgcctcgtggtcgcagatcctggttgacgacgggtcggagtgtgcaaggtaggtgagtgctatcccaccgaggacgccctccatcgagcgtgggacccccagcgcgaccggaattccctcctcgcgtgcggacttcaacgccttggtgaggccacggagaccggctgggacgacatcctcccctgggccaacctcagaagagggtgagctgaccctctgcctcccgtcgcgcccgagagtaccgtgttgatcgcgcatcatccatcgccttcctcctgaggtagccctcgtccagcacggagccactgtccctccttccgcagcaggtgacgaagggccgcgcccgcttgagggtgatcttgagcgccgccaggtcgtcgaagccgaggcgctgcgtccttcgcgccgccacgatcctccttgcgcccacaggaccgatgccggggacgcggaggagggtctcgagcggcgccgtcatgacctcgacgggaaagcggtcgaggttcgcgatggcccaggcgagctttgggtcgaggtcgaggtcgagccacggcctgtcctcggtcaccagctcgcccggtgagaagtcgtagtagcgcatgagccagtccgcctggtacagcctgtgctcgcgcctgaggggcacgggcgtcccgggctcggggaggcgcgagtcgctgagcatgggcatgtaggccgagaagaacatcctcttgaggtcgaacttcttgtacaaggactccgagagcctgagtatctggcggtccgtctcgggtgacgcccccacgatgagttgggtggactgccccgctggggcgaacttcctacgcgagttgggaacggcgctcctggacttgctcagggtcatcctgagcgccgccccgcccagtccggggcccatgtcacccgatgccggcctgcgcgccagcgaggccccctttccctgggcgaggaggcggctctcctcctcccgcctgccccgcgcgatctgacccatgggcgcgaggacggcacgcgagtccttgtccgggcagagcgcctggagcgacgccgagcttgggaactcgacgtttgagctcagtcggtcggcgagcagccccaggcgcctgacgagctccggcgacgtgccgggaatcaccttggcatggatgtagccgttgaagtggtagtcctgccgaagggtgcgcaggcacgctatcatgcgctcggtcgtctcgtccggagtccccagcacgcccgacgagaggaacagcccctcgatgtagttgcgcttgtagaagcctatggtgagctcggccagctccctgggggagaaggtggcccgcgggcacgaggcgccgcgccggttgacgcaataggcgcagtcgtagctgcaggcgttggacatgagcaccttgaggagcgtgatgcagcgcccgtccggcgcgaagctgtggcagcaaccagccgcccgggcgtctcccacgccccctttgcgagggctcctctggacccccgaggaggtgcacgcagcgtcgaacttggccgcctccgcaagaatcgcaagcttgtccatgacgtccatggggcctccagaccgtacaggtgttctgtaccgattataggcgagtgcccgcgttgcgtacaggcgttctggtgggtatgcccatggcaggcttgaagtccgtgggctacgtcgcgctactacgactgagccccatcgccaagacaggacaagttgcgacaagagtggtgcgcctaacaggcaggatgtgctcgcgcgagaaaaaacaagtgcgaagtgggcctatgagccgggttctgtcgtggacgatcatttatctactgacgccgttgccggcgccctctagcgcgcaacccgagcgcggtgcgggccacaccatggcgctcctatttgcgtttgctccggaaggggcttgccaagccgccgtgttgccacgacgctggtggtctcttgcaccaccgtttcagcttttctctcacctgcttgcgcaggcagcgggagtcttcttttctgcggcgctttccgtcgggtcgccccgcctggccgttagccagcttcctgccctgtggagcccggactttcctcatggccacccgttgccgggaggccccgcgatcgcctggcccacttcgcaggggagattgtagcatgcccccgtcgcgcccccgccgggttcccgcatctccatcttggctgcgcgaggcttcgtttggatggcacgcagcctcctttgctaccatctgcaggagacgttcgtccgtctgggaggttgcatgcaggcatccgagggatatctcacgctcgagggcgggtacgaggccaccgccgaggtcgtcgaccgcaggagccgcttcatagcccagctccgtcacgtggagggcgaggtgcaggccgaggagttcatcgcggaggtgcggtcgcgccaccacgacgccaggcacaacgtgcccgcctggctgctgcacgacgggagggagaggtgctccgacgacggggagccccagcacaccgccggcatgccgtgcctcgatgtcctgaggggggcgtccctctcggacgtgtgctgcgtggtcacgcgctactttggagggaccctccttgggccggggggactcgtccgcgcctactccgccgcggtccaggctgccgtggaccaggcgcgtgacggggaccacctggtccgaatgaccctggtgacgcgcgtgacctgcaccattccctacgccgcctacggtcgcgtcgagcgcctggtgggggagtgcgggggcaaggtgagggacaccatcttcgccgaggacgtgcagatgaactgcgcgttccccacggggcgggaggacgccttcgtgcgcgccatgagggagcttgccaacggggaggacctctgcgtggtgggcgagccctcctttggggtgctgtgatggtcggtctgtttgccagcgacctggacgggacgctcctgggggcgacgcaccgcgtgagccgaccggtccttcgcgccatccgcgcggcgaccgactcggggaggcacttcgccgtcgccacgggcagggtcatgcgatcgcccggcgacttcggctttggcggcgtgcccatcgaggcggtctgcgccaacggagccatcgtcctcggcagggacgggtcggtgctccaccacgtccccatggcccccgccttcgtgggagacctcctcgaggcctttcccggggtcgacttggagtgcgtctcgctcgaccgcacctatcaccgctgctcgcgggaccagttcctggcccacagggccagcggcggaccggcgcggagggtcctctcgctgctggtgcccctccgcgagggcgagcacgcctttggctgccccgtcgagaggatcgtctcggcgggcatcgtgaaggtgaactgcaggccgaccgaccccgcggtcgcccgggcgctcgaggcgtacgtttccgcacacccgtcgcaggcggtcaacgcccccttcagtcctcagatgctcgagatcaccgacccctccgccaacaagggctccgcggtcgcgtggctcgcgggatggctggggcttcgcgaggaccaggtggcggtgtacggcgacgggggcaacgacgtggccatgctgcggcgcttctcgcgctcctacgcccccgccggagccatgccgagggcaagggagtccgcctcgcgcatcctgggctccaacgtgctctacgcggtgccacgccacgtgatggcgaccgtgcgcgacgagggggcgttcgcgaggggctagggcgggggagagaggggcacccatccgcctggtgcccgtgcggatgggtgcccgttcgtctctcctccatgcgttacagggagatcccgaagtcccccaggtgtgcctcgaggtccgcggcggtggtgaagcggtaggcgctcatccccgccctgcgggcaccctccacgttgtcctggctgtcgtccacgaagaggcaggcggagggttccagcccgtacctctggcacaggagggcgtagatggcagggtctggcttcatcaggtgctcgtaggccgagaccacccagcccgagaggagggggagcacggggatcctccccttggcgcggtcaaacctgacgccggcgttggacagcaggtagaggtcgtagcccgcctggtgcagccgccgtgcgaggtcgttggtctggtcgattgccggctggcgcaggtcccagttggcggcggcatcttcgaggcttggccacaggcgctcgggaagccgcctgcgggcgatggcgaacatggtgtcctcgctgatgacgccggcgtcgagcagcgcccaggacgggttggagaacagcgcgtcgtcgagggcgcgggcgtcctcctcgcttgacgtgaaggctcgcgagaagagcatgccgtcaaagcggaggagcacctgccccatgtcgaagaccacgttccgtatgcgcgccatcgtctctcccctcggctacagtgactggtggcgaagcgcgcggcccatgccgctccagggctccacctcgtcggcgggcagctcgtcccacatcctgagcacgtcctcgggaacgaactcgcggcggacggcgacttcgccgccgtacaggtggaaccagtcggcggagaccaccaggaagccgtccttgcaggcgtccttgccccagctgttctccacgcgccacgcgacggggcgtccgtccgcgcccagctccacgccctggaaggtcatcgcgtgcgtgagcgagctctcgcgcaggtcgtacatgtcggcgcgttccatctgcaggtcgacgtcgaagaggccctcgtagtccatcgtgtcgagggccagcaccccggggaagtcctcgattccgcgcgggaactgctgcatcacgtcgcaggacatctcgcaggggacgcccgccttgagcgaggccacggccgcggcgtcgaggacctccggctccacgttgaggaagcgcaggggggtggcgcccagcacgctgtcggtccacctcaggtggtacgcatggccatacgggcgggtctcgccggggatcgagaccaggtcgacgtagtcgttggggtcaaaggggacgtagcgctcggcgaactgccttggggtgatgccgcggtctcggaggatgcggcgcggcttgtcgtcgtccttgccatcgcccttgccgccgtcgccctcgcgcgagccgccctggacctcgagcctctcggcgggtaccttcgcgtccttgccgacggagacctcgaggtcaaacgtcgccgggggctcgcccaggcaaatcgcgagcatgcggtagaagccctcgagcatctcctgcttgcgcgccctgagggcatcgtcgcccacgccctgggcatgcatgcggcgaagctcgcacgcgtcgcgccttgcgagcctgttgagctgggcatccatctgcgaggagtccttggagcaggcggtctcgggcatcacgtccttggggacgaggccccacttcgcgatgaggttcatagcgaacgggtagtagcccccgtcctcgatgccgccctcgagcacgaacgagagctcgcggtcgtcggcgggacggcctgccagggctatcacgttctcgaggaaggcgttggccttctccagcttgtcgtagaacatgccgaacgactggctgaactcgaagctgtcgacatcgagcaggcgcatggtctcggcgcgggcgacgttgtaggccgagaacatccagcagcggccggagtggcgctggttggtcacctctcccgtcttgggccggctcaccgagaaggtgtcgtggtaggtcctcagggtcgagacgtcgcgcgccgccttgaagaggttgtcggacgtcaccgcgttgcgggcgatgcggttgccgcggctcccgccaaagctgtcatgctgttcccgtgcccagctgggctcgactgtggtgctcatgtctctcctaacgcggcgccctcccgtgaacggggagggcgcctttggtcgctgtcgcgtggttgccgtgcgtccctagcgggcgagcgcgagggatcccatggggtcccagggctccaggaccgtgggctcctcggtctcgtaggtgtggcgctcgtcgggcgagaggtacctcttgtccacgacgacctggtacacgtactggtcgaaccaggggtcggagagggtgtcgaagccgtccctgccgtggtccttgccccagctgttctcgaccttccagagggtgggggcgccgctctcgtccagcctgacgccctcgagcaccatcgcgtgggtcatgagggactcgccgtagtccaggcgctccgccttgtccatgcagccctccacggggaacccgaggaggccgtccacgtcgagggcggcggtgtccatgatgccctcgtcgcccaggtagctctgcgccacgtcgcagccaaaccacacggggagcccgtcgcgcagctgcgcaacggcgacgcgcttgagctcggacggctcgaggttgaggtagcgcacgccgccatcctcccacacgttgcccaggcggctcacggtgtaggtgtggccaaacggcttgtcggcggtgggggcgctgatcagcgacacgtagtcgtcgagctccatgcccacggcctcgtcaaagaactcccggggcgtgaacgtgccggagagcgcgagctcgtcgtccttgtcgcgcaggcgcacctcaaagctcgcggggggctcccccaggcaggtgacgagcaggtggtacacgtcgtccatcatctgcttcttcatggaggagaggtcgccttggccgacccccgccgcgtgcgactcgcgcaggcgcttggcgcagccgcgtaggtagcgggtgagatacgcgtccatctcgcgggtgttgcgcgagcaggcggtctcgggcatcgactccttggggacgacgccgtacttcctcacgaggctcttgaacatgtcccactgcccgccgtcgccgatggggtcggtcagcaggtaggagacgagcctgccgcccaggggctcgtcgagcgtgtcgaggatgttctcgaggaaccagttgctcttctccagcttgtcgtagaacagggggaaggcctggctcagctcgaaggtcttgaggttgtacttcttgatgacgcgatagcgcatggtgttgaggctcgcgaacatccagcagcggccggagcgctgctggtcgcagcgcttgccctgcgtgaggtcgatgtcaaactgcatcgtgttgcccgcgaccccctcgggaacgcgcgctgccgcacgaaggcccatgctggtgaccgcgttcttggcgacgacgttcgcgcgctcggagaggaatccctcgcggctgttcgtcaggtcctcggcagtaacgctcctcatcgtgtccattcgttctcccttcccgcgcttggcggaccaaaatttgtaccgatgcgaggatagcacggcgcttgcgtctgccatgcagcggcgtgatgcgcgtggagacgcgcgagcgatggcgtctgggggcggactcccatggctgccgtatactcgtgggaagacaggggtgcgcggggccggtgtgtcgtcgggggtcccgtctgcacgcttccggagggaggccacatgggagcggtgggagttcccgcctacgaccttcccgactacgcggtgagggtcctctccgccctcgagtcggcggggttcgaggcctgggtcgtcgggggatgggtgagggatgcgctgctcggcgcgccctcgcacgacgtggacgtcaccacctcagcgcactggaggcagaccgcctcgtgcctgcgtgccgcggggattaccgtccacgagacggggaccaagcacggcaccgtcaccgccgtcctggatggccgtccggtggagatcaccacctacagggtggagggtgcctacagcgacctcaggcatcccgacgaggtccgcttcgtcaccgacgtgcgagaggacctcgcgcgccgcgacttcaccatcaacgccatggcgtttcatcccgcccgcgggctcctcgacccgttcggtggcagggaggacctcgcgagggggctcatccgcgccgtgggggacccgaggctccgctttggggaggacgccctcagggtgctccgcgcggtgcggtttgcgtgccgcatgggcttctccgtggagccgcgcacccaggaggcgctcgcagcctgcgccccggagctcgcccacgtcgcgcgcgagcgcgtgggccaggagctcgatggcatcgtcgcttcggggcgcatgtcctgggcgctcctccacgagacggaggtgatgggggaggccatcccccaggtggccgccatggcgggctttgaccagtgcaccccctatcacatctacgacgtgctggagcacacggcgcacgtctgtgccgcggtggaggagtttggcggcgggacgcccctgcccgcgctgcggtgggcggcgcttctccacgacgtcgccaagccggtgacgttcacccgcgacgagacgggacgcggccacttcttcgggcaccccaaggtcggtgccgtcatggcggagtcgatcatgcgcgagctcgcgctccccaactcgctggtctcctccacgcgcatgctggtgcggctccacgaccatgtggtcaagccgacggccaggtcggtgaggaggacgctctccaagttcgagcgcgcctgcccgggggaggctcccgccctcaccttcgcgctcctcgacctcaagcgcgcggacgcggtgtccaaggcccccggggcggagcgctacgtcgccgagctcgaccgggtcaccgggtgcctccgccgccagatcgaggagggcgccgtctatcgcatgagggacctccccgtcaccggtgcggacgtcatgagggagaccggcatgccacctggtccagccgtcggggcgatgctcggggagcttctctccggcgtggtcaacgacgagctgccctgcgaccgcgagacgctcctcaaccagatgcgcctgaggggatagggctcgggccacgatcagagaaacaaatttgagattggcccttgtgcgatcgcgacagatggggtagagtactttctcgcattgagacgcacaagacaacaccaattgggacgtcgtctagtggtaggacaacggattctggttccgtcagcgggagttcgactctctccgtcccagccatgtgcgcttcaatcggctcggcccgttcgtctagcggtttaggacgccgccctctcaaggcggagatcagcagttcgaatctgctacgggctaccacacgttcgcgggtcaccttcgggtggctcgcttttttgttcccatcgcctgaggcagtggtgccttcggttggttgagcgtgcaagggaggtgcgagagtgtctccccacgtcctctcgtcgaccccctcgcaggcgcgacgtgtctgacctcgaacagggccccggtcgccactcggtgtggtgggcggtcagccgcgtctgctcccgttggctcgcgatgataaatggggagcgccataaatcaccacgtcatgtagtgttacgagcatgggatgcttagccttccccgacctcgtgcagatttgctcgccaaatgcttagcgcccctaggcctcatgtgcacttttcgccgcacaacccttaggagtgctaggaaaattaagcatcgggtgctgaaatccccacaaggccgagcgttgccaagcacttagttcccaaaccgacatgggggctggcgaagccaagcctcgctctgcggaatccatgcgaggcggggcgccttcccccgcccagtggcggtgggatgccccgtcgtcttcgaaccctcgcctcgcagcctctcttcttgcttgtagaaagtcttcttggttttagaaagtttagaaagtatagaaactgtagaggagatgggggcaacggaacgcggggtgggatcgcgtgcctcgccgtgctgccctggcctgcatgagcggaggtgggggagaggcgccgctgccactcggctttccccaatctgcctggtgcctgcgccgtctggggtgacacgaaaagcgcgccccccgaaccaacggggagcgcgcatctgatttggtagcccgtagcagattcgaactgctgatctccgccttgagagggcggcgtcctaaaccgctagacgaacgggccagtatgtgaaggccaccttggctgggacggagagagtcgaactcccgctgacggaaccagaatccgttgtcctaccactagacgacgtcccaagaggtgtcttcgcgtgcctgagcacggggaatgactttatcggaaaagtgccgtccgtgcaacgagaatctaaaaagcgccctaattcacatttccttcgcttcttgccttcgcctcgtcgtccatctggtcctccgtgtcgtcgccgtcgcccccggcatcctcggaaggcgcttgcttcctgtcccaggtatcgagcaggaggtcccggggcaccgcgccgacctcccagacctgcgtgatcgagtcgaggcagtccctctcgccctcggcaagcccctcgcgtgcgatgcgcacgagctgggacacaaggtcggcggcgtccctgccgtacaccttggccccccaaccgtcgcgcgccaggtcccgggcagcagactccactgcctccggcgtggcggcgctcacgagcacgctcgcgagctcgaacgccttgtcgtcgcagaacaggccctttgcgaatgcggcgtacccaagggcaaggcgcgccggcagcgagtcggcgcacctcaggacgagcctgccgtccagccccacctcggggcacagtgccctgaggagctgtgcgacctgcgcgtcggagagctcgtcgcgcatcatcacggcgctcaggggctgctcgccgcaggggaggtcatggccgtccggccccacgtaccatgcgggtgcctggcgctccagccaggcgacgtacgcacggtagccaaaggaggggccaaacgcatcgggcaggggggacgagagctccggtgccgcctgggaccacagcgaccgcctgagcatgcgcccgcagtcgtgcgggtcctccccgcggaagcggagcgcgttgtccgtgaggaacgccaggatgggggagagggccgtggccacgcggtaggactccgccgcctcgcgctggccgccatagtcgatgccgacgacggtgtccgcggtcgcacgcatggcgtcgcgcaccttgtcgccatggcgggagaggtgcgcctcggtgagcgtgtggcgcgcgagcgggaccagcggcaggtcggagggggcctccaccgtggggttgtaaccctgtgctatgaggtcgacgtcgcgcccgacctcccgggaggcgaggtgcacctgtcgctcgagcgtcgcaagcgcctcgcccagcgcccgtacgtcatgcgcgggcccaacggtggagacgagctgaccagccgggccgacgcccacctcgacgcctatcgtctcagcgccaacgggaacctcgcccgtcgcagacgtcctcgactccgcgccatcggcgcccttgtcacccaggagccgcccggttgccgcgaccagggcgcccacgcccctctggcccgcaaacggaacggtcgtcccctcctgccggtcgaccacgaagcgctcgagggagagacgcaggcagcggctctcgtcaccccttccgccggcgtgctcgccccccgtcagcgcggcgaggagccggtcgtggttcctccgctgcctggcgaggtctgccgcggagggaaggctcgtgggatcctgcatggtgcgcactccttcgacgagatgcgacgggtgagccccgtcgccgacaacgtccttttgtgatgtaggttagtatgcccgtttgggcccttggggattattgggcatactccatagatgctaatcaacgcctggccgcatcaccgtcggcctcgcaggtgcgaacggagactgatgtcagcggattccacgggacgggagggggattcccccaaggtcagggccaaggtctcggccccccgtccaaaggtcacggggggcggcagcccagagtctgaggacagcaaggcggatgccaggaagggcgccctcttcctggcggtggtggttggcatctacgtagcctacctcctggtcaccggccagatggggcagttcctggacgcgctctccaaggtcgaccgaggctgggtcggcggcgcgtgcgtcatgttcctgctctacttcgtgttcggcgtcctcgcctacgtcatcgccgtctaccttgaccccgagtcccccgtgggcgtgcgcgacctcatgagcgtcgaggcgtcgggcgtcttcttcggcaacctcacgcccatgatggcgggggcggtgccggcgcagatctatcgcctgacccgcacggggcaggacgtgggcgaggcgtcggcaacccagttcacgcgcttcatcatgttccagtttggcgtggtgctcttcgccgcgatcatgctggcgtccaagctgtcgtacttcttccaggcgtacggcgacatcatcatcctcaacctgatcgtcttcgcggtgcacttcctcgagcttgccggtctcttcgtgatctgtctgtgccccaagctcgtgatgcgcgtgggcaactgggcgatccgctttgcgacccgccaccactggctcaaggatcccagcaagtacgacgacctggtcaaccgccaggtcatggagttctcccgtgccttcaagcgggcggcacgggacctcccctcgatgggactcacgctgctcgtgaccatggcgcagctgttctgcctgtacgccatcccttggttcgtcctcaaggcctttggcatcagggccgacttcgtggagtgccttgccgcgggctccatggtgcagatggtgtcgtccgccgtccccctccccggcgggaccggcggcgcagagggcggcttctacctgttctacggccacatgtttggcagcagcatcagcgcgggcttcctggtatggaggatcatcacgttctttggccccacgctcctggccgccccgctccttggcctgcgctccaactcgtcgcagagcatctactaccgcgtccagcggcttcgcaatcgcatggcgggcgcgttgccggggaagcgcggcaagagccaccgtggcatcacggtcagggtcaagggcaaggtgcccgcgtacaagcctaaggcaaagcccaagggcaagggcggcaacaaggactaggggagaggaggggcgagcggccgttaccgccgcccctcccgtcgggttccaccggctacaggcagcgcctgcaggccgtgcaggcggagggggccgccgcgaggccgcccagggccgtctcgcgcaggctcgcgggcagcgcctgaccgacctgcttcatggcggcgaccacctcgtcaaagggaagcgggtccagaacgcccgacagggcgagctgggacgagaccagcgcgttcgccacgccgatggcgttcctgtcctggcaggggtactccacgagtccccgcacggggtcgcacaccagccccagcaggttggcgatggccgtcgaggcggcggagaggcactgctccgggctcccgcccaacagctccgttacggcgctcgccgccatcgccgacgccgtcccgacctcggcctggcagccgccctccgcgcccgcgaccgaggcgtttcctgccacgatgagccccaccgcgcacgcgttccacagcgcctcgcacagggcgtcgtcgtccgcccccgcggactcgcccaccgacagcaccgccccggggatgacgcccgcggagcccgccgtcggcgccgcgacgatcacgcccatggtggcggagcgctccagggtcgccatcgcgtaggcgacggcgtgggagagagtctctcccatcaggcttgcgcccaggctccccgccgccgaccacaccgatgccgcctgtcccccgatgaggcccccgagcgagggctgcgggtcgtggatgggactggtcgcctcgtctcgcatcaccgagagcacgcgcgtcatctgggcgtcgacgtcctccccgtcgcacagctcgcgctcgcgcaggcgcgttacctcgccgatgccaaggccctcccggtcgcaggcggcaagcagctcggcgcccgtggagaaggacatgcgcagggtcgcgtcgggcgagacgcgcgaggcgccggggatggcgaccgagcaggcgccctggatgttgggggcatgcgagaggaactcgacgagcttgtggtcgatgggctcgtcgagctcgaacaccgtgtaggcgcgcccgccgcgagcctcgcggaaggtccgcatcgtggcgatgttggccgaggaggcggagatcccgctggtgagcgcggcgaggacgcccggcttgtcctggtgcgtcacgaacagcgtggggtagtcgcccgtaatctcaacgtggaccccgtcgatcgagacgattctcacgcgcccgccgcccagcgactctcccgcaacgctgaccctgcccgtctcgccctccatcgtcaccgccacggtgttggggtgcagggcggggtcgtctcccatctcctcgaacgagaactcaaggccgcgctcccgcgccaggtcaaaggagtcgcgcacgcgcgtgtcgtcgggggcaagccccaggatgcccgccacgagggcgcgatccgatccgtggccgcggtaggtgtggctgaacgagttgtagagggagaaggtcacgcgcctgaggtcgcggggcccgagggagcgcgccacgagcgcgattctcaacgcccccgcggtatgggaggacgaggggccgaccatgatggggccgagggtctcgaaggcggatgtctgcatgtgctctcctcgcatgtgacgtgggcttgtgttaccaacgtgtttccgacacacgatgatagccgtgacgggggagcgcttgtagcgtatcggcgaacgggcgagaggagagagaggcacccctccggggcgcggatggctccggaggggtgcctggcaacgtcggacggtgtctgcgggactacgccgtgaggctggcgtcgacgaggtgcgtgcggtcgccggcgtcgtagaacaggctctcgacgcggtcggacccaacgtggccgtgcgagtagtacatgatcgggatgatggggaggtccttgccgaccgtcttgttgatctcgcggtacttggccttgcgctcgtcgtcatccgacgtcgcgcgcgcctcctcgatcgccttgtcgacgtcggggtcgttgtagtacgagtagttgttgtcggcggtgctgtagtaggtggggtacacgtaggcgtcgagcgtggggtaggacgcggtccagcccaggcgcgcgatctggaagctgccgtcggagagcgacgagaggtacgcggcccactcctgggaggactgcttcaccttgaagccggcggcctccaggccgtcctggatgatgctcatgatgtcctcgtggccgccgcccgtgttgtagctcagcgagatctcggttccggagaggttgttgtcctctacgagcttcttcgccttgtcggcgtcgtaggtgcagtagtcccagctgttgtcgccgtcggggtcgaggacgggggagatgaggttgtcggccggcttgcgggctccctcaaacagggtgtcgcagatcttctggcggtcgatcgcgcacgagatggcctggcgggcggcgaggttcttgatgacgtcgtccttgaggttgcagatcaggtagtaggtggacatctcggagccggtcaggacctgcttgcccggggtgacggtgtagccgtcctcggaggtgcccttctcgccctcgatctccttgatgcggcccgtggggatctcggcgaagtcgaggttgcccgcctcgaactcgcggaaggcggtgtcgggatccttttggatggagaagttgatgccgtcgagcttggccttggcgccaaagaagccgtcgaacttcttcacgttgatgtactggtcggcgacccacttgccgtccatctggaaggggccgttgccgatgggggcaacgaggaagctgtcggggtcgtccttggccgcctggggcacggggaccaggcagggataggtgcagacggtgggccagtctgccatgggcgaggtgagcttcaccacgaaggtgttgtcgtcggggcaggtgaggccggagatctcggtcgccttgccggcctgcatgtccttggcgccctcaacggggtcaaggtagtagccgatctcgcccggcgtcgccatcgtggggtcgcacaggcgctcccagccgcgcttgaagctcttggcgtcaacggcgtcgccgttgtggaacttggcgccctccaccaggtggaaggtgtaggtgagcccgtcgtcggagacgtcccaggacgtcgccgcgttggggacgacctcgttcttgtcccagtcgtaggcacagagcgggctgaacagctggaagatgacgatgttgccgtcgacgtcctggccgttgtaggggtcgatcgcgacggggttgctgatgtaatacttcagcgtgccgccggtcgtctcggcaccgctgtcgctgtcgcttgcggaagaggagctcgtcttcttcccgcatgcggcgagcgtcgcgagcgcacccgcggcaagtcctcccttgatgaacgaacgcctggtaactccgtctgccatgtgatgcctccctgatggttccctttcgtggtcgcgtcccgtaccgccggggcgccgtgccggacccgcgatgcagtaaatataagtaacgtgtaagcgaactgatcgatgtattcatcacctggaaatagtcatgcgagaacatgcgtcacgatgcatccgggacgcttcggcggggcgagggtggacggcccgcccgacgacttggggggaagcttgatgagggttcttgtaacggggttccaaccgtttggcggcgaggacgacaacccgtcctgggaggtcgcgaggcgcctcccaaagagcgtcctgggcgccgaggtcgatcgtctcgaggttcccgtggtgtttggggaggggccgcgcctcgtgtgcgccgaggcggaccgccttggggcggatgcggtgctgtgccttgggcaggcgggcggccgtgccgggatcacggtcgagttcgtgggcatcaaccaggaggacgcctcgattccggacaacgcaggcaaccagcccgtcgcgtccctgatcgagccggtcgggcctgacgcccgcttcgcgacggtcccggtcaggcgcatggtcgcccgcatgcgggagggtggcgtccccgcatcggtctcgtacactgcggggacgtacgtgtgcaacgacatgctctacgaggtcctgggtcacctcggcacgggggagggccgggtgctgggaggcttcgtccacctcccctaccttccctcccaggtcatcggaaaggcgccctcaacgccctcgatgtcgctcgacgacatggtgcggggcgtgaccctgggcctcggggaggtcgtgcaagcggtcgagacacgctaaggacgctggtcgagacagtgcctcctggggaatgtcgggttggccgttggcacagcgtgtttgtgcagttggtgaccaattaggtctcgaaccacggctgaaccgctcttacgggaatgcgcgcgacgcccctcgaaaagagcgtgtgtcctaggcatccagctcgctggattcccagccacgacgattatgtcaggacatcaatggtcaaagaatgacgtgggtcgtgcctcgcttggaccagctggcccatctgtggggaaccaggtcgtcgcgactcccgtacgccgctctcgctggggagaaatacggcgccgcgggtcaggccattgctatccccacggggtcgtccgatggcaaagaacttccgaagtgagtgcacacatcgggaggcagctgccatcctgcctcggaaagggccacgtatttccagctgggtcccgccggcttcgtggcccatggcagcgatagccggatttgagtgctcactccgggagcttgctgccatccggacccgatgcctggagcatttggcaatgaactcccgacatgagtgctcacgtcgggagtttgccgccatgggcttcgaggcaggcggtcttcgggggtctcccaactgggcaaacggtcaatcgtccctgattctggaatctgcctcctcacggaaggtgctcacatcggtctttggctaccattggggttccgtggagtgtgaccggggggcagaacgctcgcgcgcgtgccctcatgcgtctgggaccgcccttgaagatgaagcgagccgctggcggaaggctcaaagcgccccaggggagagaagacgcgggtgttgcttagagatcccggagctcgtgcggggtatcaccgacgcgtgcttaaggaatcagatggatgcacggatttggcggcgtctaacacgccctcgccccgtggaggttaagtgcctgacatcgaaatccgcccgggcgccggcggggctaagcagtggatgcctgccaggcatgcgcgcgccgggatggctaagcatgccgttctgaatccgcgcgggtgggggcgcgatgcttaatcttcctagctccgtgctgattgtggggcgggatgcttagcattgctcggactcttgcgggtttttgggtccaatgcttagtcgtgctagccctcgtgcgggtagggaggcggaaatcgcgcatgagggctaggggtgttaagcaggctggggcccaatccgcatgggggctagggcgggtaagcacgtcgtggcagtaacccgcacatgcgccgaattgtcgcgcctggtcccaccgcccgtcgtatgtcagagccaagcggggcacctcctcgcgcggaggacgcagcgcccctctccccagatccctccacaagaaagccggggcgccccacccgctggggacgccccggcacatgacgaccgtatgcctcgacgagaggcccgcccgccgcctatccctccgcgggaaccgcgagcggggccgccgccctcagacgcgcgagggtcgtctgcttgcccaggagctggagcgactcgcccaggggaggcgagacctggttgccacactccgccacgcgcacggcgccgtagaacttgcgcttgttgatgcccagcccctcggggagagggtcgagggcggcgttgatcgagtcggcatcccattggtcctcgcccagggcggagagcgcgtcggtcgctgcgtcgagcgcacccgccgcgtagtccttggcgaggctcttcttcacggacttctcgtcaaaggtcacggagtcgccctcatacaggaagcgggccttgtccacgacctcgcgcgcgaaggtgacgcgcggcttgaggatggagctcaggaggtcgaaccactggggcctgcgctcgtaggcggcgtcggcgggaccctcctcgaggccggcggagacgagctcggggacgagcatggtccgggagaagtccgcgtcggtcatggccttgacgtactcgccctggatccagtcgagcttcttgaagtcgaaggtcgcggggttcttgctcacgtggtcgagcgagaagcggcttgccaggacgtcgcgcgggatgatcgtggtatcgccatcgagcgcccagcccaggagcgcgaggtagttgacgaaggcgtccgggaggtagccctggtcgcggtactcctccacgctcgtggcgccatggcgcttgctcagcttcttgccgtcgggcccaaggatcatcgagatgtgcgcgaaggtgggcacgggcgcgcccatggcctcgtacaccatgatctggcgcggggtgttggagaggtggtcgtctccgcggatcacgtgcgtgatgcccatcagggcgtcgtccaccacggtggcgaagttgtaggtgggggtgccgtcggagcggaagatgatgaagtcgtccagctccttggcgtcaaaggtcacgtcaccgtgcaccgcgtcgtgcaccaccacgtcgccgcggtccagggggaccttgatgcggagcgtgtagggctcgcccgcggcgatgcgcgccttggcctcctcggggtcgatgtcgcggcacgtgcgctggtagccctggaaggggtcgttcctctcctgcgccgccctcttgtcggctgcgagcttctcgggggtgcagaagcaggggtaggcgcgtccctcgtcccacaggcgctgtgcgaccttgcggtacacgtccatgcggtcggtctggcggtacggtccgtaggcgccgcccacgtcggggccctcgtcccagtcgagcccgagccacctcatcgcacggaggatcacctgcgtgttctcctccgtggagcgcgtggggtcggtgtcgtcgatgcgcaggatgaacgtgccgtggttggcacgcgcgaacgcccagttgtagattgcggtcctcgcgccgcccacgtggagcttgcctgtgggggagggcgcgaagcgtacgcgcacgggtctgctgtcagtcaaagccatgtctccttgtccctcggtgcgccttgttccgcaccgcttgcaaacaaccagaagagtatagactccctcgccatcctgagcccgcctacatgagcttggtggactccagcttctcctcgatccagtggttcaggcgcacgaccggcttcctgaggagcaggcccagcagcagggcgggcaggaggaagcaggcgagcttggccatctcgatggcgtagtcgttgccgtagatgccaaacatcgccgcgcgcatggcgttctcggagtgcacgaacggcagccaggggtacacggcctggaaggcgtcggggagcatctgcatggggaaggtgccgcccgagcccgccacctggatcaccatcagcacgaccgcgatggccttgcccacgtcgccaaacgagtaggtgagggcatagatgacgttgatgaacacggtcgaggcgagcgtccccgtgagcaggaacaggatggggtgctggcactggatccccaggaagtagaggtccccgagaagggccacgagcgtctgcatgaagccgatggccaggaagaacaccagccgcccgaagtagccgtggcgaggcttggcgcccgtctcccgcatggcgcgctcggagggctcgcacctcacgagggcagcgaggacgactccgcccacccagaggcagagcgttgtgtagaagggcgccatggcggagccgttgttctcgaccgggaagaccgcggtgcggtcgacctgcacgggtgaagagatgaacgccgcgagtgcggaggggtcggcggagaggatcgcgcgcagcgtgtcgaggtcgcccgacgccagggcggcagagatcctcgccctgaggtcgtcgagcttgtcggcaccctccctgagctttgcggaggcggagtcgagcgagtcctgtgccccctggaggttcttgtcggcgctggaggtcgcggcggagaggcttgacacggcatccttgagctcgcccgagacctggtcggcggtcgctgcggcgtcgtcgatggaggaggcgagcgtgccgagcgaccccttgaggtcgccctcgtagctgtcactcaccttggagaccgcggacttgccgtctgccgccagggccttgagcttggtgcgggcctcctcggcgtcgcccttgtacgtggagaggtcgttcctggtctgctggatggagtccgagagtgcctggagcctctggatggcgtcctccacgtccgacttgaggccgtcaatctgcaggatgtactcgtcggtgcgctcgtaggcgaccgaccccgcctcctgccggtcgtgcagggtcctgatgatctggtcctggctgttgatctggtcgtccagcgcctggagctcggcgcgcttgccgtccacgacgtccttgacctgtcccagccggtccgagagcgcgtcgctcttggaccccgccgtgtcgaaggcgtcgtcgagcgccgactccacgtcgtcaaagcttgaggaggacttctggagcgcagagttgaccgcgtcggtggcgccgttgatgccgctgtcgaggtcgcggaccccggaggcggtctgcctcagcgtgccgcccgcgtcgaggacgttctgcagggactggtcggcaacccccgtcgcgctcgacgagatggagcgcatggaccccacgagggaggagtaggtgtcgagcgtagaggcggcgtcgcgcatcgagccggagctcttctccgccgcctcgcccagcttcgaggcgagtgcctggaactccgcgtcgttgaggtagtccccaaactgcgacagcgtcgccgcacccacctcggtcacggtggcggagaaggtctcgtcgatcgtctccttcaccgcggtcgacgccttgctggtgacgatcgaggcgatggcgttgcgcttggcgttgttgtagtagatgacctcgggcttttttgaatcgtccgtgaggacggtgagcatcttcctgctgaagtccttggggatcacgatcgcggcgtagtacttgccgctcttgacaccctcgacggcgtcctcctcgtcggtgacgacgtagccaaccttctcgctcgcgctgagctcggtgaccgttcgctctccgatgttgatctggacgggaaggaggctgctcttgtagccctcgtcgctgttggcgagcgccaccttgaggttggcggtgttcccgtaggggtcccagctgccggcgatgttgaaccaggcgtagaacgaggggatgaccaccatgccgatgcacacaacgagggcgatgacgttgtgggtgacgtggtcaaagtcgcgcctggcgatcctgaggaagggtcccatgctactcaccgcccctctcgtcgcggtcgtccgtctgggtcgctccgcccgtcgtaccgctggcggcgtcccctccatcgttcggtcggggcatggggatggtcctcccgtcgccgtcatccggtgtcgacccgtcgggacgtgcgccaccgcggctcctgcggatgcggtcctcgccgtgccactcgcccgcagccctcgcgcgcctcctgaggtcgatcgcgcgcttgaggtgcgcgcggccggccctcagatcagtcagggtgccaagggggccggagggcgtggcgccgtcctcgctgcggtagtccaggaccatcttctcgatgggggcgaacgcgaagaactcgcccctcagggactcgtcgagcatgccgtagagctcctccctcgacatgtcggcgagcgaggtcttctcgaccacgcggtagtggaagtactccaccacgatcaggaaggtgcagatggcgacgagggagacgatccacagcaccaggaaggtcatctttgcgtcgagcaggaacagcatcagcagcaggatgcccgacaccacgaacagcgagaggatgccgcgcttcacgagcagcgggtacatgagctcgaagtgggcggtcctctcctggaagatgcgcttgtagtccttggagtccatgagcgccttcacgatggtcgtgagcttgaagtgcgcctcgtccatccccacgcgctcgccgatcatgaggtcggtctgcgtgagcctcttgtcgaagagcgagttaatgttgagcaggtgcctgcgcgcgccgagcccgatgagcagggcggggatcacgaacaccaggagcctgaggatgttgagggcgtagtatccgtcgtagagcccgccgatcgtctccctcatggcgtcgatgccgtaggtgaagggcagccaggggtacagggcctggaagaagtcgggcatcatctggatggggtaggtgccgctggagccggggatctgcacgatgatgagcacgacggcgatggccttgccaatgtgcttgaaggcgatcgagagcgcgtacacgatgttgacgtacacgaacgactccactagccccgcgatcacgaagagtgcgggggagacgcactgtatccccagcgccaggtcacccacgcagcagatgagggcctgcacctggccgagcgcgttgagcaggagccagcggcccaggtagccctgccagggcttgaactcgccgatgccctcgtcgtcgacctcgagcttgtagatcgccaccaggacgaagcctcccacccagagggccaggttggtgtagaagggtgtcacgcccgagccgtagttgctcaccgagaacacgtcgcgctcggtgagcgtggcgggcgacgacatgaagtcggagaccttgtcggcgctcacgtcactcacgttctggagctgctgccatgcggcggcgccccggattgccccgacgtccgtggcgaggtctcccagggtgtcgtttgcctggtcaacgaccgacttggtctgcgccagggcgtcgtctgccttgtcgagtgccgcgtcgagctgcgcgagcgtgccgtccgcctgcgagatcaggggggagaggcccgcagtggtcccggcgagcgagtaccccacctgggagaaggtgtccagggcggaggagagcttgggcatggtcgacccggagagctcgctgctgacgtcgttgagggactggctggaggtcgagacggacccgttgagcctctgtgccagcgacgccacgtcctgggtgtcgctcgccgcggcgtcggacatcgcctggagctggtcgaggcgctgctccaggtcctgcgagatgcctccgagcacggtgatctgcgtcccgatgctggaggtcgcctggtcgcggaggctgatgctctcggcatcggtgagctgcagcgtcaggagcgagtcgcggacgtgggtgagcgtggcgctgtagctcctggtctgggccaggtagctcttgagggaggcgatgtcgccgtcgagcgtgcccgaggctccgctcacgcgcccggagaaggtccccaggtcgctgctggcctgcgacgagagcgagccgagggtcgacgtccccgaggtgagccctgagctcagctgcgagtagaggtcgctcgccttcttcctgacgcccgagagcgagtcgagggagtcggagaggccctgacccgcgctcgcgctcttggtcgagaggtccgagagggtcgttcgggtggtgcccacgatgccgcgcgcgtcggacacggaccccgaggcgtccgagagctcctgcgagagctgggcgagaagctcctgggcaccctggatgtccgagagcgccgatgcggacgcgtcgccgccgtcctgcaggacgcccgacgccgtgaccttgagcttgtccgtcaccacgcccgccacggtcttgaggaaggtgctgttgatctggctctcgagcgtggaggcacccgtgtcggtgaccttgggcgagacggcgttgaccttctcgttgacgtagtaggtgatgtgccccttgtccacgttgccctggagcacgtccgagagggacgaggtgaagtcgctgggaatcacgaaggtggcgtagtacttgccctccctcacgccctccataccctcggactcgtcgacgaacgtccagtccagctgggtgttcttcttgagctcctccacgatcatgtcgccggcgttgacggcgcccatgccctcgacttgagcgccctggtcctcgttgaccaccgccacggccatgccgctggtgttcttgtaggggtcccagttggcctcgatgttgaaccaggcgtacagggaggggatgatgcagacgcccagcgtcacgatgatggcgacggggtttctgaggagcctcttgaggtcccttttgaaaatggagaagactttgcgcacctgtgctcctttggtggtacaggtcagattgtttccgcagataaacgggagccaattttacctgattcaaaaaagtgcgattcgatttgaaaaaagcccacatttttgaactagtatgtgccatgtttcgcaaattgcgcgcgaggcagacaatttgcctcgtgtggtttcccggggagtcgtccgtgccaatcatcaacgagagcaccgcaaccgaagtcgcgaacgccgcgcgcgccatgcgcaacgtggcgaaggacgttgccgtcgagcaggtcaagaagcgcaagacccgcctgaggtcctcgtccaagacgcgaaagagcgttgccaccagggagaggatcatgaccgcgacgagcgagctcatggtcgagcgcggcaacaccgacttccagatgagtgaggtctcggcccgctgccacatgtcgaagggcgcactctattactacttcgccgacaaggacgagctgatccaggcgatcttcgcctcgtcgagcgaggacctggttgccgcgatcgagcgcgcggtgtccgaggcgcccacggcgcgagaggcccttgcaaacgtggggaccgagctggtcaggcgcctgggcggcgggagtcccctctcgctcgccctcgccagggaggtgggcgtgagcaagggctcggtcctgcccgtggtgagcgacaacttcgcgcggaccatccgcatcatcgccgcccagctcgagcgcgcgaagaccgagggcgtggtgcgcccggacgtggacagccagctcgccgccatgttcatggcgggtggtttcatggtctcgtccctcgcggcggtgccctcgcaggacgcgcgcacggactgcagcgccttcgcccatgccctgatggacctctcgatcaggggcgtcggggtgggggagacttgcactgccgactccgagggctagccttcaacgtacaggtcaaaagaaaagcatgcgtgcaacggggcattccccaatccttgtgacctgcattcaaaatcgttgtttacatgcgggagacaaaggaatagggtattccttgctcgtcaagaggcgttccagcgacgcaaagggcggagggaccgagcccagtgaagccccggcaaccagcagcgatgcatggtgccaattctcggcaggccgcaaggcctggaagacgggggagctagagtgcagtcacgaaggtccccttaggcagggggctttttttatcccccggtaacgtggcgctcagcgccgggaaggtacgtgcaacatggcacacaagaactacctcttcacctccgagtcggtgacggaggggcatcccgacaagatgtgcgaccagatctctgatgcgattctcgacgccatcctctccaaggaagcggcgctccagagggagggctacgtcggccctgacggcatggcggccaacgtcgacaacgttcgcactgcaatcgagacctttaccaccacgggtaccgtcgtggtcatgggcgaggtccgcaccgaggcgtacgtggacgtgcagcagatcgtccgcgacacggtcgcgaagatcggctacacccgcgcaaagtacggctttgacgccgagacctgcggcgtcatgaacctgatccacggtcagtcgcccgacatcgcccagggcgtcgatggcaccttcgcgcgcgcaaacgacgaggacgaggtcgacaagatcggcgccggcgaccagggcatgatgtttggctacgcctctgacgagacggacgtcctcatgcccatgcccatctacctcgcgcagcgcctcgcccttaggctcgccgaggtccgcaagctcgggacccttgcctacctgcgtccggacggcaagacccaggtgacggtccgctacgaggacgacaagccggttgaggtcaccgccatcgtcgtctcgacccagcacgccgaggacgtggagctctccaagatccgcgaggacgtcatcaaccaggtcattcgccccgtgctcgacgaggtgggcatcaagtgggacgacgccaccatctacgtcaaccccaccggccgcttcgtggtgggtggccccatgggcgacaccggcctcaccggccgcaagatcatcgtcgacacctacggcggcatgggccgtcacggcggcggcgcgttctcgggcaaggaccccaccaaggtcgaccgctccgcagcgtatgccgcgcgctgggtcgccaagaacgtggtcgcggctggcctggcacacaagtgcgaggtcgagcttgcctacgccatcggcgtcaccaagcccctgtccgtcatgatcgacacctttgacacctccacggtggacgaggaggtcatcaccaaggcggtcgagagggtcttcgacctccgccccggcgccatcatccgtgacctcaggctccgtcgccccatctacgagaagacggccgcctacggccacttcggtcgcaaggacccggagttcacgtgggagcgcaccgaccgcgtcgacgagctgaaggccgccgtcgcggagctctcccgctagcgtgaccgcggagtgcgtgcgttgccccctcgccgtggctgacgtataatcgctactccgttcggggcgtggcgcagcttggtagcgcatctgctttgggagcagagggtcgctggttcgaatccagtcgccccgaccagaggaatcgaggccacccatgtcaagtgggtggccttttcatgtgcaggggtcctcggttgccgtacctgccccggcctctagcaggtgtcatgccatgtcgtccgtcgcgctcgtgccaacgacacggccatgggacgggtgagtctggctgctggctcaggttggattgcgcaaggttggtggtcacgcgcaagatcctatggccggtgaagaatgtgtgtatcctcgccggggtcgcccggcgctcggcgcatcctaggtacgcttacaaagcttcgtgacgggagcgactctccgtcgcgtttgccgccgacggcgtcggcgcacatactgcgggcgtagtccaatggtagggcctcagccttccaagctgaagacgcgggttcgattcccgtcacccgctccaggtatgcaggggagaggtgcttgtgcacctctccttttttcatctcacctggctccttgaatgggtttggctgcggcgtgcctgggaacccgagcgcccgcgcgggttatgaatcggctgggcgaggaatgcttaggaatcccggggcgaggacgggccgcgggcggtgcgcgcttaggaatcccggggcccgcacgggtttcgggggtcccgaacggttcgagccccggcaaggctaagcatctggtgtcgaagcccgtgctagccccggcagggctaagcacccgatgcgccaggcccgtgcgagcaccgacggaactaagcacccaatgcacgcgacccgtgcgggtcccgtcgcggctaagcaggtggggctctagagtattttggggtagctgaatacactacttcggtgtgcggcaataaaagaatggcaagcggtacctatcagaatttgtgtatttcggtatgagaaacaaaccaaagcgcgggcctcttctggcgtattaatttgttggcaatatcccatggtgtggcgcgtgttcggaccgataggcgggaaggcgccgcatgcgagaggagcatccatgaactattccgagcgtgtgatcgcggagctggaggcgcgctatgccgaccagccggagttcatccaggcggcgagcgaggttctctccacgctgcagcccgcgctggacgcccatcccgagtacgaggctgccggcctcctcgaacgcctggtcgagcccgagcgcgtcgtgatgttccgcgtcccgtgggtggacgaccagggcaaggtgcaggtcaaccgcggctaccgcgtcgagttcaactccgccatcgggccctacaagggagggctgcgcctgcaccccagcgtcaacctctcgatcctcaagttcctgggcttcgagcaggtcttcaagaactccctcaccacactcccgatgggcggcggcaagggcggctccgactttgaccccaagggcaagtccgacatggaggtcatgcgcttctgccagtcgttcatgaccgagctctaccgccacatcggccccgacaccgacgtccccgctggtgacatcgggacgggcgcgcgcgagatcggctacctctttggccagtacaagcgcctcaccaacacctggtcgtccgtcctcaccggaaagggcctctcgtacggcggctcgctggcgcgcaccgaggccacgggctacggcgcggtctacttcctcctcaacatgctcgcggacaggggagaggacatcaggggcaaggtcgtcaccgtctcgggctccggcaacgtcgcccagtacgcggtccagaaggccgagcagctgggggccaacgtcgtcaccgtctcagactcctcgggctacgtctatgaccccgacggcattgacttcgacaccctcgtggaggtcaagcaggtcatgcgcggcagggtgagcgactacgccaagaggcgccccaacgccgtctaccacgaggggcagaggccctggggcgagaggtgcgacatcgccatgccctgcgccacccagaacgagcttcacctctccgatgccaaggcgctcgcctcgaacggctgccgctacgtggtggagggcgccaacatgcccaccaccctcgaggcgaccaagtacctcaaggacaacgacgtgttctttgcacccggcaaggcggccaacgccggcggcgtcgccacctccggcctggagatgagccagaaccacgagcacctgtcctggacgttcgaggaggtcgacgacaagctccactcgatcatggactcgatctacgcctccgccgccttcgccgcccgcgagtacggccacgagggcgacctcgtgttcggcgccaacatcgccggcttcctcaaggtcgccgacgccatgatggcccagggcgtctgctagcatccggccttgagaccggcggggcgggtcgtgcatgcgcgcggcccgtcccgctttgcgccgcgtggggaaacctccatgccacccacacgaaaatccgtgcctcacgtgggttttcccgatgcgtttgctatcatgtcaaggctgtatgtgcacttgcgggcgtggcggaactggtagacgcgctggatttaggttccagtgggagagatcccgtgaaggttcaaatcctttcgcccgcaccacatgcccatgcctcgacagcatgagaagggaactacgcaaggcagcggggcgctcgtctcgctggcaagcaagagacactggaggaacgttgaacatcaccgttaccgctgagaagccccagagcgaccaggtggtcgcaaaggtcaccgtccccgccgcagacgtcgacaaggcaatcgcccagacgtacaaggacatcgctcgcaagtacgccttccagggcttccgccgcgggcacgcgccccgtcccgtgatcgatggcctcgtcggccgcaaggcagtcctcgcccaggcaacgagtgacgtcatcaacgacctcacgcccctcatgatcgaggagctcgacatcgtccccgtcgaccgcccggactttggcgaggaggcggtgaccgtggtcgagggccaggacttcaccatcgaggcaaaggtcagcgtgccccccacctgcgagctggacagctatgacgcccccgcgatcaacatgcccccccagaccgcgaccgaggccgagatcgaccagcagctcgagcagctcatgagctaccataccacctacgaggacgacgacgaggaccgtgccgtcaaggccggcgacatcgtggtcatggacgtcgagaacaaggagggcgcgcccgagctcgagggcaccgaccgcaccctcaacctcagcaacggctacctccccaaggagttcgtcgagggcgtcgagggcatgaagaagggcgagaccaaggacatctcctggttcgtcgagcacgagggccacgagcacaagttcgaggtcgtcgcaacgctcaagggcctcaagaaggccgtcgtccccgagctcgacgacgagttcgcgaagaagaactttggctttgacaccgtcgccgagctccgtgacgccgtcaaggacgagatcgaggaggacaagaagaccagcctcccgaccctcaaggaggaccgcgtcgtcgaggagatcggcaagcacctcacgctcgacgagatccccgaggcctaccagaaccaggtgttctccgagctcggcaacgaggtcctctcgcagcttcagcgccagaacatctcgcttgacatgtacctgcacgcccgcggcatcagcggcgacgacttcatgaaggacctccacgagcaggccgaggagcgcgcccgccagtccctggcgctcgacgccctcgccgacaagctctccctcgaggccaccgaggaggacgtgcgctccgagttcgagaaggccggcgtcaaggacctcgactcctcgctcgaggagttcaaggccaacggccagatgcccgccatccgcgagtccatccgccgcacgaaggccgtgagctggctcgtcgagaacgcgcccgtcaccgaggtcgacgaggtcgccgaggcccgcgccaagaaggccgaggaggccgatggcgagtccgaggagaagggcgacgccgagtagtcggctcccccgcttaggactattgagtgcgctccgggggtaccaactctcggagcgcattcgattagataggagaacgcatggtaaaccccaccaacatcccgctcatcccgtacgtggtcgagcagaccccgcgcggcgagcgcagctacgacatctactcgcgccttcttaacgaccgcatcgtgttcctgggcgaggagatcacccgcgagtccgccaacctcgtgatcgcgcagctgctgcacctcgagagccaggatcccgacaaggacatctcgctctacatcgactcccctggcggcgaggtctatgccggcctcggcatcctcgacaccatgaacttcatcaagcccgacgtctcgaccatctgcgtgggcatggcggcgtccatggcgtcggtgctcctggccgcgggcgccaagggcaagaggctcgcgctccccaactccatgatcctcatccaccagcccagctccggcgcgcagggccagcagaccgacatccagatcgtggccgacgagaccaagtggatccgcaaccacatgaacgagctgctttcgcagtacactggtcagccggtcgagaagatcaacgccgacaccgagcgcgacaactacatgcgcgccgaggaggccagggagtacgggctggtcgacaaggtcatcacctctcgcaccgagcagaccgactaggcccaaggagaggctgaatgacgaccatggacaacaccaacatgccagagatgcgctgctccttctgcggtaagacccgcagccaggttcgcaagctcgtccaggggccaaacggcgtgttcatctgcgacgagtgcgtcgcggagtgcgccgacatcatggccgagggcgagcccggcccgctgggcgaagaggaccttgccgcggagcttcccattcacgacctccccacgccccaccagatctacgacgagctgtcccagtacgtcatggggcaggaagaggccaagcgcgccatgagcgtcgcggtgtacaaccactaccgccgcatcctggcgggagaggacgcccctcaggacaaggacgaggagaaggtcgagctcgccaagagcaacatcctcctcctggggcccaccggcacgggcaagaccctgctcgcgcagaccctcgcgcgcttcctcgaggtgccgtttgccatcgcggacgccaccaccctcaccgaggcgggctacgtgggcgaggacgtggagaacatcctgctcaagctcatcaccgcggccgacggcgacgtccagcgcgcccaggttggcatcgtctacatcgacgagatcgacaagatcgcgcgcaaggcggagaacctctccatcacgcgtgacgtgtcgggcgagggcgttcagcaggcgctcctcaagatccttgagggcaccgacgcctctgttcccccgcagggcggccgcaaacacccgcagcaggagctcatccacatcaacaccaacaacatcctcttcatctgcggaggagccttcgtgggtctcgacaagatcgtcgcggaccgcatcggcaagaagggcatcggcttcaacgccgagctcggcaagaaggtcgaggagaacgaggacgagctgatggcccaggtcatgcctcaggacctccacaagtttggcatgatccccgagttcatcgggcgcatccccgtgatcacctccacgcacgagctgaccgaggacgacctggtcgagatcctgaccaagccgcgcaacgccatcgtcaagcagtacaggcgcatgttcgagctcgagggcgtgagcctggagtttgagcccgacgccctgcgcgaggtcgcgcgtcaggccatcgcgcgtggaacgggtgcccgagggctccgcgccatctgcgaggcgaccctggaggagaccatgttcgacctcccgagcgacctcgacatcacggacgtggtggtgaccaaggagtccgtgggaggctccgtcccgccgcggctggttcgcaagggcgcggggaagcaccgcgccagctagggcaaggccaacgattcaggcgagaggggcgtgcgaggccgtttggccgggcgcacgcccctctcgtcatccgatgggggagaggagctctcgggagttgtgccccacggccccggtgacgtcggtgcccctgatgagcgagagctcctcgagcgttcggcggatctccccatccacctcgacggccgagagggccgtctggtcctcggcggggaggtccgtctcggtgaggagcctcttcaggggaagctggcgcgcgtactcgcgcccccgcctggtgcggagcatcgggagcccgacgctgaaccaacagccggcgagcaccgcccggtggagctcgtccgaggtccccgagaaccagtggaaaacgcaacggcaccgttcgagcgcacccgtctgccccagcacgtccaggcactcgccggcggagcgcaccgagtggaccgagagcaccgtgggcgccatggggtcgctccccgccgcagcggccgagcacacccgctcgaacgcggagcgctggacgtcgtgggagcccccggggacgtggtggggcgagaggtccattcccacctccccgacccaacgcgtggtgcgtgcgagctcggcggcgcgggcgacgtcggcgtccccgcatcgcccgtccgcgacccaccaggggtggagcccagccgccagccgcacgttcccctcgccccccaggagtgggagcgccctctcgtagcctgctggcgtaaccgtcgtcgcgagcatccagagcccgagggcgcccgcgtccctcgcgacccggcgcgggtcccgcatgaggtccaggtgcacgtgggcgtcgagcctcatggctgcctcccgcggcggcgctcctcgccgacgggctcctgtacgtcgagctcgttgtggagccccgcgatgtcgcagatcacccgtcccgcgatcatctgccccatgatgggtggcatgtagctcatggttcccagcgtcacggccttctcgggacgcccgccgcccgccggcagctcgttgccgcgtggcgtcacgggaagcgggacctcgctggagtacaggaccctgaggcccttgatcccgcgcttgcggcactccttcctgatgaccttgcacagggggtcgctcttggtgcgctcgatggtcgaaaagcgcaggcgctcggggttgagcttgttcgcgccgcccatcgaggcgatctcggggatcccctcgtcctggcaccattgcgcaaccaggagcttctggctcacggtgtcgatcgcgtccaccacgtagtcggggtgggggagggacgagagggtctgcgcgaggttctccttcgagaggaaccgatggcagagcgtcacgtcgcaatcgggattgatgtcggccacgaggcgccccatgacctcggtcttgggtaggcccaccgtgctgtggaaggcgaccgcctgccggttgatgttgcttggggcgaccacgtcgcggtccacgagcacgaggctgccgatgccgccccgtgcgagcgcctcggcgcagtttgaccccacgccgcccagaccgagcaccatgacgcgggctccctgcacgcggcgcagtgcctcgtctcccatgaccaggcgcagcctgtccgttgccgtctcgtccgtcgccatggcgcccatgcccccagtctcgcgtggaaccgtctcgtccgctccatggtattccatcggagggcggggtcggctcttccgccgtgctatgctcgtgtgctgtcatgcacacgagcccgtggcggtgcgcgctcaagacacgagtgccaacgctggccaccagggcgcaacagaaggtgggacaatggaagagatgcccaagacctacgacccccaggagagcgagccagagctcatccagaagtggatggatgccggctgctaccagcgcagcaagggggtgggtgactgcaccgtggtgattcctccccccaacgtgacgggcatcctgcacatggggcacgccatggacgacaccatccaggacacctacatccgctacaaccgcatgcgcggccgctccacgcgttggatcctggggaccgaccacgccggcatcgccacccagaccaaggtcgacaagaagctcaagagtgagggcatctctcgccttcagatggggcgcgagaagttcattgacgcgtgctgggactggacgcacgagtacggcggcaccatcgtgagccagatcaagcgcatggggtgctccatcgacttcgacgacgagaagttcaccatgagccccgagtacgccaaggccgtgcgcaaggttttctgcgactggtaccacgacggcctgatctatcgcggcaagcgcatcgtcaactggtgcccctcgtgcaagaccgccatctcggacgacgaggccgagtacaaggacgagaaggggcacctctggttcctgcgctacccgctgaccgagcccgtcgacggcatcgagtacatcaccgtggcgaccacccgccccgagaccatgctgggcgacacgggcgtcgccgtctcgccccaggaccccgacaagcagcgcttcgtgggcaagacggtcatgctcccgatcgtggaccgcgagatccccatcttctccgactggcatgtggacgcaaagtttggcaccggcttcgtgaaggtcacccccgcacacgaccccaacgactatgcgatgggccaggctcacgacctgccgcagatcaacatcttcgacgagaccgcccacgtggtggacggctacggcgagtactcgggcatgtcgcgcgacgagtgccgcaccgccgtggtcgactggtttgaggagcacggcctcctcgaccacatcgaggacctggaccactcggtcatgcattgctaccggtgcggcaccgcccttgagccatggctctcggagcagtggttcgtcgcggtcgacaagctcaaggagcgcgccaccaaggtcgtcaccgacggcgaggtcacgttccaccccgcacgctggacccagacctacctcacctggatggagaacctcaaggactggtgcatcagccgccagctgtggtggggtcaccgcatcccggtgttctactgcgaggactgcggctgggaggacgccctcatggaggacccctccgagtgccccaggtgccacggccatcacgtgcaccaggacgaggacgtcctcgacacgtggttctcgtcgcagctgtggaccttcgcgacgcagggctggccagaccaccccgagcagatggaggggcaccatcccaccaaggtcctcgtgaccgctcgcgacatcatcgccctgtgggtcgcccgcatgatcatgagctccctctacttcaccgacgaggtgccgttccgcgacgtgtacatctacgcgaccatcctcgccaaggacggaagccgcatgagcaagtccaagggcaacggcgtgaaccccatggacctcatcgacaagtacggcgccgacgccatgcgcttcaacctgctgaccctcatcacaaccaaccaggacgtcaagtttgacgccaacatcaaccgcaagaccaaggagctcctgggaagcccgcgcaccgagcaggcccgcggcttcgtgaccaagatctggaacgcgagccgcttcgtccagatgaacctggaaggctacgtcccaggcgatcccaaggcggagacgcccgaggacgcgtggatgctctcccgtctcgccaaggtcgtcgccagctccacgcaggcgctcgagtcctatgactttggcgagtacgcgcgcagcatccagtcgttcttctggaacgaggtctgcgactggtacatcgagctctgcaaggggcgcctgctcgacggaacccccgaggagcgcctgcaggtccagcgcaacctggtgttcgtcctcgacacctcgctcaggctcatgcaccccgtgatgccgttcgtcaccgagcgcatctgggacagcctccccgccagcggcctggacgaccactccgcgcagttcctgatggtcgcggagtggcccgagcccgagcgattcgccggcttcgtcaacgagcgcgccgagcacgagttcgagcttgccaagcgcctggtctcggttgtccgctccacccgcgcgcgctatcgcctctcgcccaaggcaagcctggacgtcgcggttcgctgctccgaggaggactgccagacgctcgaggcccagcgcgacttcatctgccgcgtgggtcgtgttgaccagctcgccctgggggcgcaccaggacaagcccgcagggtcggtgagcgtggtcgacggtggcctggaggtgttcgtggtcgtgggtggcctggtcgacctcgacgccgaggcaaggcgcctgcagaaggagctcgccaaggccgagaaggacctcgcctccgtcacccgcaccctctccaacgagggcttcgtggcaaaggcggcccccgaggtcatcgagaagaagcgcgcccagaagtccgagctcgagaccaccatcgagcagctcaggtcgcaggcgagtgacctggcgtagaaaaaccgcatgtgatggggcctcgtccttggggacggggccctttctctgctggtgatacgttacgttcggctaatattggcattacacattcaaaacaagtccgctgcgaggcaggggagagctgcgcgcgagcgtgcgagagggaagacccaatgagtcgagtacgccacagggaggcagtcttctacgactacttcagacagtccacgaagatcatcgtgcaggccgcggagctgtttgaccgcatcgtgggggagtggcccgcgtcgaagcccctcatcccccagatgaaggagctcgagaccaggcacgacgagctcaccggcagcgtcatcgacgagctcaaccggtccttcatcaccccgttcgaccgcggtgacatctactcgctcatctcgctcctcgacggcatcgtggacggcctggagggggtctccgcccgcttcgacatctatggcgtgaacgagatggtccagtccacccgccagatgtccagcctcatcctgcagtgcgcgcacgagctcgacacgctgttcgagcacttcgagaacttcaagcgcgacggggtggtcctggagaaggtcaagcgcgtgagcgaactggaggacgagggcgacctggtgtaccgccgcgccctgggcgaggtgttctcctcgtccgccgaccccgtccacgtgctgaagtggaagagcctgctcgacaagacggaggacgcgctcgacaactgcaagcacgtcaccaacgtcgtccacagcgtggtcatgaagaatgcttagcggcccgctcatcgccgtgctcgtcgcagcgttcgccttcgagttcatcaacggcttccacgacaccgccaacgccatcgccaccacggtctacaccagggcgcttcccccacgcgtcgccgtggtctgctcggcgctcatgaacttcctcggggcgctcacgagcgacaaggtcgccatgaccatcgcgaccgggctcgtggacgtgcagctggggctgcacgtgatcctcgccgccctcctgggcgccatcctctgggacctcttcacctggtggctctccatcccctcgagttcgagccacgccctcatcggcagcctggtgggcgccaccatggtctacacgggcgggccccaggacatcaagtgggacggcgtcctggacaaggtcgtcatccccctgttcacctccccgctcatcggctttgccctgggcttctgcctcatgcacgtggtgttcgagctcttcgcaaactggacctcgcaccacgccaacgcgttcttccacaaggcgcagatcgcctcgtccatgttcatggcgtacagccacggcaacaacgacgcccagaagacgatgggcatcatcaccatcgctctcatctcggcgaacctgcttcccgcggggtccgacgtcccgctgtgggtcaaggtcttctgcgccgcgaccatggcgacggggaccatgatcggcgggcagcgcatcatgaagaccgtcggccagggcgtcaccaagctggagcccgtggtgggctttgtctgcgagacgtcctctgccatcgcgatcgagaccatgaccgcgctgggtgcgcccgtctccaccacccaggtgctcaccacctccatcatgggcgcgggcagcgcccgggggataaagaacgtgcgctggggcgtcgcccggtcgatcgtcaccgcctgggtggtcacgcttcccgccgccatggcgtttggagccggaatcgcctacatcgccgagatgctcgtgtagcttgccgtgtggccgcgtcgcgggcgcgcgtcccggattgccgggcgtgcgcgcctgcgcgtttggcgagagggtcgccgcctggcgttgtcccgggccatcccgcccctctcgccccgcattcgaccctgcccgaccgtcatctgctacagtctgccgtgtctggagtcgaccacacggaggctggcatggaaggcactaaggccatgaagcgcgcggagcgggagcggctgctcgccctccgcgacgccctgcccgagggcgagcgcgcgcgggcggacgccgccatcctcagccggtgccaggggcttgacgcctggcgcagcgcgggcgtcatcctggcctatctcagcatggggagcgaggtggacacccacctaatcatccgagcggcgtgggggcttgggaagaccgtggcgcttccatactgcgtcccccacacccgacggatgaggtggtatgccgtggattcgctcgacggtctcgtccgcagcaggtttggagtgctgcagcccgaccccgacacgttcggggaggtcgacccgtccggccccggtcgcctcgcgctcgtccccgccctctgcttcgacagggcggggttccgccttgggtacggcggggggttctatgacacgttcctctcctcgttcgggggaggggcggtcgggctctgcaggggggtgcagctgagggacgaccttcgcggagaggggctcgtggaggcccacgacgtgccggtcggcacggtggtgaccgacgccgagacgatcgtccccctcgcctagggcacgccctggcggcgaagtcccaccccacgtgtggtggagacgcgacgattccaaacgtgcggccgaagcctgcgggcgagttgcacaatgtaaggcggtcagttcgtcccgtgagactcggtaaccattggcgtcgaccagcgccataaagcgaaaggaagccaaggatggcaaagtcggacatcgagatcgcgcaggaagcgaagatgcaggacatcttcgaggtcgccgagaaggccggcctctcccgcgacatgatagagccctatggctacaccaaggccaaggtcgacatccacagtctggctgacaagccccgcaagggcaagctggtgctggtgaccgcgatcaaccccacccccgcgggtgagggcaagaccacgacctcgattgggctcgccgacgccatgaaccggctgggcgagaagaccatgctctgccttcgcgagccctcgctggggcccgtcttcggcatcaagggaggggccgccggcggcgggtacgcgcaggtggtccccatggaggacatcaacctgcacttcaccggcgacttccatgccatcggcgccgccaacaacctctgcgccgccatgctcgacaaccacatcaagcagggtaacgccctgggcatcgacccgcgccgcatcgtctggaagcgctgcgtcgacatgaacgaccgccagctccgcaacatcgtggacggcctgggcggggtcgccaacgggatgccccgcgaggacggcttcgacatcaccgtcgcctcggaggtcatggcggtgttctgcctggcgaccgacctcatggacctcaaggagcgcctctcgcgcatggtcatcgcctacacctacgaccgcaagcccgtcaccgtgcacgacatccacgcagagggcgcgatgaccgccctgctcaaggatgccatcaagcccaacctggtccagacgctggagaacaaccccgcgttcgtccacgggggcccgttcgccaacatcgcccacggctgcaactcggtcgaggcgaccacgacggccctcaagctcgccgactacgttgtgacggaggccggcttcggcgcagacctgggcgccgagaagttcctggacatcaagtgccgctacgccaacctgcaccccgacgccgtggtcctcgtggcgaccgtccgcgcgctcaagtacaacggcggcgtcaccaaggccgacctgagccaggagaacctcgacgccctggagaagggcatgcccaacctgctgcagcacgtctccaacatcaaggacgtgtttggcctgcccgtggtggtggccatcaacgcgtttcccaccgacacccccgccgagctcaagatggtcgaggacaagtgccgcgaactcggcgtcaacgtcgcgctctcgcaggtgtgggccaagggcggcgagggcggggaggacctcgccagggaggtcgtgcgcctgtgcggccagcccaacgacttccgctttgcctacgacctcgacgacacgatcgagaacaagctcaacgcaatcgcgaccaaggtctatcacgcggacggcatcgacttcaccaccaaggcggcaaagcagctgaggcagctggaggagcagggctttggcgggctccccatctgcgtcgccaagacgcagtacagcttcacggacgaccagcacaagctgggtgcgccgcgcggcttccgcatcacggtgcgcaacctcaaggtgtccgcgggcgccggcttcatcgtcgcgctcacgggggacatcatgaccatgccggggcttcccaaggtgcccgcggccgagaagatcgacgtcacgcccgacggcaagatcgtggggctgttctagtcgtcgctgccgccggggccacgcgccccggcggtccctttccggcggccgcgtgccgcatacatcaactaggagagcattgaggtggttggctatggcgcagaccatggctggacgtaccgttgccagcttctcccaggccctgggctcgtccgcacccacgccaggtggcggcggggcgtcggccgtggtcgccggcataggggtcgcgctggggcagatggtggcgagcctgacccagggcaaggagcgctacgcggacgtgcaggggcgaatcggcgagatcgcacccaggctcgaggagctgcgccttgagctcctctcgcttgccgacgccgacgcggaggcgttcgcgccccttgcccgggcctatcggcttcccaagggcacggaggaggaacgcaggcgcaaggcggaggagatggaggtcgccctcgcgggggcgtgcgtcccgcccatcgcgatcatggagcgcacctgcgaggcgatcgccctcgtggacgaggtgagccggatcggctccaccctcgcgctgagcgacgcgggggcgggcgccgcggtcctctccgccgcgctgagggcggcgagcctgaacgtgttcgtcaacgccggttccatgcgggaccgagaaagcgcggaggagctcgtctcgcgcgcccagtcgctgctcgacgacgggtgcgcgcgggcggacgaggtgtttcgccgcgtagaggagatggtcagatgagcgaggtcctgaggggcgcccccgttgccggggcaattaccgagagactcgtgccgcaggtggaggggctcgtcgcgaggggggtcacgcccaccctcgccatcgtgcgcgtgggggagcgtccggacgacctcgcctacgagaggggcgccaccaagcgggcccagaaggtcggcctggggcttcgcaaggtcgtgctgccggcggactgcgaccaggcccgcctcatggacgccatccgtgccgtcaacgacgacccgtcggtccacggctgcctgctgctgaggccgcttccctctccgctggacgaggaggcggcgtgcgccgcgctctcacccgagaaggacgtggactgcgtcacggaggcctcgctctacggcgtgttctccaacaggcccaaggggtttcccccctgcaccgccgaggcggtgatcgagctgctggaccactacggggtggggctcgacggcgctcgtgtcacggtcgtggggcgctccctcgtgatcggccgcccgctggccatgatgctccaggcgcgcaacgccacggtgaccatgtgccatacgcacacgcgcgacctcgccgccgcctgctgggaggcggacatagtggtcgcggcggccgggcacgcccgcacggtgggacgggagtgcgcccgtcccgggcaggtcgtggtggacgtggggatcaactgggacgaggcgtccggcaggttcgtcggcgacgtcaacttcgacggcgtgtcggcggtggtcgacggcatcacccccgtgccggggggcgtgggggccgtcaccacggcggttctcgccaagcacgtggtcgaggcggcgaagaggacggttggtgagtgatggacgtacgtgacgacgaggactacgacgaggcgtcgcagacggaggggcccggcagggtgtcggagctcagctacggggcgatcgacaagacccgcatcgaggcagcggtgagggagttgctcctcggcatcggcgaggaccccgacaggccggggctcctcgggacgcccgaccgcgttgcgcgggcctgcgaggagatattcggggggacccaggaggacccgggccgctacctgcgcaagcagttccatgagccgggcaacgaggagatggtcgtggtgcgcgacatccccttctcgtccatgtgcgagcaccacctgctcccgttcatcggcaaggcgagcgtgtgctacgtcccccgcgacgggcgcatcaccggtctgtccaagatcgcccggtgcgtcacgggctacgcccaccgcccccagctccaggagcgcctgaccagccaggtcgccgatgccatggtccgcgagctcgaccccctcggcgtccttgtggtgattcaagcggagcacacctgcatgaccatccggggcgtccgcgcgcccggggcgcagacggtcacctccgcggtgcgggggatcttcaagcgcgacatcaagaccaggggcgaggcgctccgcctgctcgggctctgacgcccgcgcccggcggctgacgcgattccacgaaaggcgaggctgttcgatgtaccaggttccgttcgacgttccatacatgacctacggggaggccgtctcggcgctcaagggggcgctcaggtttgggatccagcccatgctcgagagcgtccaggacatgctcgccgagctcggcgaccccgacctccgcttcagaagcctccagatcgccggcaccaacggcaagacctccacctcccgctacaccgcggctatcctcgggggagaggggctccgcacggcgctctacacctctcccgagctcgtgagctacaccgagcgcatggaggtcgacggccaccccatctccgaggaggagttcgcctacggcgtctccgccgcgatcgtggcgggacgtcgggtcaacgcgcggcgcgatgcggcgggggagaggccctacgacatcacggagttcgacacgctcacggtggcggcgatggtcgcctacgcccgtgcgggggtggacgtggcggtcctggagtgcgggatgggagggcgctgggacgcgacgtccgcctgccggtcgatcgagtccgtcgccgtcaccggcgtggggcttgaccactgccgcatcctgggcgacaccctggagaagatctcggccgagaaggccgccatcatcaggcgtgggaggtcctgcgtcctgggtgttggcaccgcgacgcccgacagcgtggaggacgtgttccttagacgctgtcgcgagcagggggtgacccccacgctgctgcggcccgaggtgctgtccgacgccgagggggagctccaccccggcgtcccgcgcgcccacgaggggatgccccacgcctcgtaccgcatcacggcacgcccgccccacctgggctttccccttgagctgacggtgaccaccccgcgcgcgacctaccccgagctcgccgcactcaagcctggctaccaggccgccaacgtcgcgtgtgcggtcgccctcgcggaatgcttcctcgggcgcgtcctggacggcgaggcgctctaccagtccgtggtcacgtgccccacccccgggcgcttccagctcctgcgcccgcagcctctcctgctcatcgacgcctgccacaacccgcagtcggtccagaccttcctcaccgccgtgcgcgacgtggagcctgaggtggcgggccggccgaccctcctggcggcagtcctcgccgacaaggacgtggatgggatcgtctcgctgctcgcacgagagttcccgcgggtcgcctgcacgcagacgtcgtccccccgtgccctgccggcaggcgagctcgcccaggcgttctgctccgccggcgccaacgtcgtggcgacgtaccccacggttcgcgaggccctctctggcttgtgtggagactcggtcgtggcctgcggctccatcaccctggcgggcgaggtcgcggcggaggcgggctggtcatctgctacaatgtcgcgagccatggattagcgccgccaagccgcagcgcacgtccgtctcacgcaacaagaagaaggagcgcttcccctcatgtctgacctccttgaccagctcatcaccccagaggttcgcatggtgctctacctcatggtggcctgcatcgtcatgctgtacatcctctccatcgtctacgtcatccgcgatgcgcagcgccgcggtgccgagccctggtggctgtgggcgatcatctcggtcatccccatcgtggggctcctcgcctacgtgatcctccgtccctccagctacctggtggaccgcgaggagcaggacctggacatcgcgctccgcgagcaccagctctcgcactacggcatctgccccaagtgcggcgctcccatcgaccgcgacttcgtggtgtgccccatctgcaacacccaggtgcgcaacgtctgccccacctgccatcgtcccctcaacgctgactggaaggtgtgcccctactgccgtacgcgcatccagtagcgccttagccatagtccaagagggaaccccgtcgcggcccgtgtcgcggcggggttcctcgcgtacggtcgcggcgggcgacgggcgagaggggactggccccctaccagaccgacagctccgacggcggaacggcaagcccctctcccgcaagccatgaggccatgtggtagcgcatgcgggccatggcagcggctgtggaggggtcgtcgaagcggcggttgagcatgtggaagaggtagccctgccccacggcgagctccgtcgccctcctgcgcgtgagcccccacaccaggcagacgtgacccacgatcatgtcggcaggaaggctcttcgccgccgtcgggatcgtgcggtgggcgaagaagtacgtctccaccaggggcgacatcccgctcgccaccaggctgtcctcgccaaagggatagatatcgcccacgggggtctcgcagttgaccctcaggatgtcgaccttgtcggcgtcgcggaggacctggctcagcgcgagcgtcctgtcgtccagcccctcggggagctcgtaggagctgtggttgcccaccgcctccaggatcacgtcgtcgtcggcgtcgtcgggggcaaagcgcctgaggagcgtgcggtcatcctccaacaacagcttcacccccagggccgcgtggctcacggagtcggcgtcgcgaaacgtcccgaagcgcctcacctgctcaaagcgcccgatgtcgtgcagcattcccaggagccacgccaggtcgacgtcgtggtcgcccatgccgtctgcacgggcgatgtcctcggcgagccgcgccaccctcacggtgtgtgccgccttcagcgcgatcttggggtccctcatgtcgtaggcccccacgtagcccctgaactcccggagcaccctcttgcggtccactcccatcggccgtctcctccccgcgtttctcgcaagtgttagagccaagctatcgtagcagcgaagattgttgtaaggttggtgcgttactggctattgcacgtggaggtgccccggcatgtacttgctcgcagggatggcccgcgtccgcacgttggcgcacgcgaccttgctcgctgccccgccttcctcggcgcggacggtgaccgcataggcgcctgtcctttcacggcggccctggggccgtgcggcaagcgccatcatcgcgcgccccgctgcggggcgcgcgcaccagcacaccacgcattaggaagaggttccagcatgaaggttctgtacaacgacggccacgtggacgagtgccccgaggacgaggagctgcacgtcctgcgccactccgcggcgcacatcatggcgcaggccatcaagaggctgtatcccgaggcggactttgcctatggccccgccacggacaacggcttctactatgacatcgacctcggcgacaagaagatctcggaggacgacttccccgccatcgaggacgagatgcgcaagatctgcaaggagaacctcaagttccaggtcttcgagaagccccgcgccgaggccatcgccctcatgcaggagcgtggcgagaagtacaaggtcgagcacatcggcgaccttcccgatgacgcccgcatcacgttctaccagcagggcgagtacatcgacatgtgcgttggcccccacatctgctacaccaaggcgctcaaggccttcaagctcacgggtgtctccggcgcctactggaagggcgacagcaacaacaagatgctcacgcgcatcaatggcgtcgccttccgcaacaagcaggagatggacgagcacttcgccctcctcgccgaggccgagaagcgtgaccaccgcaagatcggccaggagatggagatcttcatgatgaacgaggccggccccggcttcccgttctggctccccaacggcatgcgcatccgcaactcgctcatgcagtactggcaggagatgcaggacaagtttgggtacgatcaggtgcagaccccgatcatcctctcgcgcaagctgtgggagacctccggtcactgggaccactacaaagagaacatgtacaccaccaagatcgacgatgaggactacgccatcaagccgatgaactgccccggcgcctgcctcatctacaagagcaagccgcgcagctaccgtgacctcccgctcaagctcgccgaggccggcatcgaccaccgccacgagctcaagggcgccctccacggcctgttccgcgtccgcgagttccagcaggacgacgcgcacctgttcatacgccccgaccagatcaccgagcaggtcaccgacgtcgcccacctcatcaccgcctactacgcgcagtttggcttcccgtatcgcgtggagctctccacgcgcccggacaactccatgggctccgacgaggactgggagcgcgccgaggacggcctcaagaaggcgctcgaggccatgcacgtcgactacaagatcaatcccggcgacggcgcgttctacggccccaagatcgacttccacctgcaggactgcctgggccgcgagtggcagtgcggcaccatccagctcgacttccagctgccccacaacttccagctcgagtacacggaccgcgacggctccaagaagcagcccatcatgatccaccgcgcgggcttcggcagcttcgagcgcttcatcggcatgctcatcgagcagtacgccggcaagttccccacctggctctccccgtgccaggtcaaggtccttcccgtctccgagaagacgcgcgactacgccaaccaggtcgcccagcgcctgcgcgacgccggtgtgcgcgtcaaggtggacgagcgtgacgagaagatcggctacaagatccgcgaggcccgttccatcgaccgcgttccctacatgctcatcctgggcgagaaggaggccgaggcgggcaacatctcggtccgcgaccgctcaaacgagacggtccagcgcgacctcgaggacttcgtgagcgacatcaccgaggagatccgcgagcgcaggggctaggacccttgagggagggcagctcccgtcacaatggtgctgcgaggcggcctcgacggctgcctcgcagctttcgtatcggggtccagcgtgtgcggcgtcaaggtagggggaggaccacatggcgcaaggggaagagcagggttcgggagaagcggcacaacctcagggccaggcccacgacctccccgctgcgctgcgttcgaggatgaggtccctccccgcggccgcctcggaggcggtcctctctcgcatcgcattggagcacggcccctcggggattggccatgggcgcctccgcgagcttctcgaggaggagctcaagccaagggggcgcgccactcgcgaggagtcgctggcctacggcaaggcgctccgaaagcaggtccctcgcggcagccatgccgcctgggaggtgggggaggaccgtcagcatgccatggaccttctccgccgtcaggagggcgaccgcgtgcaggacctcttgcccatccgccaccagcgcatggccgagtcgcccttctccttctaccgtggcgccgcagtcatcatggcggacgacctcgcccacaccccaacgaccggcgtgagggtgcaggcctgcggagacgcgcacctcgcgaactttggcatcttcgcctcgcccgagcgccgtctggtcttcgacatcaacgacttcgacgagacccttcccgcgccctgggagtgggacgtcaagcgccttgccaccagcgtcgagatatgcggacgccacctcggactctccgaggaggagcgcctcgatgcgctccgatcgacgtcccggggctaccgtcagtcgatggcgcggttctcgaggatgggcaacctcgacgtttggtatgcccacctcgacgtcgaggagatcctgcgcgagcgttccgactacctcaacaaggcggagaggagcgcgctgctggccaccgcagagaaggcgtccaagaggacgagcagccgagcggtggcaaggttcaccgaaaccgttggcggcgagctgcgcgtgatcagcgaccctccgctcctggttcccctgcgagacctggcgggctatggcatctcgcaggagacgatcgtcaaggtgctgggtgcctatctcgcgtgctatcgcctcaccctcccgcgcgagcgccggtcgctcatcgaccagtacaccccgcaggacatggcgcgcaaggtcgtcggcgtgggcagcgttggcatgcgggcgtggatcatcgtgcttgagggggcagaccccagcgactcgctggttctgcagctcaaggaggcgacctcctcggtcctcgagccgtacgcgggcacgagcgagtttcgcgaccacggcaggagggtcgtcgaggggcagcgcgccatgcagacggccggtgacgtgcttctcggctgggcgcgatccccggacgagaggggcgtcatgcgcgactactacgtccgccagctgtgggacgcgaagggatcgatcgacctggagcgcatggatgcccatgagctcgcccgctttgggacgctgtgcgcatggaccctggcgcacgcgcacgcgcgaacgggcgaccggcatgccatcgccggctacctggggaagggcacggccttcgacgatgcgctctgcgagttcgcacgtggctatgccgaccagaacgaggtcgactaccagctgttcctcaagtcgttcgaggatgcgcactagggcaaaggtgacatcgtctggggagaggggagcgttgcgtggcggtagcacagagcgaggtggagcgcgccttctccaggcgcatcggtgcgcagaggacgcgcatcgtccgttgcgggggaacgcgggagcttctcgacaagctcgggctcacgggggtcacccccgtggagagcctgggtggcgtcccggtcacggtgccggacatgagggaactcgccggcgggtaccgagcgcgtggcgaggtgctcgtggtggacaacaccacggcgagctcgttcgggtccgccccggggaggaggggcgggcacgtcgtgttcgagcgcctcgcccacgtccttgacgacccggagtgcgccttggtcgccgtgagcgtctcgcgtgacgcgcgctccatccccggcctcctcgatcgcctcgacctcctgcccggtgcctcggaggaggagcaacgcgccgtggcggaggcgctccccgacttcgacgagcgccgcagacgggcgaacgacctcgcgcaggtggttgccacgttcctctcctgccatcccggggtcggggagctccgctatcccggccttccgacggacccaggccacgaggtggccgcaagcctcctcttcgacggcttcgggcccctcgtggacctcgtcccctccgtcggagcacgggggatgcatcaggcatgcgagaggatcggtggcatggcctccctcgccctcccgtcgcgtgagggtggggaggcctggctgcgcctcgaccttcgcgagtgggacgggggagaagttcgcggcgcccttctcgccctcgagtctgccttgtctgtacttgatggataaacattccgacgctatgcagaacgtgtgctccctcaaacttttccgctttggaggatgtgggtcaaacaacctgaccactgttgtgtgatcaacttaaaaaccgcaggtgaaccgtgttgtggctcgtccataaaatcgtcattcggccagcgtgggaacattcccatgcgatatgatatgtgcatgcattgcgggaaatcgcaagctcatgtcccaaccggtcgactggaggccacatggacgcacccgagcaggtttcagttattgacagcgtcgaggcgctgcaggctcgcatcaaggagatgcgtgccgcgcaggccgagttcgcaaccttcacgcaggagcaggtggacaagatcttcttcgccgctgcgatggctgccgacaaggcgcgcattcccctcgccaagatggcggtcgaggacacggggatgggcctcgtcgaggacaaggtcatcaagaaccactttgcggccgagtacatctacaacgcctaccgcaacaccaagacctgtggcgtgatcgaggaggacaaggcctacgggttcaagaagatcgcggagcccatcggcatcgtcgccgctgtcatccccacgaccaaccccacctccaccgctatcttcaagagcctcatctgcctcaagacgcgcaacgccatcctcatcagcccgcacccccgcgccaagaagtgcaccatcgaggccgctcgcatcatccgcgacgccgcagaggccgcgggcctgcccaagcacatcatcagctggatcgaggagccttccctggagctcaccaacgagctcatgcactcctgcgacgtgatcctggccaccggtggccccggcatggtcaacgccgcctacagctccggcaagcccgccgtcggcgtcggccccggcaacaaccccgcgatcatcgacgactccgctgacatccagctctccgtcaactcgatcatccactctaagaccttcgactacggcatgatctgcgccaccgagcagaacgtgatcgtgctcgacaaggtctacgacgaggtcaaggccgagttcgagcgccgcggctgctacttcctccagggcgaccagatccccacggtcggcaacctggtcatcaccaagtccggcggcgtcaaccccaaggtcgtcggccagcccgctgccaagatcgccgagatggcggggatcgaggtccccagggcgaccaaggtcctcatcgcagaggtgacctccgtggagccgagcgagccctgggcgcacgagaagctcaccacggtcctcggcatgtatcgtgccaaggacttcgacgacgccatcgccaaggcctcgcgcctggtcaacgatggcggccgcggccacaccagctccctcttcgtcaacgtcaacgagaaggagaagctcgagaagcacgagaatgcgatgaagacctgccgcatcctcatcaacacccctgccgcccagggtggcatcggcgacatttacaacttcatgctcaccccatcgctcacgctcggctgcggcttctacggcggcaactccgtctgcggcaacgtcggcgtccagaacctgctcaacatcaagtccgtggcggagaggcgtgagaacatgctgtggcttcgtaccccagagaaggtctacttcaagaagggctgcctgcccgtcgccctcaacgagctcaaggacgtctaccacaagcagcgctgcttcatcgtcacggaccagttcctgtacatgcacggcttcaccaagcccatcgaggacaagctcgaccagctgggcatcgtgcactccagcttctggaacgtcgagcctgacccgtcgctccagtccgcgctcgagggcctgcagcagatgaacgccttccagcccgactgcatcatcgccatgggcggcggctccgccatggactgcggcaagatcatgtggtccatgtacgagaaccccgacgagaagttcgacgacatgtccgccgacttcatggacatccgcaagcgcgtctacaccttccccaagatggggaagaaggccttcttcgtggccatcccgacctcctcgggcaccggctccgaggtcaccccgttcgccatcatcaccgacaagaccaccggcgtgaagtggcccatcaccgactacgagctcatgcccaacatggccatcgtcgacaccgacaacatgatgagccagcccaggggcctgacctccgcctccggcgtcgacgtcctcacgcactgcctcgaggcctacgtctcgatgatggcgtccgactacacggactccttcgcgcttcagggcatgaagctcgtgttcgagtacctgccccgcgcctacgacaaccccaacgacgtcgaggcccgcgatcacatggccaacgcctcctgcctgggcggcctcgccttcgccaacgccttcctcggcctcaaccactccatggcgcacaagctgggcgcgttccaccacatcccgcacggcctggccaacgccgtcatcctcacccgcgtcatgcgctacaacgcggccgagcgtcccacccgcatggggaccttcccccagtacgaccaccccaagacgctgcaccgctacgccgatgccgcgcgcttctgcggggtcacgggcaaggacgacaaggaggtcttcgagaagttcctgctcaagatccgcgagctgttcgaccacgtgggcgtcaagcacaccatcgccgagtacaacgtggacgagaagtacttcctcgacacgctcgacgcgatgaccgagcaggccttcaacgaccagtgcaccggcaccaacccgcgctacccgctcatgagcgagatgaaggagctgtacctcgacgcctactacggccgtcccgcaagctcctacgaggactagttggtcacaacgtcgaggcaccaagaccaaggaggctcaaactatgaggctttcggatagcaaggtcgagctcatcagccgtggaaacaaggtcgtctaccaggatggcgagagggtcgtcaaggtcttcaacaccgagaagcccgctgccgacgtgttcaacgaggcactgaacatcgcccgcgtcaacggctccggcgtccgctcctgcgaggtcctcgaggtctctcgcgtggaggagggggagcacaagggctcctgggcaatcgccaacaggttcatcccgggcaccacgctccgccagctcatggacgacgacaaggccaacgccgacaagtacctggccaagttcgtcgacctccagaccgagatccacgaggccgaggcaccccttctcaaccgccagaaggataagctcgcgcgcatgatcgggtcctgcaagcagatcgaccccaccacgcgctacgacctgcagatgcgcgtcgacggcatgcactccggcaccagcatctgccacggtgacttcgtcccgtccaacgtcatcgtctgcgacgaggacgaccagctttacctggttgactgggcgcacgtcaccgcgggcatcgccgaggtcgacgccgccacgacctacctgctcctcaagcgtcgtgacgacgacctggcggagaggtacctggacctctactccaccaagacggacacgcccaagcagctcatccactattggctgcccgtcgtcgctgctgccgagctcgcgcgcggtcgcaaggagaacgaggagtacctcctcagctggatcagcgtgggcgactacgagtaggcgttcccacagctgggactgacatgggggaggggccggagtgcgcttcggcccctcccttgtcgtatccgtatgggctccgtccaaggtcgcgtcaggcgagacgctcgaggtcacaaacaggcaccgcccccgaacgcatggggacggcgcctgttgcctcgatgccaatgggtggggagtcgggcgaggggcctagcccttatcgccctccttcgtgtacgtcacgaagtcgtagtcgacgcccgccgaggtggttcccgagccctcgggctcgcttgcggcccaggcgtcctcctggtcgaggttggggaaccaggcgtctgcggggacggtcacgtggttgcgggtcacgtagacgcgcgagcagcgggggaggagctgccggtacaggctctcgccgccgatgagccacacgtgcccgtcggccgaggttgcctcgagcgcctggtcgacgtcgttgaacacctccgccccgggaatcacgagccccgggttcctggagaggacgacgttcctcctgcccttgagggggccgccgggaaagctgaggaaggtcgagtggcccatcagcacggtcccacccatcgtcaggcgcacaaaacggcgcatgtcctccctgttgcggacgaggaggttgccgtcgcggccaatgccccagtcgtcggtgacggagacgatcgcatccatctggcaagcccccctagacggcgatggggatgttcttgacctgcggcccgtgctggtagtcctccaccacaaggtcatcggtcgtgaagtcgtagaagtcccgcacgttggggttcaggcgcaccctgggcgcgggataggtggggcgtgagatgagctccctcaccacgtccacgtggcggtcgtagatgtgtgcgtcagagatcatgtgcacgagctcgcccggaaccatgtcgctcacctgggcgaccatcatgagcaggatggcgtactggcacacgttccagttgttggcggcgaggacgtcctggctgcgctggacgaggagcatgttgagcgtgggacgctcgtcacccggggcctgcgtcacgttgtagaccacgttgtaggcgcaggggtacaggttcatctcggacaggtcatcgaagttgtacgtgttggtcatgatcctgcgcgagaagggattgttcctgaggtcgtagagcacgcggtccatctggtcgaactcgccctcgggatagctgctcttccggccgatctggtagccgtacgccttgccgatggagccgtcctcgtccgcccactcgtcccagatgtgggagtggaggtcgtggatgttgttggacttgcgctggtagatccagaggacctcgtccatgcagctcttgagcgctgtcctccgcagcgtgatggcggggaactcctcgcgaaggtcgtagcggttgcagacgccaaagcgcttgatggtgtaggcggccgtcccgtcctcccagtggggcctcacgcgctggcctgcgttggaggtcccgttctcgatgatgtccctgcacattgcgacgaagatgtcgtccgccctgctcatctcgctcccttcggtgtcaccctgcaacgacgcggcccgtcgctacatgtaccagtcgatcccaccctggatgccgtcgtgcgtgtctccgtcgccctccaccaggcgctccagctggtcgccgccatcgccgtccaggtagtagtacgggtcgaccccaccctgggcgtccgtggagttggagtatgcgacgtaggcgagcgagacgagctgggcaatgccgcctgcgatcgacgagaacacgagcatcgccgcgagcaggcctgccgcggcgatgacgatgggcttggagcccgagttcgcgttgtcgggggaggtcgtcgcggaggcggtctctatggggcgggagggtgcggcgagcgtcgccggcgccccctcgttcggtgtctggtcgttcatgggatacctcctcgcatctggtcacgctcccatgatacccaagagccagtttcgcgctctccggatgattgtctggtgctggccaccccgcgatcggggatggcgtcacaggtggctgggctggaagatgctgtcccacatggcgccgacccggtcgatcaggctcaggtccgcggggagccagtccacgtcgcccagctcggcgcggtcgagccacctgccctcgcggtgctcgagcagcctgggctcctcgccgggggcgagctcgctcacgaacacgtccatgctcaggtggaagtcggggtagtcgtactcgatggtgtccagataccacgtggtggagaggcgaacccccagctcctcgcggacctcccgggcaacggcctgctcgcccgtctcgccctcctcgaccttgccgccggggaactcccagccgtccatgccatggcctcggcgtgcggcgaagaccttgccgtccctcaccatgatcgcgcatgccgccttggtaaccttcaccgacatcacccctgagtctctcgcccgcaatgcatgaaacggaaagccgtcatcgcgagagcagctggaccacggcgtagtcgtcccccgtgggagacgagagctccacggtgtgcccgccctcgacgtcgtgcacccttggaaccacggtgtcgccgagcagcgccatgtggcggtactgcacgcagatgcgccttgggctcacggcctcgcccagctcggcaagcgcgtcgagcgccagcatgatgtactgggcgttgttgacgtggcggttggtgtccaggtgctgctcggagatggtcacctccgaggcctgggcaaacggcccctcgaccgggagcctcctctgcgtggggggcatgtcaaggcgctcgtccccctcgtcgtagatgctctcggactcggggatgcgtgtgggcctgcggcgttccgtgtcgaacacgaaccacagcgagtccgccctcacgtagggcctgcccgacgggtcgcagatggtgaagttcctgcccgcctgggtcttccccagcgtgtggcaccaggtgctcaccctgatggggtcgaagaagcgcgggagggcgtctatctcgatctgccaggcggagatgaaccagctgaagtggtgctcgcgcatgaactccagccccacgcccaggctctgcgactgaaaggtggagcagtcctgaaggtagttgacgagcgagacgagcgagaggttggcgtcctcgtcgcactcgctgtagcgaacgcgcgcgtcgaaggagtacatgggatacctcctagatctcggggaaggcgacggtgtccgtgccaccgaagccgctggtgccgtcgtcgtcgggctcgtagcggctgagcgagtccacgacgagcctgttggcggcggggatgacctgggccacgtagctgctcacgaggccggggatgacctcgccgtctgcctgcatggggatgggcttggagctcttgacctcgatcgtctcgcccgtgaagtgctcaaggtagggccgtccaacggagttgccggacttgtcgaccatgcccgcgaagatgggcctgaggagctggacggcgtccgaggtctcgaggaggatgacgtccagcttgccgtcggtcatcgtgctgttgggaacgacctcgatttcaccctggatcatcgcgttgttggcgacgatgcaggctatgccgtccctctcgcagcgcctgccgtcgacggtgatgtcgaagtggatgatgtcgggatggatgttggagagggccgcggcgaagtaggccgcctcgcccatgctcttcttgttgggcacggccgcgcgcatgagctgcgcgtcgaagccggtccccgccatgatgccaaacccgtgctcgcgaggggtgccgtcctcgtccgtccagcgcatgacgcccaggtcggtgtggaccgagcggccaaggcggcaggcgtgggcgatcgcggacggctccggggcgctgccgaggttggcgaagaggaggttcgccgtgccggaggggaagatgcaggtgaggacgttgcggtccctcagctcaaacaggaggttggtcacggtgccgtcgccgcccgagaccaccacgaggtcaaagtcctccgcgtcgcgcacggcctcgcgcgcgccaccctcctcgggcagcgcgcgcagcgtcacctcgtctccgtcgcgcagcagggcccgctcaaactcgaagaccgcgtttgacccaaagcccgacttgaggttatggacgatgagcgtgcgcacgttgcctcccatgtggttcgttatgataatgaggttgcgcctgaggcgcacatagatgtcatggtagctatttttgacccagaatcgagggcgcgtgtacatacgtgacgcggaacagctggcctccttctgcgatcgagcgtcggggtccggcatcctcgccgtcgacaccgagttcattcgggagcgcacctaccatccccagctctgcctcatccaggtcgccacggcagacgagtcggcggccatagaccccatcctcatcaaggacctgagtcccctctccgagcttctggtcgaccccaggatcgtgaaggtctttcatgcctgtgggcaggacctggaggtcatcaacgacgcgatggggctcgtgcccgcgccgtcgtttgacacgcagctcgccgccgcgttcgtgggctaccgcaaccagatcgggtacggcgcgctggtcgaggcgtgctgcggcgtccacctgcccaaggcggactcgctcacggactggtcgcgccggccgctcgacgccgagcagcttcggtacgcggaggacgacgtcacgtacctccccgccgtctacgagtccctgatggctcagctggtggagagggaccggctctcgtggctgctccccgagatggaggagctcacgcgtcccgaccgctacgagcgaaacccgcgtgaggcctacctccacctcaagagggcggggtccctcacgcgcaagcagcttgccgtggcgcgcgagctctgcgcctggcgcgagggcgtggcggagcgacgcaacctccccaggaagtgggtcctcaccgacgaggtggtgctcgaggcctgcaagcgggcccccaggaccgtcgaccggctcctccgcatccgcggcacggagcagcttgggagggccgaggcccaggccgccgtcgacgcgatcgctcgcggcctcgaggcaaaccccagctcgctgcccgagcgtcgccgccacgagcgaccgggtgcccagaccgagagcgtgctcgacctcatgtacgcgctgctccgcctcgtgtcggagaggagcggcgtcgcgtcgcagctcatcgcgacccgcgacgacctcctcgagttcctgaacgaccccggctcgtcgaacctctccacggggtggaggtacgacctgcttggctccgagctcgagcgcctgctcgccggcgagacgggcctcaccatcaaggacggccgcatagagctgctctgagtcccccatcccacagggtggggatttggtgtccggggtccggcgtagcattggcgggagaaggacgtcgccccgctggggtacaagcggggcagggttcagcacaggaaggaacgcacccatatgatctacttctatggatccgggctcgcctactggggcatcatcatcgtctcgctcgtcctcggcggcgcgacccaggcatacatcaactccacctaccgcaagtggtccaaggtgcccgcaagcgcgggcggcacgggggcggaggtcgcgcgcaggatgctcgacaccgagggcgcgcccaacgttgggctcgcgcgcgtctcgggccacctgagcgactactacgacccgcgcgacaaccgcctgcacctctcgggcgagaactacgagggggcctcggtcgcatccgtcgccgtcgcctgccacgaggccgggcatgcggtccagaccgccaagggctacgcgttcgggaagttccgcaccgccctcgtgccggtggtcaacgtgacccagcagctgtggagcatcctgctcatcgtgggcatcttcatcaacgcgatggggctggtccgcatcggcgtgctgctcttcgcgttctcggtcctgttccagctggtgacgctcccggtcgagatcgacgcctcgcgcagggccgtcgcgtacctgggccgtgcgggcggcagcatcgacgagcggggcgcccgccaggtcctcaccgccgcggcactcacctacgtcgcagcggcgctggtctctgtgctccagctcctgtacctcctcggccagacggacagggactagccgtggggaggggcgagtcggaggcgccgctctcggtctcgcaggccgtcgagctggtcaaggggaccgtcgacaccatcccgcagatcgtcgtgaacggcgaggtctcgggcttcaggggccccaacgcgcgctccgggcactgctacttcaccatcaaggacgacagcagcgccatggacgtgatcgtgtggcgtggaacctatgccaggtgcgggttccggctgagggacggcctggaggtcaccttcacgggcaggttcggcgtctatgccggcacggggcggctctcgttcatagcgtccaggctcgaggtcgcgggggaggggctccttcggcagcaggtcgcagccctcgcgcgcaggctcgaggccgaggggctcatggaccccgaccgcaagcgtcgcatcccgcggttctgctcgcgcgtggcggtcgtgacctcgctgtcgggcagcgtcatcgaggacgtcaagaggacgctcgcacgacgcaacccgctggtccagatccaggtcgcggggtgcatggtccagggccccggcgcgccgcagaccatcatccgcgcgctcggagtcgccgcggccgcgcgacccgacgcgatcctgctcgtgcgcgggggcggctcgttcgaggacctcatgacgttcaacgacgaggcgctcgcccgtgccgtggccgcgtgccccgtgccggtcatcacgggcatcgggcacgagccggacacctgcatctgcgacatggtggcggaccgccgctgctccacgcccactgcggcggccgagtcggtggcccctgccttcgacgaggtggaggggaagatctccgagcgcgcggagcgccttggcaaggccatgggcaagcagctctcgggcgaggcgcagcggctcgacacgctcgccctcctcgccaccaactcggtgagggagggcatcaggaggcgcgcggtcgccgtcgacgcgatggggaccaggcgctgcctgtccgacccccgtgggatgctgctcgaccgcgaggcgcagctcgagcagaccgggcagcggctgcacgacgcgataccccggaccctccagaggaggggcgagctgctgtcgaccgacgcctcgcgcctctcgactgccgcgcggaggatgctggttcccttccatgcggaggtcaccaggtcggcggccacgctcgacgccctctcgcccctcaaggtgttggggaggggctacgccgtggccagggatgccaacgggcacgtcgtggactccgtgggcaaggttgcggccgaggacgtcgtgagcatcctggtgtcggacggcagcatcaggacgcgggtcacgggcattgaaagagacggtcagacgggcgagagcccgagggaggcatagggatggaagagaagaaggacggggcggtcgagcagttcgccgacatcgatggcatgagcttcaaggaggcgtcgaccgagctggagcagatcgtccgcaggctcgagagcggcgagctcgagctggaggagtccatgaccctctatgccaggggcgtcgagctcctcaagagcctgagggcacgtctcgccaacgccgagcagaaggtccaggtgctgctcgacacgaccgagtccgcgcaggtgaccgacaccaccgccgcaccttcgacggcgttcatcgacgagtagcgaaacgaggggaaggggagagacccatggcaaccaaggacgactgcatcttctgcaagatcgccaaccaccagatcgagtccgactacgtgtacgaggacgacctggtctgcgcgttcagggacatgaacccccaggcgccggtccacgtcctggtggttcccaaggaccactatgacaacctggtggacgacgtccccgccgagaccctcgcggccctcgcccacggagtggacgaggtcgccaagaggaccggcatccgcgagagcgggttccgcgtcatcgccaacaccggtgacgccgccggccagacggtccatcaccttcaccttcacgtcctgggcggggaggggctcggcgagggcctcctccccaaggagtagccatgggcgccgccgaggagatggccgcgcgggcgaccgagcggcacgagcggggatacaactgcgcgcaggcggtggcctgcgccttcgcggagcgcctgggtgtcgaggagaaggtcctcttccgcgcgaccgagggccttggcctgggcatgggcggcatgcagggcacctgcggggccgcgagcggcgcgtgcgtggtggctggtcttgccaacagcacgggcaacctcgagcgccccgacagcaaggcgtcgacctacgcgatctcgcgccggatcacggaccgcttcgcgcacgaggcgggagccgtgcgctgcgccgacctcaagggcgtggggacgggcaaggtcgtctgcccgtgcccccgctgcgtggagctcggcgccatcatcgcccaggaggaagtcttcgacgcccgctgacaaccacgaaccctcacgtagcggcatatggctatgatggggtcgcttgtgttcgttgggtgagaagggatgcgggcctggcgcccgcgagaggagtcgcatgaacgtcctagtaatcaacgctggtagctcgtcgctgaagtaccagctcctcgacaccaagtccggcaaggtcttcgccaagggcaactgtgagcgcatcggcatcgatggctccttcatcggccacgaggagaacgacggcgggaagcagaagaccgaggtcgcccttccggatcacaagactgccatcaagcacgtcttcgagatcctcgacaaggccggcttcgacaccgacaagatcgagggcatcggccaccgcgtggttcagggcggctggtacttccccgagtccaaggtggtcaccgacgagaccctgggctgggtccgcgaggttgcccctctcgccccgctccacaactacgccgaggcggacgtcatccagatctgccgcgagatgttcccctccatcggcaacgtgatcgtcgccgacacctcgttccactacaacatgcccgagaaggcctggcgctacgccctcccgcgcgacgtggtggacaagctgcacatccgcaagtacggcgcccacggcacctctcaccgctacatctggaagaccaccaacgagttcctcaagggcgacgtccacaagctcgtgagctgccaccttggctccggcgcgtccctctccgccatccaggacgggcacgacatggacaccaccatgggcctcaccccgctcgacggcctgatcatgggcacccgctgcggcaccatcgaccccgccaccgtgtgctacctggttcgcgagggcggctacaccatcgaccaggtcgacaccatgatgaacaagcagtccggcctgctcgcgctctccgccgtctcgtccgactcccgcgacatcgaggcaggcgccgagaagggcgacaagaactgccagatggcgctcgagatgttctactaccgcacctctcagctcatcgccgagatggcccagtccatgcacggctttgacacgatggccttctcggccggcatcggtgagaactccgccgagatgcgcctgggcgtggccaaggagctggagtggctcggcgtcaagatcgacgagaagaagaacgaggtccgctccgacgagccccgcgtcatctcgaccgacgactccaaggtgaaggtcctcgtggttcccaccaacgaggagctcatgatcgccctcgacgtcgaggagctgctcgggaagtagcatccctcgtagggtaaggagcggggcgccccggcgatgagccgaggcgccccgcttgccattgacgtctcttggcgtgatgcgtcaggccgagacaggctaccccatgaggccgcgccttctccaggggagccacgacagccagccgccgtcgtccccctggcctggcaccacgagctggtaggccatgcgggggctgccgtccctcacgtggatggtcccgcagtgctggaacccgcggctggcaagcagccgctgcatgggcacgttgtcccgatgggtgtccgcccgcaggctcgttgcggactgcagcgcccaatcaaggcagaaccctcccacgccacgtcccggttcgcgcaccgcgagccggtggatcacaaagtaagggccgtcgtcgagccaagcgccgtcctcgatcttgaggtaggtggggtcggggccgggctgcaggcacaggcagcccacgacctgcccctcgtcctcgcacgcgaagagggtcccgcggcgcacgtccgcgaggatgtcgcttccggagggatactccccggcccactgggtcgggttgccgttgcgtcgcatgaagtcgcgggcgccctcgtacaggctgtccagagcgtccaggtcctcccgcgtggcgggtctcatctccatgacggctccctagaacggccgcacgcagaacgagcgctcaagggcctggcagggggagaggagcgtcatcccgcgcttgtgctcgaacacgtcgtcctcgtccagcgccgtggcgcagccggtccagggctcgagcgcgacgaacggcgcgtctcctgcggcggaccagaccccaaggtagtcgaagccctcgaacgcgacctccaccccgtggccgccgtcgcccaccaggcgcacgaacctctccggaacgtcctggaacaccaaggtgtccacatcaaaggtgcgatgggtcaggcgcagcacgttggagccgtcgaggagcgggagccggtcctcgaagtcgaggaggccggacgacgggtcgatgcggggcgaggcgtaggtccactcccgcgcaaactccaaccggtacgagtcaaagtcgtcgccgccctggggctgcgggacgttgaaggcagggtgcccgcccaggacgaaggggagagggacgtcccccgtgttcgtgacctcaaacgtctgcgtcagggcgccgtctgccagcgagtaggagagctcgaggcggaagtcgtacgggtacgactcgcgcgtccgcgcatccgagcacagacggaacctcgcggaggcctcgccgctcgagacgagctcgaactccctgttgcgggcgagcccgtggcggcccaggctcacctccccttgcgaggaggacgcgcggtcgtccctcaggctgcccacgatggggaagaggacgggcgccctgcggggccaccacctctcgtcaccctgccagaggcactccccgccgtccctcgtgaggctcatgagctgtgcgccctgtgagtcgatggtggccgtaagaccgtttgaggcaatgctcgtcatgaagggcatgaagctcctttccttggaccataatcagcattatggtcttaatcgtcttttgatatccacgccccctgccacaaatgtcggtggggggcatccggggatgggggaatcaacatgctcgaccgcaggcagttcgtcaaactctctggcgtcctctccgcctcgctcgcccttggggtgtccgggtgcggatccaagccggcggcaggcgggtcgtcctcgtcggacggcgactccgccgacagctccgcctcctcgtcaaagcagaaggtgcgcgtcggcgcgctcaaggggccgacctctatcgggctcgcatacctcatggaccaggcgtcaagcggcaaggccgccgaggactatgagttcaccgtcgccgcctcgcccgatgcgatcctcccctccatcatcaagggtgacctggacatcgcctgcgtgccggcgaacgccgccgcggtcctctacaacaagaccaagggcaaggtctcggtcatcgacgtcaacaccctgggcgtgctgtcggtcgtcaccgccgacacgagcatcaaggacttcaccgacctcggcggccgtaccgtgtactccaccggcaagggtgcctcccccgagtacgtgatgagggacctcctcgacaaggccggcatcgccgatggcgtcacgctcgagttcaagagcgaggcgaccgaggtcgtgagcctcctcgcgcaggacgcgagcgccgtcgccgtgctgccccagccgttcgtcaccgcggcactggcaaagaactcgtccctcaccgcgcccatcgacctcaacgacgtgtgggacaagtacaaccccgactccaagttcgtgatgggcgtcaccatcgcacagaacgagctcatccagaagcatcccgacgtggtcaagaccttcatgaaggagcaggcggcctcggtcaaggaggcaaacgacgacccggacaccgtcgccccgatggtggtcaaggcgggcatcctggacaacgagaagatcgtggccaaggcgatccccggctgccacgtggtctgcatcaccggcgacgagatgtccgacgacctctcgggcttcctctctgtcctgtacgacgtcgactcctcgagcgtcggcggcgagctgcccaccgagaacttctactacctgggctaggaagccaggggttccacgcgcatgcgaggcgggcgtagcgtccaccggtcaccgacagccccttccggaaggggctgtcggtgacccgggggagggggaacatggggcggcggctcgccgcctgcgcgctgtggcttgccgcctggcaggtcgcgagcgtctgcgtgggcagcacgctcctcctcgcggggccggtcgacaccgttcgctcgctcgtctcgatcgccctcgacgggagcctcctcgccatcgccggaaccacgttcctgcgtatcctgtgcggcttcctgctcgcgttcgtcgcgtcgctcgccctggggtcggttgccagctcgcatccgctcgtttccgacctcctcgagcccggcgtcgccgtcctcaagagcacgcccatcgtgtgcgtgatcgtgctcctgctcctgtggctcggcacgggcgtggtcccggtcgccgtggtgttcctggcgacgttcccgccgctctacttctgcgtgcgcgactcgctgcgccaggtcgaccgcgacctcacggcgttcctccgcgtcatgcgcgtcccccggtggcgcgttgccctcgcgcacgtgtggccgcagattctgccctacgtgatcgccacctgccgcaacgcctgcggcatggcctggaaggcgggcgtcgccgcggagctcatcggcacccccgtccccagcgtgggcgagcgcgtgtaccaggccaaggtcctgctcgagacctccgacctctttgcctggaccatcgtggtcgtgctctcgtccttcgcgtgcgagaggtgcttcctcgcgctcctgcgcgcctccggcggccttgcgaagcgggtcgctctccatggcctcgggacgtcgcccgccccccgagacgacggctcctctcccatggcgaccgattgcctgggcgtgcgcctgggggagagggacgtgctccacggcctttcgatcgacgttcccgccgggtgctccgtctgcatgctcgacccgtcgggggccggcaagaccacgctcgtcagggcgctgtgcgggctcgtcgcacccacgtcgggggcggtcgccccactgggccgcgtgagcctggtcgagcagtccccccgcctggtggaggacctcggcgccctggacaacgtgctgctgtgcgccggcaggtgggccagcgggggagaggcccgcgcccttctcctccgggcggtccccggcctggacgtggaccttcctgtgcgcagcctctccggtggccagcgcaggcgcgtggagctcgtgagggcgcttctgacctgctcggatgtcgtcatccttgacgagcccttcgccgggctcgacgaggctgcggtcgaggcgtgcgcagccatcgtgcgggatcaccttggggggaggaccctcctcgtggcgtcccacgaccccagggcggcaacgctcctgggcgccacgccgctcccgtccctctcgcccgagacccccaggcgagaaaccgcagccgtccgcgggaggtaatcagacggaaacgtagttggccctccccctcgggcaagatgggtaggtgcgcacccataccatgcccagcggtgcgccctaaggaggacactatgcttcaagaccagcttgcggaggcgggcatcgcctccgcccacggggcggtcctggtggacggctctcccgccgtcctcgtcgagaaggcgctcaaggcgaacgagggccagctcacctcgacgggcgcccttgcggtcaggacgggcaggtacaccggcaggtccccgcgcgaccgcttcatcgtcgacacgcccgacgtccatgaccagatcgcctggggcacggtcaacatgccgttcccacccgaggggtacgagagggtcaagcgggccgtgtgcgactacctctcgatgcgcgacctctacgtggtccacgccatcgccggggccgaccgccgctggtgccgcaagttcctggtggtgtgcgagcgcgccagccaggcgctcttcgcccgccagctgctggtgaggcccagcaagcggcagcttaaggagttcgagccgcaggacttcagcgtgctcgtggcccccggcctcaagctcgaccccaaggagtacggcaccaactccgaggcggtggtcctcatcaacttccaggaccgcgagatcctcatcgccggcaccatgtactcgggcgagatcaagaagtccatcttctcggtcatgaactacctcatgcccgtggaggaggacatcctgcccatgcactcgtccgccaacatggacccggtgacgggcgagacggcggtgttcttcggcctctccggcacgggcaagaccacgctctcggcagacccgcagcgcatgctcatcggcgacgacgagcatggctgggccgaggggagcgtcttcaacttcgagggcggctgctacgccaaggccatcaggatctcggcccacacggagccacagatctacaacgccatccgctttggcgcgctgtgcgagaacgtggtcgttgaccccgtcacgcgcaggcccgactacttcgacgactccctcaccgagaacacgcgcgtctcgtatcccatcgactacatcgagaacgcccaggtcatggggcagggccgctaccccaacgtgatcgtgttcctcacctgcgactcgtttggcgtgctgccgcccatctcgcggctcgaccgcaacggcgccatgtaccacttcctcagcgggttcaccagcaaggtcgcgggcacggagcgcggcgtcaccgagccgcaacccaccttctcgacgctgttcggcgagccgttcatgcccctctcgcccctgcggtacgcggacatgttcggcgagaagatggagaaggccggcacgcgcgtgtacctgatcaacaccggctggacgggcggtccctacggggtggggagcaggatggacctcgcctccacgcgcatcatggtgtccgcggctctggacggcagcatcgaggagagcgagttcgagcgcgaccccatcttcaacgtggacgtgcccacgcacgtggagggcgttgaggaccgcgtgctcatgccgcgcaacgcctgggccgaccgcgacgactacgagcgctgcgcgcgcaaggtcgcccgcatgttcgaggagaacgccgcgcagaagtaccccgacatgcccgaggaggtttgcgccgcagggccgcacgcctagcgggcgagacgacacgaccgctcgcgccccggtaatgaacgctcggtgagctgggccccgcacctatgggatgcggggcctactgttttgagccgtccgcccccatgggggaggggtgggcaggcccatgcggccacggaaaggagaggctttctatggcacgaatgcacgtaatggagagaagcgaggagcaggccatcatggacgagctccacgcggcggtggggcggcggctcgcggtgagctcgctcgcaccgtgccccgtggagttcacgatggcgttcgtggacatgtgctcaacgcagagctgcggcaagtgcaccccgtgcagggtggggctcaacacgctgcggcaccgcctgagcgacgtcctgaggggcagggcgacgatggccacgctcgatggcatcgagcgccttgccaggaccatctacctgtcgagcgactgtgcgatagggtacgaggcgggggccatggccctcacggccatccagggctttcgcgacgacttcgtccaccacgtgacctaccacgcctgcggcttcaagcagtccgagaaggtcccgtgcgtgtccggctgccccgccggcgtggacatcccgggctacatctcgctcgtgagggcgggtcgcaacaccgacgccgtccgtctcatccgcaaggacaacccgctgcccatggtgtgcgggctggtgtgcgagcatccctgcgagatgcactgccgccgcggcatggtggacgaccccatgaacatcagggccatcaagcgcttcgcctgcgagaacatggagtccgactaccgccccgtcatggcggagcccacgggcaagcgcgtcgccgtggtgggaggcggccccgcggggctctcgtgcgcctactacctggcggtcatgggccacaaggtcaccatcctcgaggcccgcaggcggctgggcggcatgctccgctacggcatcccgagctaccgcctcccgcgcgaggagctcgacggcgagatacggtggatcctcgactgcggcatcgaggcgaggacccagaccgaggtcgggggagacgagctccaggcgctgcggcgcgactacgatgccgtctacctggccatcggcgcccatggggaccgcaagctggggcttccgggcgaggatagcgagggcgtggagagcgccgtcgcgatgctgcgcgccatcggcgacggggacatccccgacttcacggggcagcgcgtgtgcgtcatcggtggcggcaacgtcgccatggacgtggctcgctccagcgtgaggtgcggcgcgagcaaggtcaacatcgtgtaccgccgccgcgtgcaggacatgactgctcaggacgaggagatcgccggggccggcgaggagggttgcgagctccttgagctcaacgcgcccgtccgcatcgaggcggacgaggcgggccgcgtgtgcgggctggtcgtgcagccgcagatcatcggctcgttcaagggcgggcgcccctctccccggcccgcggacacgggggagaggaccatcccctgcgaccgcgtgatcgtcgccatcggccaggcgatccagtccgagcccttcgaggaggcgggcgtcggctgcaaccgcggtcgcatcgtcaccgacacggacgggcgcgtccccgggatggacggggtcttctgcggaggcgactgccaaagcggccccgcgaccgtgatcagggccatcaacgccggcaaggtcgctgcgggcaacatcgacaactacctgggcttcgaccacaaggtcggcgtgcccgtcgacatcccgcccgtcgagttcagggacgtgggcccgtgcggcaggtccgagaccaagttccgcgaggcaaacgagcgccggcacgacttctgtcagatcgagcacggtctttcgcgcgaggaggcgctgcaggaggcctcgcgctgcctgtgctgcgaccactttggattcggcgcgttccgtggggggagggagctccagtggtaggaaatggcgaaggcctgaaggctgccgaccagagggcggtctccaccgggcaggtcacgctcaccgtggacggcagggaggtcagcgtccccgccgggtccaccatcctggacgcgtgccgggaggcggacgccgacgtcccgacgctgtgctacctgcgcgagctcaacgagatcggctcctgccgcgtgtgcgtggtcgaggtcaagggctacgaccgcctggtcgcctcgtgcaacaacctcgccgtggacggcatggaggtcctcaccaacagccccaaggtgaggatggcccggcgcaccaacatggagctgctcctctcgcagcatgacgtggcatgcaccacctgcgtgaggtcgggcaactgctcgctgcaggaggtcgccaacgacctgggcatcgtcgacttcgagtacgacaccgacctgccgcccaagcgctggccgcgcgacttcccgctcatcaggaacaaccagaagtgcatcaagtgcatgcgctgcgttcaggtgtgcgacaagatccaggcctcccacgtgtgggacatcaccaaccgggcgacgcacacgctcgtggacgtggccggcggccgcgacatccacgacgtggactgcaccctgtgcgggcagtgcatcacccactgcccggtgggcgccctgcgcgagcgtgacgacgtcatgaccgtctacgacgccctggcagaccccgacgtcaccaccatcgtccagattgcgccctcggtgcgcacctcctggggcgaccactggggcctcaagggcgacgaggcgaccgtggaacggctcgtggcggccctgcgccccatgggcttcgactacatcgtcaacaccgacttctccgccgacctcacgatcatggaggagggcagcgagctcctgcgccacctccccaagtcgcaggcgggcggctaccccatgttcacgtcgtgctgccccggctgggtgcgcttcgtgaaggcgcactaccccgagcttgtggacgacgtctccaccagcaagagcccccagcagatgtttggcgccatcgtcaagagctactacgccgagtacctggggctcgacccgcacaagatcttctcgctctcgatcatgccctgcgtcgccaagaaggcggagtgcgcctatcccaccatgcgggacgcgtgcggcgacccggacgtggactgcgtcctcaccgtccgcgaggtcgagcgcatgctgagggccgaccacgtggacgtgcgggccctgggggaggagcccttcgacgagcccctgggcatcggcaccggcgccggggtcatcttcggggccaccggcggcgtcatggaggccgcgctgaggaccgcccactacctggtgacggggaaggcacccgccgccgacatgttctcggacgtccgaggtctcaggggctggaaggaggccaccttcgaccttgcgggaaccaagctgcgcgtggcggtcgcgagcggccttgccaacgcggacgcgctctgcaaggcggtcgtcgcgggagaggtgtcctacgacttcgtggaggtcatggcctgccccggcggctgcgtgggcggcggcggccagcccatccacgacggggaggagcttgcgggcgtgcgaggcaaggcgctctacgggctcgacagggtctccaagtaccgcaactcctacgagaacccagacatcgtgaggtgctacgaggagtacctgggagagcccctctcggagagggcggaggagctcctgcacaccgaccagcacgggtggctcatgccgtccgagtggatcgcggcggcggaggcggcgccccaggcgtaacgggatggaaccaaggggggagggcccgcgcggttttcgcgcgggccctccccgtgtgtctcgcccatgagtctcctgcgaggtgcctgccggcctaggcctgcttggcggccatctgtgcctggaccgcggtgatggcgacgacgcccacgatgtcatccgccgagcagccgcgggacaggtcgttgaccggcttcgcgatgccctggagcagggggccgtacgcctcggccttgccaaggcgctggaccagcttgtagccgatgttgcccgccgcgaggtcggggaacaccaggacgttggcgtgacccgcgaccttggagccgggcgccttgagcgaggcgacctcggggaccagggcggcgtcaagctggagctcgccgtcgcaggcgaggtcgggggccttctcggcaaccagggcagcggcctggcgcacgcgctcggcggagtcaccgccggcggaacccttggtggagtaggagaggagcgcgacctcggggtcggtgcccatgaacgacttccaggactccgcggaggcgatggcgatctcggacagctggtcggcgtcaggcgcgatgttgaggccgatgtcggagaagatgaaggtgccgtcctggccaaactcgcagtcggggacgatgaccatcatgaagccggacacgagcttggtcccgggtgccgtcttgaggatctggagagcggggcgcagcgtgttggcggtggagtggcacgcgccggataccaggccgtcggcgtcgcccatcttcaccatcatggtgccgaagtaggtgttgtcgttcatctgctcgcgggcctgctcgatggtgacgcccttcttcttgcggagctcggcgaaggcctgggcgtactcctcgtgcttgtccgacgccttggggtcgaccacgcgcgcgccctcgaccttgacctcggtggggtcacccaggatgaccaggttggcgagaccctccgccacgatcttctcggccgccgcgatggtgcgcgggtcctcgccctcgggcagcacgatcgtcttgcggtccgccttggcgctctctttcatcctctgaagaaaatcactcatagaacctctccttcgtgacgcctccaactgcgtgtggacgtgccgcccgaccacaaaatatgcatgtcggctgcgtatttgacggcactctaaaacattatagggcggcgtgttagaatcgactccgtaatcgagccgggggagcgtgtgcgcctgccctcaactcgatttatttatgtccgcgtccagggccgccccgggcggtagtctgcatcgaagggaatccacatgagcatcgccaaagggttgcccgagggctttaacccctccgcatacgacgcaatcgtcgtcggggcgggctacgccggagcggtgtgcgccaggcggcttgccgaggcgtgcgggtacaaggttgccgtcctcgagcgtcgcgaccacatcgctggcaacgcgtatgactactacgacgaggcgggcatcctggtccacaagtacgggccgcacatctaccacacctacaacgagcgcgtgaaccagtacctctcgcgcttcaccgactgggttgactaccagcacaaggtcctggcaaacgttcatggcaccctgatgccggtccccttcaaccacacgtccctcaagctggcctttggcgaggagaagggcgagcacctgtaccagaagctcgtcgctgccttcgggcaggacaagaaggtccccatcatggagctgagggccaagaacgaccccgagctcgccgaggttgccgactacgtgtacgagaacgtctttctccactacaccatgaagcagtggggcaagacgcccgaccagatcgatccggccgtcatgggccgcgtccccgtgttcgtgggtgacgacgaccgctacttcccgcaggcccccttccaggggatgcccaaggacggctacacggccatgttcgaccgcatgctcaaccacgacctcatctcggtgttcaccggcgtcgacgcccgcgacatcctgcagatgggcggcacgtcggtcaaggtctgcggccagccgtttggcggagaggtgatctacaccggcgccctggacgagctctttggcatggaccttggcgcgctcccgtaccgcacggtcgacatggtgttcgagaccctgcccgtcgatcagttccagcccgtggggaccgtcaactacaccgtgtccgagaacttcacccgcatcacggagttcaagaacatgaccggccaggtcgtgccgggcaagaccaccatcatgcgcgagtactcccgcacctacctgcccggcatgggcgagacgccctactacgtcatcaacgagccgcagaacatcgagctgtaccgcaagtacctcgagcgcgtctcgggcgtcctcaacttccacgtggtcggacgtctcgccgagtaccgctactacgacatggacggcgtcgtggcctccgcgctcgagctctcggacgagatcatcggaaaccactaggcacaaccgagtacagaggcaccaggtcaacacatgcagaagaccatcacgttcggcatcccgtgctacaactcctccgagtacatggaccattgcgtcacgtccatcctggaggggtcggactacgcggacgacgtgcagatcgtcatcgtggacgacgggtccaccaaggacgacacgctccagaaggcactcgactggcagaggcgctatcccgagatcatccaggccgtgcaccaggagaacggcggccacggcatcgccgtcctcaaggcgctggagcacgcggagggcgcctacttcaagatcgtcgactccgacgactgggttgacggcgacgccctgcgggtcctcctcgagcgcctgaggatgttcgtcgactacgagaccagggtcgacctcgtggtcaccaactacgtgtacgagcacgtggccgagggcaagcagaaggtcgtcgactacgggttcgcgctccccaagggcaagatcatcacctggaagagcatcgggcacttcaacatggcccagaacctgctgatgcatgccctgtgctaccgcaccgaggtcctgcgcgacggcgggctgcccatgcccgcccacacgttctacgtggacaacatctacgcctacgtgcccctgccgcgctgccagacgctctactacctggacgtcgacctgtaccgctacttcatcgggcgtgatgaccagagcgtcaacgaggacctgctcgtctcgcgcgtggaccagcagctcagggtcacgcgcgtcatgatgcacgcataccacctgtacgacgacatcgacacgcgggagctgcgcgactacatgatcgggcacttcaccctcatgatggcggcgtgctccatcttctccaagctgtccaaggatccccaggcagagcctcggctcgaggagctgtgggaggagctgaggcagtacgaccgtcgcatgtaccgtcgtgcgcgccacggcctcgtggggaccgccatgaatttcaccggcgagggtggcaagaaggccacgatcatcatctatcgcgttgcccagaagctcgtcaagttcaactagtcgatgctgatgctgcgactccgcggtgtcgatgccccaggcctttcggaaggccccgcgtatcagcaatcgaaccattgcgaccggagcccgatgtgagcgcatccccttccctggcgcgctcggctgttccttgcttgccctgctggcagtccgccagagtaccagccttggcaaaagccgcccgatgtgagcgctcacatcgggctttcgttgccatttatgcccgaaacggcggcgggatggcagggaactcccgatgtgagtgcaattatcgggctttcgttgccatcggtgggtgggtccagggactgtccactgcgtcacctgcgcaaacgtcgggatgcctcagccggatgccgaagagccagccctcagactgctcacatcgggcatccgccgccacttcgtccgcccgttcccggctcgcaagcgctggctgccaaccctggagacgggcgggggagggaatgcccctcgctctcatccacttcctggccattggggccccggactcgaccttgccgggaatcgggtctcgcgtgtaaacgtgggagaccttctgccggcgggatgggtggggagaacgtccatgcgcccctctccccacccttgtgctagccggccaggtcgcaagccgccttgagcccatgggccccccgggcatgcagcgccgccgacacgatggcatcctcgagcgcctgcgtcgccgtgacgcccaccaggtccaccggggcctccacctgacccgtcgccatcacgaagatcgtgtcgccgtcgttggtggtgtgggtcgggcgaatcgcatgcgcgtaggcatcggcggacatctgggccaccttggtcgcctgtgccttggtcaggcgggcgttggtcaccacgcacgagatggtcgtgttggtccgcaggggcatggacgccgccgcgtcatcccacgcctcctccggcgtcatgatgctgtcctgggtgggggagaggaccccggcgacctgggctcccgtcttggggtccacgacgttgccacaggcgttgacggcggcgatcgccccgcaaacgagctccccccgcgtggcgacggactcccccagaccggacttcatgcagcgctggggcccgcagagctttcccacggtgcagcccgtgccggcgcccacgtttccaagcgagaggggcgtctcctcgcgtcccagggcgcgcctgactgcctccgcccccatccgggcgtcgggccgcacgtccgccctcccgcaggcgaggtcgaacacgcaggcggacgagacgatcggcaccacgcccacgcccacgtccagcccgatgccgtgccgctccagctcctccgcggccccgcaggaggcggcaaggccataggcgctcccgccggagaggaccacgcagttgagggcctgaaccgtctcctccggcctgaggaggtcggtctcgcgcgtcgccggggcgcctccccgcacgtccaccgcgccggttgcgccctccgggcacacgatgaccgtgcagcccgtccccgcctcggcgttggtcgcgcttgccgcatagacccctgggatgtccacgatgctgcggatgctcatttcgtctcccctccgtcgccggcggtgccgcccatgtcgcccgagagcgccccctcgaggagtccacgcccctcggggaacgcgtcgccgagctcgcgcaccaggcgcgagacgggaagccccaccacgttgctgtagtcgccctcgatcgcgcgcacgagcaggcggcccctgccctggatgccgtaggcgcccgccttgtccatgggctcgccgctccgcacgtaggcgtcgatctgcgcgtccgagaggtcccagaacagcacccgggtcgtctcgacgaacgagcggcgcgtcacgtccccgctgccgtcggcgcgggcgacgcagacccccgtggagacgcggctctcccttcccgagagcgccctcagcatgtggtgcgcctcggcggcgtcccgcggcttgcccagcacgtccccgtcggagtcccacacgatggtgtcggccgccagcacggtctgtccgccgtcgcggacgacggggtccgccaggcacgagtcggccttcaggcgcgcgagacgctccaccagccgctccggcggctcgcccgcatggcgcgactcgtccacgtcctgcggcatcacatggacctcgatgcccagctcctctaggagcctcctcctccgaggagagcccgatgccaggatcatcgcctcacccccataaaaaatgggaaccaccgagttggctcccatgcaacgacatgtcgtctcgtcccgaccagcgggctactcgacggtgatggcagagacggggcagttgtcggcagcctcctgcgcgctgtcctcgttctcctcggggacctcgtcgacgatgacctccgcggtgccctcgtcgccgatggagaagacctcggggcaggtggactcgcacagaccgcaaccgatgcaatcctcgctgacagtagccttcatgattatttcctctcactccgatgggccgggccccttacccgtgcccttcctgcttctttttactattactcgtgcacggatgctagccccttttctcggagcggccaaaaggactccacgccatgccgaagtcccttttgcgggggagagggaaggagcctctcacctgcgacgacgcagacgtgcaattatggtttgacgattggggggaaacaaggtggccgcgtggattctcatgggcgaagggggccactccctcgccgctctacggttgccgcacacgcaggggcgaggccggctgcgatcaagcccggcgggcggcagccggacatgctctggggacgcaagccttggccaaccagtgcctgcctcccgtccccccaagagatggggcaagtcgttatgagcaatagccgtgccgtatatataattgagcccatttcaaattctcttttcgaaggaaaagcaatggtttgggtgtttgaatatgcatattcggcgctgttgttgcagtgtctgcttctcttcttctacctgctcggcaagcagctccccacatatcaaaatatctgcttccgcaggattctggaaacgggttgcgttaccacgacgcttgatattgtgacctgtatcatgttggagcatgtggattcgactccgccctggctgctccacggagggctcatatccttctatattttctttcttctcaggatgtacctcctgtttgagttcaccctttgtctgacaggagtgaagtatcgcctcggcaaggctgccgaaaggctgtttgagattccgctcctgttgttttgcgccttgacggtgacggcaccatggacgcacttcatttaccggattgcaccagatggagtgttctggcactctaggtcctatttctctctatacgtgacgtttgcgatctacctcgccttgtgcctctatctggtcattcgctaccgcaagcgacttcgaaagcttcagttttttgggtacatcgggttttgcggacttctgacgctcggaagcatttcgcgcatgtacaacgacgacaatctgtccatgaacctgttctacgccattgcgatcatggttatctatctaacgattcaggatccgagcaggtatctcagggggaacaacacattcttcaaccaagaggggctgtacgatctggcctttgaccacatcgagcggaaccaaaagatggcactaatgtgcctgagggtcaacaactacgaggaggtcaagtcttccgtcggaaagcgcggcggcgtcggcatgcaagagaacgttgtggagagcttcttccaatccatgcctcgcccgatgatcgttttctatctgggaaacggctgctttgtcttggtcgaccagggcgaaaccgaggaggaggcgttccgagaggcggtggacaagtacttcaacgaccccgttgacccctcggacgagctgctgacgatgaaggccgccacggcgtatatcccggcgagcatgcccaaggccagcgtcggcgagctgctcgctgccgtcaactacctgttttcggagctgcgggcgcgggggcgcgagtcccggctgatgggggatgcgcacacgctacggaaaatggagcgggatttcgaggtcgacgaggcattggagagaacgattcgcgatgcctcgattctgttgtactatcagccgatttattcctgcagcgagcatcgcttcacctcagccgaggtgctttcgcgaatagaggacgagaagctcgggttcctgatgccggtggacttcatcgagaatgccgagcggagcggcagcatcatgcggctcgaccaattggtgtacgagaaggcctgctcgttcatccagcgcaacgaccttgggaagattggcctggactacctggaggtcaacctctctcccgtctgcggcagccacgagggacttgaggacgacctcaggcggcttgcggggaagtacggcatctccctgcatagcctcaacctcgagataacggagtccgccgcctcggacatgatgcagatgtcacgctacatggaggcactgggaagcgaggggatgaagttctcgctggatgactacggaactggcttctccaacgtgatcaaaatcatgagcctgccgttcgagatcatcaagatcgacaagtccatcgtctggtcctacttcaggggcgagaacaattatctgaagagcatcatcggcaacttcagggagcaggggttcaaggtcctggcggagggggtggagacggaggagatggcgtcggagcttgagaggctcggatgcgactacgaacagggcttctactactccaagccgatttgcgagaccgagtttctgcggttcctgcaagagcagtagggacgggggacgcgccccgttgaccacgagggtgtgaacccccatgcccccgttggacctggctcccgaaccgttccgtcctccggccgccggccctagggggcatctgccgtggccgtcccctcaccgtagaggtgaggccgccaggtctcgtgtcgggtgggactgggtcgcgcattggagctgacggggttccgtcaggcaacagggaatgttggcgacccgctgctaacgagtgcgcgtcagcagcgtcacggtctcgacgtggaaggtctgcgggaacaggtccacgggtgccacccaggcgggggagaagaccccctcatccgcaaagcgcgtgaggtcgcgcgccagggtcgccgggtcgcacgagacgtaggcaattgccctcgcgggctgttgggacagcttgcgcaccacgcccgcggcaaggcccgccctcggggggtcgaccacgatcacgtcggcgtccgcgtcggggaactccaggtccgcgtcgccgcccactgggtccacgttgtccaggccggcgcgctccaggttcctcctgaggtcgcgcacggcgggcccgtacgactccacggcgtcgacccagtcgcagcgacgggccagcggcagggtgaaggtccccgcgccactgtagaggtccatggcgcactcgccctcggcggggtccagcccctccatcaccaggcgcaccagctcctcggccccgcgggtgttcacctggaagaacgagggggcggagaggagcatggactcgccgcccacgcgctcctcccagctgccgtagccgcccagcttctccagtcccgacaccttgcgggccttctgcggccccttggtgaggaccctcaccaccgaggtggccccggtcgcctcgcgcaggatcttcgccgcctgggcgcgcgggaagcccccggtctgcgtccagagcgcgacctcgacctggcgggtcctcctcgaggcgcggacgcccacgcggtcgatctggagcgagcgcgagttcgagaggtacgagagcgcacccgagacggacttggtcaccttctcgaagccgcgctgcagcagggggcagcggtcgaccttgaccacgcgctcgcccgtgacgtcgtgcatgccgatcacgctgcgacgtccctgggcctggaacgcgagctcgaccttgttgcgatacccccaggcgtcgccggggtcggagcacggccgcacgagcccctcggcgtcgtcctgggccatgtggccgatcctcacgagggagtcgaccacgttgccgcgcttggagtgcagctgcgcctcgcgggacaggtgcgcccacgggcaccccccgcacacgtccacaaaggggcaggggatggtggagacgcgctcgggcgacgcctcgagcacctcctccaccacggcgttggagtacgtgggctgctcgcgcgtcacgtgcgccctcacgaggtcgccgggcacggcgccccgcacgaacaccgccttgccgtcgtcggcgtgggcgatggcgtcggggccgtacgtcatccgaccaacgcgcagggtcagggcttgctcgcttccggcgggttcggtcatgcgggtcctcctcgcgtctagagttgggcggccccaccccgcctgggggaggggccgcccgctgcgagtcccatcatagggtcatcgcgcgcccgggcgggggcggaggcgctatctaccggagaagagcatcctaaagccctcgccgatgagcctgaggccacgggagaggcgcccctctccctcgccgtcgtcctccggctggcgcgtcgcgagtgacgtgctgggcgacggctgcgtggcgcggtgcgccggggcctccggggcggcggtggctgccgcagacggcttcccggatgcggccctcgccgcctccgtgggcgccggcttcgccatcgccacgacgtcggcctcggccgtggagtaggtgccgatgttggggaggctcaggagctgcctcttcatctcggaggtgatcctgggcatgatggacgaggcgggcgtgacctcctcgctcgccctgtcgtcgccctcgtgggcacgcaggtaggccagctgcagcagcacctcctggctgttgatgcgtggcgtgccctcctccacggggatgcgctcccaggtgccctcgctcgtcaggcggcgtgccttgacgttgtcggcaagctgcaggctcatgtactcgatcacgagctcgcggcacgtggggtcgagcacggggtaggctatctccacgcgacgctcggtgttgcgggtcatcatgtcagcggacgagaggtacacggtgtccgcgttgacgccaaacgcgtagacgcgcgcgtgctccaggaagcggccaacgatctggcgcaccacaaggttgtcggtcttgcccgggatgtttgccttgatgcaggcgatgccgcgcacgatcatgatcacgcgcacgccagcctcgcacgactccgagatcttgtcgattacgtcgcggtcggtgagcgagttcatcttgaggaacacctgagcgggctgtccggcgcgggcgcgctcgatctcgcggtcgaggccgcgcatcacgagcggcttgagccccgcgggcgcgacccccaggtagcggtagttgcccagcaggttgccgatcgagaggttgcggaagaacagattgccgtcctcgccgatgccgtggtgggcggtcagcagcatgaagtccgagtacaggcgtgcagtcttctcgttgaagttgcccgtgcccaggcaggtgatgcggctgatggcgcccttgtcgtggtaggtgatctggcagatcttggagtggcacttgaagccctcggagccatagatgaccgtgcagccggccgactcgagccgctccgcccaggcgatgttgttcgcctcgtcaaagcgcgcgcggagctccatcagcaccgtgacgtccttgccgttctccaccgccgcgatgaggctctcgcagaggtgcgactgcttggccacgcggtagagggtgatcttgatcgagatgcagtcgtcgtcggaggatgcctcgcgcagcagcgtcagcaggggggacatcgactcgtaggggtagaagagcaggacgtcgtggtcctcgatctgcgggcgcatgggctcgttcatgttgaccatgggcgagatctgcggctcgaagggctggaacaccagctcgtcgtggcgctgcgtggggatgtgggactccaggccatacacgaagcccaggtcgagcgggatgttcacccgagacaggcggtcggggcgcagccccagctcgtccatcaccagacgctccaggtcctcgtcgagcgagcccctgatctccaggcggatgggctgcagtcgctggcgcttcttgagcaccttcttcatgtgctggcggtagtcctcctcctcctcgacgccctcgccgtccgggtcgatgtccgcgttgcgggtgaccctgatggtcgccgcgcgggtgggctcgtagtcgccgaagcagctgcccaggtaggtgtagatcacgtcctccaggagggtgtagcggtattcctcgggggtcgaggggagcgcgacgacgcgggggagcgacgggggtacctccacctggcccaggacgccccgctcggtcggcccgtcaagggagcacagcacgtagagcaggccgttcctcaggttggggaaggggtggcgcgggtcgatgatcaggggggagatgatcggggccacgttgcgctcgaactccctctcggtggcctctcggtccgcctgggtgtactcgaggggagggacgtaggtcagcccgtggcgcgaaagctcgccggtcacggcgttccacgcctcctcctggcgtgcgagcaggccaggaagcattctgaagaccgaggacagctgctcggagggcgtctcgttggacttgttgtcggtgggctggtgcttgagccgcgcgaggtcggaaagcccgcccacgcggatcatgaaccactcgtcgaggttggagccaaagatctcgacgaacttgagcctctcgaagagcggcacgctctcgtcgaaggcctcgtcgagcacccggtcgtcaaagtggagccagctcacctcgcgattctgcgtgtacgagaagtcccgctcgtggggtcggccccccttctcggcagccgattcctgcacgaactcccccttgttggccatctgttcctcccaagaatcacctgcgaatgccagtgcggtcattctaatgcttggggccaaatgggagatcttggcccaacctgcgggagaattgaataatgatggataataataagaaagaatagaatattaactgcttgttacacgacttttatgactcaggtggaataagagcgacagttcttgcgaactcctggacaggtaagcatatggtaatgaatacgcagctcaaccaccttgatatttcgaacgtgacgtgcaagcagaccgctcgtcctcgtaaacctaccgttcccacttctaaatgaaaacaagggtgacgtagcgccaagtattggatatagtgtttctcggcgttaagacgcccgccgcgagccggacgaagaagccgcagcatttcgagcctggcgagcacgtgggtaacgtattcgtaaagtgttggtaaggtgccagcacgaaaggagaaggaggaaccatggctaacgggctttacgtccacagcgaaattggccccctgaagaaggtcatgctccacaggcctggtgaggagctcctcaacctcacgcctgatgacctcgagcgccttctgttcgacgacatccccttcctggaggtcgcacaggcggagcacgatcgctttgccgagatcctgcgtgagcagggcgtcgaggtcctgtacctcgagaagctgacggcagaggccctggacgccgttcccggcgcccgcgaggagttcaccaaccagtggctcgacgagtccggcctcaagggcaaggctgcccgtgccgccgtcaaggagtacatggactccatcaaggacaccaagaccttcgtcgacaagacgatcgccggcctccgcaaggaggagatcgacctccccgcgaccagctcgagcctgctcgccgacctcgtcggctctgaccaggacggcgagaccgacctcctgatcgaccccatgcccaacacttacttcacgcgcgacccgttcgccgtcgtgggcaagggcgtcaacctcaaccgtatgttctcggtcacccgtaaccgcgagaccctgtacggcaagttcatcttcaagtatcaccccgactacaaggacgcccccctgtggtaccgtcgcgacagcgcgttccacaccgagggtggcgacgtcctcaacctcaacgcccacaccctggccatcggcatctcccagcgcacccaggctggcgccatcgaccagctcgcccagaacatgttctgggagaagggcgacctgtgcgagatcgacaccatctacgcgttcaacatccccgtgtcccgtgccttcatgcacctcgacaccgtgttcacgcagattgacgtcgacaagttcaccatccacccgggcatcatgggcaccctgcaggtcttcaagctcaccaagggcgctcagcagggcgaggtcaagatcgaggagatgaacgacaccctcgagcacgtcctcgagaaggctctcggcctcgatcaggtcaagctcatcaagtgcggtggcggcgaccccgtcgcggctgcgcgcgagcagtggaacgacggttccaacaccctgtgcgtcgcccctggcaagatttgcgtgtaccagcgcaactccgtcaccaacgacgttctctacaaggagggcctcgaccttctcgtggttccctcggccgagctctcccgtggccgtggcggcccccgctgcatgagcatgcccttcgctcgcgaggacctctagtctctcggatagcgtgaagtccgggggcgcccttggcgccctcggactactgctgtcgagcaagtatcagtgttctaaccgatggcacagggctgtcggttgaaaacgaaaggaacgtacatgggcgtcaatcttagcggtcgcagcttcctgaagcttctggacttctccaccgaggagatcaactacctcctggacctctcccgtgacttcaagaacatgaagcgcgctggcgtgccccaccgctacctcgagggcaagaacgtcgccctcctcttcgagaagacctcgacccgtacccgctgctccttcgaggtcggcgcctatgacctcggcatgggctgcacctaccttgaccccagcggctcccagatgggccacaaggagtccatcgccgacaccgctcgcgtcctcggccgcatgttcgacggcatcgagtaccgcggcttcgagcaggagaaggtcgaggagctcgccaagtacgctggcgtccccgtgtggaacggcctcaccaacgagttccaccccacccagatgctcgccgacatcctcacgatgaaggagaacttcaacaacgacatcaagggccgtcagctcaccttcatgggtgacgcgggcaacaacgtcggcaactccctcatggtcgtctgcgccaagctcggcgtcaacttcgtggcctgcggccccaaggacaacatgcccgaggccgagctcgtcaagacctgccaggagattgccgcccagaacggctccacggtcaagctgaccgaggacgtccacgagggcgtcaaggatgccgacgccatctacaccgacatctgggtgtccatgggccagcccgacgagctctacaagacccgcatccccctcatggagccctaccgcgtcacctctgacgtcatgtcccaggctcacgatgactgcatcttcctgcactgcctgccctccttccacgacaccaagaccaccaagggtgccgaggtcgcgaagaagttcggcatcaccgagatggatgtcaccgacgaggtcttcgagtcccgtgcctccaaggtcttcgacgaggccgagaaccgcatgcacaccatcaaggccgtcatgtacgctaccctcaagtaagtagcgcctcaggaaatggcaaaggcctccccgatatttcggggaggcctttttcatgtcctagaaccatccaaatattgaatagatgaaatttgtttgcacacatggtgtgaactttatatacaatcattgaggttctgttggcttcatcgttcctgaggaggaaaacgatggcaaacaatgagaaggttgacaaccccgacggcgttggcttcttcggcctcgtcggcctggtcgtctcatcctgcatcggatctggcgtcttcgcccttaccggccagctcgccaacgtggcatcccctggtgccgcgctcgtggcatgggtcatctgcggactgggcttcctgttcctggccctctcgctcgccaacctgggtgcgaagcgtcctgacgccgatggcgtcgtcgcctacgccgaggagggctttggcaagttcgccggcttcatctccggctggggctactggctgtccgcatggctgggcaacgtcggcttcgccacgatggtcgcgcagacccttggctcccagtactgcctgggcaacatccttcctggcgtgttctccgaccccaacacgggcaaccccgccgtcgtgggcgtcatcgtgatctccctcttgctctgggcactgacctacctggtcatccgtggcgtcgagagcgccgcgttcctcaacgccattgtcatggtcgtcaaggtcgcctccatcctgctcttcatcgtcttcaccttcttcagcttcaaggccggcctcttcaccgccgacttctggggcaccgccgctcgcaacgccaccgtgctcgccgccaacggtgacggcctcggcagcgttggtacccaggtcaccaattgcatcctggtcatgatgtgggtgttcatcggcatcgagggcgcctctgtcatgagcaagcgcgctcgcaagaagtccgagattggttccgccaccatcctcggcctcgtggtgctgctcgtgctctacatctgcgcctccgtgctcccgtatggcgtcctcccttacaaggacctcgtcgcagcccccaagcccgccacgatcaccgtcttcgagtccatggctcccggttggggcggtgccttcatctcctgggcaatcatcatctccgtctgcggctcctggctctcgttcaccatgctgcccgcggagtgcacctcgatgatggccgaccacggcctgctccccaagtcgtgggacgagcgcaacaaggccaacgcgccccagatgtcgctcctcatcgtcgccgtgctgaccgagatcttcatcatcatcgcgacctttgcggccgatgcctacaccttcgcgatctcgatgtgcaccgtcaccatcgtcatcacctgggcgttcgctgccgcctaccaggtcaagtacagcgttgagaaccacgagggcctccaggcgttctttggtgtccttgcactcctcttccaggtcgtcggcgtcatgttcactggctggggcttcctgctcctcgcctgcctgggttacatccccggcatgtacttctacaagaaggcacgcgaggagaacggtggctctgtcaccaaggcggagtgggccgtgttcgcggtgatcgccgtcctcggcatcatctcgatccccctcaccgcggtgggcatcattcccgtcttctagtttctcggggacatagctctgaaggggagggtcgccgatggcggccctccctctcttatgcggcgccttacgccccgttgccgcatgactgacacgatgtatgtatattgatgtcagaatttgcataatactgagcatatggttttctcgcatgcgcaatgggacgaagaggggagagccaatccaaccaatgcccgaattcccaggaatgcggttccagaatgcggagctggaaccccttcatttgcggtcgcggcaattgaatcgccgtcacgtactcgtatcggggtctgcgagtctctcatggcaccaaaatgggatattcatcgaatattggataccgttcacggcaacgcttgacgtaggggattgagccttgtgtaagatttgtttcgaagttgcgtaggttctgtctacgttgtgtttcgcaggagtttcagttccctaacgtatggcgcatgtgcgccgaaaggagttgcgaccatgtccgataagacagcgcagccaaagaagaagagggagatgctgacgtcattctccatcatcttcatcctcctggcgatcgtcgcaatcatcacgatctgcctcaatggtgcgacctacacggtcaatggcaccgagggcaccgtgacgggtgcgacgctggcggacttcctgatggcccccgtccacggcttcgcggacgccatcgacgtctgcctgttcgtcatggtccttggcggcttcctcgggatcgtcaacaagaccgaggcgctcaccactggcattgacgtgctcgtgcagaagatgaacggcaacgagctcaagctgatccccatcctcatggccatcttcgccttcggcggcaccacctacggcatgtgcgaggagaccgtcggcttctacgccctgctctccgcgaccatgatggcagccggctatgactccatgagcggctccatgatcgtcctgctcggcgctggcatcggctgcctgggctccacggtcaacccgttcgcgaccggcatcgccgcagatgccctcacctcgctcggcatcaacgtcaaccaggccgtcatcatcagcctgggcatcatcctgctcctggtctcgtacgtcatcgccgtcttcttcgtcctgcagtacgccaagcgcgtcaaggccgacccctccaagtcgctcatgagcgaggaggagaaggctgccgccgaggccgcctatggcaccgagaagtccgacgagaaggcatcgctctccggcaagcagaaggccgtcctctggatcttcgccgccgccttcatcatcatggtcatctcctttgtcccctgggaggacctgggcaacaacttcttcgtctctgacgccaagagccacgaggagaccaccgaggtcaccgctgacgacatcatccagcagtacagcaacgacaaacttggcgacctgaccctcaccccgtccaacgtcaagggcgagctgaagtccaccgtcaccgactatgccggctggtcgtccttcctgactggcaccccgctcggccagtggtacttcgccgagtccaccacctggttcctgctcctcgccatcatcatcggcatcgtgggcgggctctccgagcaccagatcgtcgacgagttcatggccggcgccggcgacatgatgtccgtcgtcatgatcatcgccgtctcccgtggcgtctccgtcctcatgagcagcactggcctggccaacctcgtcctgagctccgcttccaacgctctgcgcggcacctcgggcatcgtgttcgccatcggctcctacctgctgtacttcctgctctccttcctcatcccctcgacctccggcatggcgaccgtctccatgcccatcatggggcccctggccgcgcagctcggcttcaaccccgcggtcatggtcatgatcttctccgccgcctccggcgccgtgaacctcatcacccccacctccggcgccatcatgggtggcctggccctctcccgcgtcgagtacgcaacctgggtgaagttcgcgctcaaggtcgtcatctccatcgcggtcgcctcgatggtcatcctgtccatcgccatgatcgccatccccgcgtaggcttcggcacatacgcaaggaggggaggtcccacgttggtggggcctccccttttgcatggcggagcgaggttgtctgaatagcaggaagccggggtgggggagaggccccgaccccggcttcctttcagtgccgtagaggttgcctggcgctagtagaccatgcccatcgcctcgcgcacctcgtcgagcgtctgccttgcgacctcgttggcgcgcgcgttgccgtcgtgcaggacgtccttgacgtagtcgaggtcgtcctcgtaccggtgcctgcgctcgcggatgggcgcgaagtagtcgttcaccgcttgggtgacgtacttcttgagctggcccgagccacccatgccgatctcgtccgcaatctcgcgctcgtctcgcccggtgcagatcgccgcggtcgtgaggagtgccgagacaccgggacggctctcggggtcaaaggtgatgttgcgatcggagtcggtcttggacttcttgatgagccttgccgtctcctccgccgtcatgctcaggctgatggcgttgccgtagctcttgctcatcttgcgcccgtcgaggccgggaatgagcggggtcgacgtgaggagccctgcgacgtccgggaagaccttgccatagcgctcgttgaagcggcgggcgatcttggccgtgatctcgatgtgggggagctggtcgcgtcccacggggacgatgttgcccttgcagaacaggatgtcgcacgcctggtgcaccgggtaggtgaggagcaggccggtgagcgcgtggcccgaggcctcctgctcggccttgacggtggggttgcgctccatctccgcctcggtcacgagcgagaggaacgggagcatcagctggttctcgtaggggaccgccgagtgggtgaagatcatggtcttgcttgggtcgatgccgcaggcgaggtagtccatgaccatgttgtacacgttgtcgcggatgtgctccgtggtgtcgcggtcggtgatcacctggtagtcggcgatcacgatgttggtcctcacgcccagctcctggagcctcacgcgctccttgatggtgccaaagtagtggcccatgtgcagacggcccgtggggcggtcgcccgtgagcatggtgtacctctgggggttgaccttgaggtcctcctggatctggtcgcttcgcctcagagcggcctcgtagcttccttcgttgggcatgacgactccttgtgaatcaagcgtgcagaccgtaccatggtacgccaaacgctggccctcgggacctgtgggaatggcgccggggcggcctcagccctgggggagggtcgcgttgaggatggcgcgcgcctctcgccaggaggggtaggccgaatcgaggaggtcgtggaaccgctggttgtggctcggctctaggaggtggcacagctcgtgggcgatcacggagtcaaggcaggtcgaggggagcgaggcaagctcggcgttgatggtgatgacggaggtgcgcacgttgcacgagccccatcgcgaccgcatgtagcggacgcgccagccgctgcacgcaacgcccagccgttcctcaaggggcggaaagcgggtggggagctcgctcgagagcgcccgggcgagccatgaccgtccgaggtcacgtgccaggcccgtgtcttcatcagtgggcggaagcaaaagctgcagatcgtcgcccgcacgtctgactcctggtgcgggcgcctcgcgaacgaccctgacggcgagcacctcgtcgaggaaccggaccttgccgccgtcctgccagcgggaggcctcgcgacagcgggccgcatcctgtctctcccgctgggagcgtatccaatcttcctttgaggcgacgaatgcgtccacgtccgacagcctcgctctggtgggcgcgctcacgaccacgtcgccgtccgccctcacgcgcaggttgacgcgcttcaccccaccgcggcgcagggtgtatggcgtttggcccccctgacgttccgtcacaacgatatcagcacgtcgcatggctttcacatcgctttctgccaccttttgccttgccgtttgcccccaagttgcggccccgtcgtcacgggcggacgagaaacgaggataatgtatctggcgttcggaggaagggggacgatggcgagctcatacggcgaggacgcgagcaagagcgcactgcgggagcgttatcttagcgccggcgcatcgctctcgccccggcagcgcgcgaggttcgacatccaggtgtgccgcaacctcagggccgtccccgcctatcgctcctgtaccctgctcctggcctacgtccccttcagggacgaactcgacacggcctccatcatccggcgcgcctgggacgaggggaaggacgttgcgcttccccgctgcgtcggaggggagagatccctggagttcgtggtcgtgggcaccctcgacgggctcgtgcgtggtgcgagcggcgtcatggagccggcggagggggcgggcgatcccatcgacccggcgcgtctccccgagtcggtctgcctggtcccgggactcgtgttcgactcccgcgggtaccgaatcggctatggcgcgggctactacgacaacttcctggcgacctaccccggcaccaaggtggggcttgccaggagcctgcaggtgagcggcaacccgctccccgtggatgggcatgacgtcgcggtggacgtgctggtgagcgacggggccgtctggatgtgccgctagcgcgcgggtggcacatctccccttggccctactggtcgtcctcgtcctttgccaggtgtgccgccaggtcggcgatggccttggcgtagcccttgacccccagtcccatgaccgtctcgaagcaggcggccctgacgtacgagacctgcctgaacccctcgcgctcgtccaccttggagatgtggacctcgaccgcgggtatgctcaccgccttgagggcgtcgaggatggccacggaggtgtgcgtgtacgcgccggggttgatcacgatgccgtcaaagcgcccgtaggcgtcctgtatggcgtccaccaggtcgccctcgtggttggactggtagcacctgcagacggagaagccctcctcctcggccgcctcgtggcacagctccagcaggctgacaaagtcctcggtgccgtacaggtcgggctcgcgaatccccagcatgttgatgttggggccgttgaggacgaggagacgggggccgtcggtgggctccacggcctcctcgctggcgtcgtcggcaaagtcgtcgtcggggtcgtcctccacgccggcgagcatccgctcgagctcctgtgcctccgagccgccgtcctccagctcccgggcgatcgccgtgggggtggggcgagcgggtgcccccgcacccgtcacgcgcacgttgagggagttgccgacgtggctgaggtcggcgaagctggagcggtccgcctgtccctggctggtgaggcccgagaaggcgtcgtacaccccgccgatggacttgggcccaaacacgacctcgatcccataggggccgcgtcccacggtgcccaggacgccggggatctgcgagagcccctcctggtcgaccagcgttgggttggcgatggtgatgcggagcctcgtcatgcagagggtgttggaggtgacgttggcgctcccgccgacgcagctcagtacgcgcgatgcaatttcctggtcgttcatgagaacagccttcttccgtcgcaagacgggctctggtcactcgcttactttcgaaacgaaaacgagtatagggatgcctgcggacggatgggccgtccgttccgcgaaatgtcgggatggcgtcgcatgcgggcgcgcgggtgcctcacaggcccaggagggccctcacgcgcgcggcatcgccctgcgggctgcccgtgcagtcgatctggacgtcggaccaggaatggtatgcctcggaccgctcgcgcgcaagctccctcacgccccgctcctgcgagatgggcctgcccgcgagcgacagctgaccgagcggccgctccaacaggacgatggtgccgttctggtggaggagggcgtagttctcccgcctggtgacgatgccgccgccgcaggagatcacgagcccgctgcgggcgcagtagcgcgaggcgaccctcgtctcctgctcgcggaaggcctcggtcccgtcctggcggatgtaggtctccaccggcgtgtcgaggtcgagggcgagggcctcgtccaggtccacaaagggcctgcccaggaggtgcgcaagcgtccttccggcggtcgtcttgccggcaccgggcatgccgatgaagacgacgttcctggtctgggtgcggatcctctccacgaggcgggggagaagcgcctggtcgagctcgtggccctggaacagctggctggagtagaacgcctgggcgacgagcatggggaggccgctctggaacggcacccccaggcgctccgcctggaggcagatgcccgtgcgctcggggttgtacaccacgtccagcacgccctgcaggtgggggagagacccaagcacgccatccgcgagcgggctcgccgggcaggaggggaacatccccacgggcgtggtgttcaccacgagggtcgcgtccgcgtgccggtcgagcaggttcgcgtaggtgtcgtcgccggagcgggatatcacgacgggcctcgcgcccgcctcctccagggccaggaccacggccctgctcgccccgcccgagccgaggacgagggccttctcgcccgcgagcgcgttggcggcggaaccgcccagttcctcctcgcagaagctgtcgaggagccaggagaagcccagaacgtccgtgttctcggcgaggatggtgccgtccttcctcctcaccaaggtgttggcggcaccgcacgcctcgacgcgcgggcttctctcgtccgcaagcctcgcggcgtcgaccttgtaggggatggtgacgttgaggccgcgccacgagccttccctcacgaagggggcgacctcctcgggctcgagttcgacaagctcgtaggggcaggagccgagcgcctggtggatctgaggcgaccagctgtgaccgagcgtgcgtcccagcaggccgaagggggcgcgccccttgccggcgagcggcatgctagaccacctccgagtagctgcccaggtagcgcacgtcctcgcaggcgtcgccgatggtcgcgatgagctccttgaactggggtgcggcgacggggcagtcaacgtcgaagtagaacatgaactcgaagtcgcggtcggggatcgggcggctctcgagcttgaagatgttgatgtcgagggcgtagaacttctccaggacgtggaagagcgcgccagggcggtggctcaccacgagcatgagggaggtgcggtccgcccccgggaacacctgcaggtcctttgagatgcaggcgaagcgcgtgtagttgttgcccttgtcctggatgtcgcgcgcgagcgggtcgagcccgtacagctccgcgcaggagctcgaggcgatggccgcgacgccggggcgctcgctcctcgcgaccatctgcgaggcgatcgcggtgttctcgacgacgtggaccgtgacgccgtggaggtcggagaggaactggtggcactggttgatggcctgctcgtggctgtacacgtcggtgatctcctccaggcccacgccgggcttggcgaggaggttgtggtcgatcttgaggcggcaggtcctcacgatgctgaagttgtggcgcatcatgaggtcgtagacctggttgaccgagccggcggtgctgttctccacgggaagcacgccgtactggcagaagccctcctccacggcgcggaagacgccgtcgaaggtgtcgaagaagctgatgtcggcatggtggaagatgcggtcgcaggctatctgcgagtaggcgccctccacgccctggcaggcgacgaaggcgtcctgggggaacaggtcgggggtggcggaggctgccgcctcgatcctcctgacgacgtcgctgccctcggggttgagcagcccgtgctgcctgttgcgcgacgtctccatgaggagctgcatgaggacctgggcgtagctgcgcagctcgggcgggaccttcgctgcggcgtcctcgatgacccggcgctccctcgagcggtccaggaccgggagtccgtgggcggccttgtaggcggctaccttgtcggcgcactccatgcgcctctggaagagggagaggattctgtcgtcaatctggtcgatctcttccctcacctggctgaggtcctccaacgtgtcctccttgctagttggtgccgagcgtgaacggatcgccctcgggcgggaacgagagccacgcgtcgaggagcgagagggcgcagatcgcctctgccacggggaccgcccgcggtgcgatgcaggggtcgtgcctcccgtggacctccagcacctcgggttcgcccgtgccgaggttgacggagtcctgggggcgggagatgctggaggtgggcttgacggccatcctgaacaggacgggggcgccggtcgtgatgccgcccagtatcccgcccgcgttgttcgtgcgcggggccgggccgtcgggcgtcgcgtcgaaggggtcgttgttctcgctcccgcgcacgtccgccgcgccgaagccgcttccaaactcgatgcccttcaccgcggggatgccaaaggcggcacgggcgacgaggttctcgatgccgtcgaacatgggggagcccaccccggcggggaggccgcaggccacgcactcgacgacgccgccgacgctgtcgaggtccctcctcgccgcgtcgatggcgtcgagcatgcggccgccggccgcggggtcgatggtggggaggccgtccctctcctccagcgcgtcgatctgccgggagagtgcctgggagtccgagcgcagcgtggcacggaagggctcgtcctccacgccggcaactcgcaggaggtgcgccctcacgcggacgccgcgcgcctcgagcatctggatggcgatgccgcccgccacgcagagcggggccgtgagccttcccgagaagtgcccgccgccgggggcgtcctggttgccgtgccacttttcccaggcggtgaagtcggcgtgtccggggcgcgggaccgcgagcaggttgtcgtagtcgtgggagcgcgtgttggtgttgcggatgaccgcggcgagtggtgcgccgcaggtcctcccgtcgtggttgatgccgctcacgaactcgggctggtccgcctccctgcgtggggtcgaccagctgccctggccgggggccctcctcgccatgaaggcggagagccgctccccgtctatcgcgaagccgctggggagcccctcgaccacgcagccgatcgcctctgagtgagactggccgaacacggtgaccctgagggcattgccaaaagtggagggcatcctactcccacccttccgttacgttgccccccagcgccgcgaagtcggcgaagaaggcgggatacgactttgagacgcagctggagtcgtggatcgtggtggggcccgaggcgccggcggcggcgaccgccgccatcatcgcgatcctgtggtcgttgcgcgcgtccacctcgccaccggcgagccggggcacgccctcgacgacgagctcgtccccctctatgcgcacgttggcgcccagggcgttgaggccgtctcgcacggtcaccaggcggtcggactccttcaggcgcagcctcccagcgttggtgaagcgcgtggtgccctcggcggtcgccgcgaccgcggcgaggggagggacgaggtcggggatgtccgccacgtcgatggtgcggccgcgaagggcgtcgtgggtgcagcgcgcactgtcgccgccgcgcgtgacgtgggccccaaacgaggcgagcgcgccgagcaccgccctgtcgccctgggagctcgagagatcgagccccgtcaccgtgacgcccgacccgcaggacgcgcccgcggcgagccagaacgcggcgttggaccagtcgccctccaccgaggcgacgccgggggatacgagctcggagctggcagggaccgagtagcgcgtgaccgccgccgtgccgcggggctcgcggtcgacggagacgtgcacgccaaacctcgcgagcgagctcacggtgatcgcgacgtaggagcgtgactgcatgggctcgcccacctcgacgtcgagcccacccgcaacgagcggggccgccatgaggaggccgctcacgaactgggacgacacgtcaccgggcaggcggtaggtcccgccggagatggggccctgcaccctgagcgggaacgtcccctgtcgggagagccgggccccgtgcgacacgagctcctcgtagaggggcgagagggggcgctgggccagtcggccgtggccggtgagggagcatgccgcccccagcgcggcgaccacggggaggaggaagcggatcgtcgagccggactcgccgcagtcgagggtcgccccctcggcagccctcggccggccggcctcccgtgggatcgggttcacgcggaacccgcgcgaggtccgcgcgacgcgcgcgcccagcgagcgcatgcagtccgcggtcgcctcgatgtcgcgcgacgtggtctcgcagtccaggtcgaccctccccccgcagagcgcggagaggatcagcatgcggtgggccaccgacttggacgcgatggcggggatcgtgcctgccaggggggcgggctggatgacggcgaacctcttctctcccatcacgcaccggccccgcagcccaggtccacgagcctctcgaactcctcaagggagacgtgcctcacctcgaccgagccgatcgcccgggggacaacgacgttgacgccgtcgccgtggcgcttcttgtcgtgcgtcgcgtacgagacgatgaggtcgtgggggaggtcggtgtcggtggggagcccgtgcgcacgcaccagggcctcgatccgccggggcacctcccggtcgcaccagcccatctcgcaagcggcgcgggcgatgcagcacatgcccagggcgacgcagcttccgtggccaagggagaagtcgcccgcggcctcgacggcgtgcccgatggtgtggccaaagttgaggatctggcgcaggccgtgctcacgctcgtcgctggcgaccacgtcgcgcttgatctgcacgttcctcgcgacgacccgcgcgagctcatcctctgcgacctcgccggtgagggggttggcctcgagccaggcaaagagcttggggtcgcgtatgacgccgtgcttgatcacctcgccgcaggagtccctgaacaggtcgggggtgagcgtgtcgaggcagtccacgtccgcgaccaccagccacggctgccagaaggcgccgcacaggttcttccccgcgtccaggtccacggcggtcttgccgcccaccgacgagtcgaccatcgccaggagcgaggtggggacctgcacgaggttgatgcccctcaggtacagcgccgcggcgagcccggccatgtcgcccgtcacgccgccgcccacggccacgacaacgtcgtcgcgcgtgaggcccgcctgggccaggccgcccaggagctcctccacggtcgacaggcgcttgttcctctcgcccgcctcgaagatctggatgcaggcgtcgtagcccgcggccacgagggactgggcgacggcgtctgcgtagagcggcgccacgttggagtcggacaccacgcacgcgcggccgcccccgcacgcctggcgcgcgagccggccgacctcgtcgatgacgccctcgcccaccaccacgtcgtagtcacgctggctcgtggggacgcgcaccacgatgggcttcccctcgatgccggcagtcgtctgggtcatcggccctcgacctccctcttcctgcggtcgccgtctgcgaggaggccctggagcctctccgcgtcgcggttgtctatcgcgtccttgtactcctgcaggtgccctatgaggttgcctatctcaaagctcaggttgtccgcgttgtccaggaacagctcggtccacatgggcgcgttgaggcgcgcgaccctggtgaggtcccggtacgagcctgccgagaagcccctgtgcacggtgcaggaggggctcttgacgtaggcgtttgacaccacgtgcgcgagctgcgaggtgaaggcgatgacctcgtcgtggtgctccggcgtcgagagggtcatgctgccaaagccgcagggctccagcagctgctccaggcgctcgagcatgtccgcccgctcgaagtcgtccatcttgggcggcaccacgaccatgggcgcgttgtggaacatgttcgcccggctgtgggcgaagcccgagtactgggtccccgccatggggtggcagcccacgaaggtccagggccttccctctgcgatcttaaagcagcgctcgcagatcacccgcttcacgcccacggtgtcgatcacgatcgcgccgggcgagaggatgtccgccatctgggcgagccagtcgatggacacctgggggtatcccgccaggacgatcagctcgcaggtggggaccacgtcgtccgtgagctccccgtcaatggtctcgatctcggcgagctcggtcaccgagtgcgtcctgttccagccgtacacctcgcggccgcccgcgtggagcgccttggcgaacgacccgcccatcaggccgagccccacgatgccaacgcgaccgggcacgagcgccgtgctctgcttcacttctcccatggcccctagtccaaatctgcctcgacggcggagcggatgagcgagatgcgcttcatcgcgtccgagaactgcgcgggcgtgagcgcctgcgcgccgtccgagagcgcgttctgcgggtcgtcgtggacctccacctcgaggccgtcggcgcccgccgcggtcgcggcgtacgcgatggggcgcacgtagcgggtgtagccggtggcatggctggggtccgcgatgatggggaggtgcgacaggtggtggaccaccgggatcgcgtttgcgtcaaaggtgttgcgggtgcgggtctcgaaggtcctgatgccgcgctcgcacaggatcacgttggggttgccctcgctcatcacgtactcggcggacatcaggaactcgtcgatggtgcagcccatccccctcttcaggagcacgggggccttcgtcctgccaagctccctcagcagcgggaagttctgggcgttcctcgttcccacctgcagcacgtcgacgcccctgtccaggaagccccccacgtcgcgcgggtccatgacctcgctcaccacgggcatgtccagcgagtggcccacctcgcagagcagctcaaggcccctctcgcccatgccctggtaggagtaggggctggtgcggggcttgtaggcgccgccgcggagcatcgtcgccccggcctcgcgcacgccgcgcgcgatgtcccagaggttgtcgccctccaccgagcagggccccgcgatcacctggaagttgccccctcccaggagcaccccgtggccgcagtcgaccacggtgtcctcggggtggaacttcctgttggccttcttgaagggctccgagacgcgcctgacctggtccacgatgtccatggactccaggaggaaggggtcaatcttggtcgtgtcgccaattatcccgacgatcgtctcgttctcgccccgcgagacgttggtcttgaatccgcgcccctcgatccacgagacgaagtggtcaagctggtcaggcgtggcgctgtccttgacgattgcaatcatgagctgtggtctccctgcggcctgtgtgaccccgtgtttatggcatatcttcgcgatgctactacaacccacatcctaacttctgatgggtcaacaggcggaaacaaagggaggtgggggagaaacaacaaaacccgcccccaccgatggggacgggcttctctcgtgcgatggtgaccccagtggggctcgaacccacgacctttcgctccggaggcgaacgctctgatccactgagctatggggccgataggagattatagcgaaaacgggtgccctgggaagggcgttgggtatgctcttctggtgacggcgcgccatatcggcggcaatggggtcccgacggggtcggggaggggagacgcatggaacaggactctcgagcgtcccgcggcgatcgcgacggcctcacctccgcggaggtcgaggagcgccggcgcgccggcctggtaaacgtcgacgtcctcgcgcgcaccaagtcggtcccgcagatccttgcggagcacatcctgaccctcttcaacgccgtcaacctcgccctcgccgtgctcgtgtggaccacggggcagtaccgcaacatgctcttcctgggcgtcgtgctctccaacctggtgatcggcacgttccaggagatcagggcaaagcgcctggtcgacgccctgagcatcgtcaccgcgagccgcgtccgcgtgaggcgcgacgggcgcgaggacctggtgggggtcgacgacctcgtgagggacgacctggttctggtgtcgcgcggcgaccaggtccccgctgacggcacggtcgtgttcggcatcgccaccgcgaacgaggacctcctcacgggcgagagcgccccggtggagaaggccgtcggctccgagctgctgtcaggctcctacctcgactcgggcagcgtcgagtaccgcgtcaccagggtgggcgcggacgggtatgcgtcccgcataagctccgaggccaagcggtggcggccgccgacctccgagatcagtgacaccctcgcctctatcatccgcctcgccacctacgccctcgtcccccttgggctcgggctcttccttcgcctcgttctctcggggcgctatggctacgacggcgcggtgctccaggccgtcgccgcggtcgtcgggatgatcccgcaggggctcgtcctcctcacctcgggcgtcatggccatcgccaccacgcggctcgcgcggcgcaaggtgctcgtgcagcagagctactgcgtcgagacgctggcacgcgtcgacgtgctgtgcctcgacaagaccgggacgctcaccacggggaggatggaggtctcgtccctctcgccctgcgggggcgtcgaggaggaagacctcgaggcggcatgcgagacggtcatggaggcaaaccggtcggacgccaacgagacggcgcgcgccctcctcgcccatgccgtctcccggggcgtgcggcccctctccttcgtgaggggcatccccttctcgtccgccaccaagctctcggcggcggtcctggccgacggcgggtgcctcgtggtcggcgccccccagttcgtcctgcgcgaccagctcggggcgcatcgccgggagcttgacgcgttcgaggcgatcgagcgcgtgctgtgcgtcgcccacgccgaggggctcgacgcgacgggcgtccccgagggcagggtggtgccgctcggcttcgtcgcgctgcgcgaccagatgagggcgagcgtgggccagacggtcgcgtacttctcctcccagggcgtcgccctgagggtcatatccggagacgaccctcggaccgtctccgccatcgcggcacgcgccggcatcccgggggcggacagggccatagacgcctcgcggctcgatcccgccaacctcccggaggaggtcgacggggcggtggtgttcgggcgcgtcaccccgcaggtcaagaaggcgctcgtggcgaggttccgcgcgctcggtcacgtggtcgcgatgacgggcgacggcgtcaacgacgtcctggcgctcagggagtccgactgcgccatcgccatggcgtcgggctccgccgccacgcgcaacgtcgcggacatcgtgcttgccgacaacgacttcgcccgcatgcccgaggtggtcgctgagggcaggaggtccatcaacaacctgcagcgctccgccgccctcttcctcaccaagaccgtctactcggccgccctcgcgctcatcagcatcctcatcccgccctacccgttcatccccatccagatgtcgctcgtctcgtccgccgtcatcggggttccctcgttcgcgcttgcgctcgagcccaaccacgaccgcctgcgtggcaccttcctgggcaacgtcctctcgcactccatgcccgcctccgcggcgatcgtctgcgggctcctggctgccatggtcatggcgagggcgttcggctggagcgacgcgctcctctccaccgtgagcatgatcgtcatggcagcggtgggcatagccctgatcgagcggctctcgcggcccctcaccccgctcagggtcgccctcctcgtcttctccacgtcctacgtcctcctgggcatcaccgtgttccgcgacttcttcctggtggctccgatggattacgtcacgggaatagtttgtgtggtcacggtggcctgcgccataatcctgttcgagtttctgtacgcgaagcgcgaactatggtccgaggggtcggccctaggcaggctcctctctcggggaatggagatgctcgatggcagcagaggaaacgcagggggagttcgcggccgccgtccgtgaggccaggaggcccaggcggcttgaggcgggcggcatcacgaggctcgcctacgacgtgtccggcatcccgggtgcctcgcggctcccgcgcgccctcgtcgtcctcctcgagaactgcgtccgccgagcgccgagcgacgaggaggccgtgcgcctcgcccgccgcgtcgtcgaggcgggcctcgcgggggcgcagggcgaggagatcgactacatgccgtcgcgcgtcctgttccaggacttcacgggcgtgcccgtgttcgtggacttcgcctccatgcgcgacgccatggtcaagaggggaggggacgcctccaaggtaagccccaaggtgccctgcaccctggtggtggaccactcggtcatcgccgacgtggcgggcaccccggacgcggcggagaggaacctctccatcgaggccaggcgcaaccgcgagcgcttctcgttcctcaagtgggcggcgcactccttcgacaacgtcaggatcgtcccccccggagagggcatctgccaccagctcaacatcgagcggttctgcaaggtcgtctcgaccgacacgcttgcagacgcggggcaggacgtcgcctgcttcgacacgctggtggggaccgactcgcacaccacgaccgcaaacggcctgggcgtgctcgcctggggcgtgggcggcatcgaggcggaggccgcggcgctcggccagccgatctcgatgctcgtgccccccgtggtggagctcaggctcaccgggcggctgcgcgacggcgtgagcggcatggacctcgccctcaccgtggcccaggcgctgagggccgccggcgtcgtgggctgcctggtggaggtgacgggggacggcgtcgccaccctcagcgccacgcagcgggcctgcgtcgccaacatgacgcccgagtacggcgccaccacgaccctcttccccgtggacgaccaggcggtgagctacctcgccctgaccggcagggatgcgggcgagatcgagttcgcccaggcatacctgcgcatggagggcgtcctcggggcgacctccgggcgcgtctactcccgcacggtcgagctggacctctccgaggtcgagacgagcctggccggcccctcccggccccacgcccgcgtcacgcccgccggcctgagggagcgcttccgctcctcgctcgccgagcacggcaggtccatgtccgaccaagcggccacgctccgctttggggacgacgaggtgacgctgcgccacggcgccatcgccatagccgccatcaccagctgcaccaccgccaccgaccccgccatgatggtcgcggccggcctcctcgcgcgcaacgccgtggagcgcgggctccagtccctgccctgggtcaagaaggtcctcgcgcccggcagccacgccacctcgctcatgctcgcgcgcgccggtctcctcgagcctctcgccaagctgggcttccacgtctgcgggtttgggtgcatgagctgcatcggcaactccggcagcatcgcgccccagctccacggggtcgccgaccgcctcgagctcacgagcgtgctctcgggcaacaggaacttcgacgggcgcatctcgcccgacgtcagccagaactacctctgcgagcccgcgctcgtggtggcctactcccttgccgggaccatggactgcgacctctcccgcgagcccgtgggggagggcgcgaacggccccgtgtccctctccgacctcatgccgagcgacgaggaggtgcaccgggtgctcgaccgggtcctgaccccggagctcttcgacgagggcggcaagggcctgtggacaggctcaagcacctgggcggacatcgacgcgccctcgtcccgcaccttcgactgggacgacgagtccacgtacgtcaggcgcgctccctactttgacgacgcggtcgcctctcccgtcatacgggtcagcggcgcgagggcgctcgcccttctcggcgacttcgtgaccaccgaccacatctccccggcgggcgccatcgccgcggactcgccggccgcgcgctacctccgcgagcatggcgtggaggacaaggacttcaacacctatggcagccgcaggggcaaccacgaggtcatggtcagggggaccttcgccaacgtcaagctccagaacgcccttgccgacggcaggagcggcggctggacccgcgacttcctggacggggaggtcaagagcatcttcgacgctgccgaggactatcgcaggggcggcgtgcccctcgtggtggtggcgggcaagatgtacggttcgggctccagccgcgactgggcgggcaaggggccggcgctgctgggcgtccgtgcggtcatcgcccagagcttcgagcgcatccaccgctccaacctcgtccagatgggcatcctgcccctccagttcctcgaggggcagagcgcgcagtcgctgggcctggacgggtcggagaccttcgacgtctctccggtcgacgtctccggcgggctccccgcgagccgcgagtgcgaggtcgtcgcgcgcaagggcgacgggcgagaggtgaggttccgctgcgtcgtgagggttgacacccccatggagggcagctacgttgccgctggcggcattctccccttcgtcctcgacgagctcgtcggggcctagcgggatgccgaggggaggagaagcttgatctgtcccaactgcgggtccaacgttcccgacgactcgcgccggtgcccggcgtgccatgccgacctcacgcgctccctggtggcgtcacgcccccagggcacgtggtgccccaggtgcggcgcgcttgtgcccgacggggaggaggcgtgccccaactgcggcacgcccgtcctcggcgacgatgccgccgaggaggccaaggatgaggggcgtgcgtgcgtgccccccgttccccagggggaagacgacgcggatggcccctccgaggcggaggagacccacgccatgccccgcatcgagagcgccatcccctccgagggcgaggacgacgaggtggggatgcgcgaccgcttcccgcgcgcccgcgtcctcaccgtcgccctcggcgccgccgtcgtgatgatcgtgggcctggccctcgtcatcacccacccctggaacccggacgcactcgacgaccgcgcaaagacggacgccgacacgtcgatggcgggctaccccggctacgtgagcgcccttcagggccaggacaacgcctcggacagctcggacagcgccatccagagcggcgacgacgcctcgctctcgaagctccacgacatctggaagcagatgggcgagctcgaggcgaaggcggacgcgagccaggaggactacgacaagtactacctcaccggcaccgccgaccagaggtccgagggcaaggtgagcgcggagcagctctcgtacgacatcagcaacctcatctcctcgatcgacgacgtggacgtaacctcgggcacctacgcggacaccgccgacaacctcagaacgctcggcaactggctcaggaacaggatcgacttcctcaaggcggggtggcagaaggacgcgagctacgaccagccgcaggaccacgaggacgagctatcgtcctacagcacctcgtccggcaccacgctgggggagtcctacaagcagaacttcgaggacaagtactcggactgggagcccaagcaggcctcataggccccccgaggggtcctcgcgggtgtccttgacgcttcccaagcgtgttgcctcctgccgaatgtgtgaaacccacgggctactggtagaattagcgagctaggcagtgagaagtccgtacgtgccacgcacgtcccgggaggagaagcaatgggattcttcggtgagcccctctatacgcctgactacaagccgcagggtgacgaggtcgccgtgttcgacacgagcaaggggaccatcagggtcaggctcgacgccaagggcgcgcccatccacgtcgcgaacttctgcgagctcgcctccgccgggttctacgacggcctcaagttccaccgctacgtcccgggcttcgtgatccagggcgggtgccccaacacccgcgacatggcccccgaggacgtcgcggctgggaagcccggccccgacggcatgcccgggacgggcggtcccggataccgcatcagggaggagttctcgaccaaccccaacaacagccacgtggacggcgcgctcgcgatggcccgcgcgcaggaccccaactccgcggggtcgcagttctacttctgcctgggcccgcagcacatgctcgactcgggatacaccgtgttcggcaccaccatcgagggccttgacgtcatctcgagcctcagggcgggcgacgtcatcaacagcgtgaggatcgcccacgaggcgtagtttcgacagcacagacgcaatagaggagcaaccgtgaatcagcaggcattcgaggcgggtaggaacgcgtacaggcagggcgacctcatgggcgccgttgcccagctatcggcggcaaagggcccgggcgaggtctctggctccgtcgaccacctcctggggaactgcctcatgaagctcggccgctacgccgaggcggcggactcctacggcgacgcgctgagggacggctcctatgggcacaagggcgccctcgcctgcaaccgcggtcgcgcgctcctcgccgctggcaaggtgcaggaggccatcgcctcgctcacgctcgcgaccaaggacagcgagtaccccaccccctacaaggcctacgtcgccctgggcaatgcctacaagaagatgggcaacgtgcgagaggcgggtgtcgccttccgcaacgcggccatcgacgagaccaaccccgaccccgccagcgccctcagggagctaggcggctgcttcatgcagatgggacgtgcggtcgacgcggtggaggcctaccgcaccgcgctcgacttctcgacgcccctccagaaccagaacgccatctacggcgacctcggccttgcgtacgttgcggccaacaggatgtccgaggcggtcgacgccttcaaccacgcgacctccgacggcagctacaagctccagcccgaggcccaggcggccttcgacgctgccaagaaggcggtcgcggcaatcgcgggcgacggcccgtccgagaccgacgccttcctcgcggcggcgggctatggcaccggtgcctacgatcccctcgaccccacgggcgccacgggcgacatcatgccctctcccgaggacaccgggttcttctccgtgagcgaggaggacctcgagcgcaaggagaagtcggagcgcaaggtgcgccgcaagcgtaagcaccgcggtctcaaggtgttcctcgtgatcctgctcatcctcgtcctcctcagtggtgcgggcgcttttgcttactcccgcggctacggctggcccatgcaggacgaggtcgttcagcagatgttctccgccaacgcctcgggcgacgacatcagccagttcctgagcccctctctctccagcgaccaggcttccgagatcaagtcgctcctgcccactggtgacacgtccgtgaccatcgacggggtggaccgctccatggcagagtccaccgtccttgccaccgccaagctcgcggcgggcggcacccagacctacaccatcaagctcgtccgcgacggcatcagctggaaggtgagcgacgtctccgccacctacgcctcgcagtcggatggcagcgcctctctcacctcctccaacaccggcgccgcggactccagcgtcacctccgcaagctccgcctcctcagacagctcctccacgaccagcgggaccaccacctccggaaccatctccggggagtagcgatacactattcacgcgtccgccgcgggcgcgtcatgcgataggaacagggagaaatgtcgtttcttgactcactcttcggggaatacgacggtgacctggcaatcgacctcggcaccgcgaacaccctcgtcgccgttcgaggccagggcatcgtcctgaacgagccctcagtcgtggccatcgaccagagcgccgacagggtgcttgccgttggcgccgacgccaagcgcatgattggccgcacccctggttccatcatcgccgagcgcccgctcaaggatggtgtcatcgccgacttcgatgtcacggaggtcatgctccgctacttcatcgagaaggcgcgtggcaccaggcgctacccgtggtcgccgcgcccccgcgtcgtcgtttgtgtcccgtcgggcgtcacctcggtcgagaagcgcgccgtcttcgaggcgaccatctccgccggcgcccgccaggcgtacctcatcgaggagcccatggccgccgccatcggcgctgaccttcccatcgaggatccaacgggctccatggtcgtcgacatcggcggaggcaccaccgaggtcgccgtcatcgccatgggcggcatcgtcgtgtcgcagtcgatcaggactgccggtgacgagtttgaccagaccatcctcgagcacgtccgcgacgcctacaacctctccatcggcgagagaactgcggaggacatcaagatcaaggtcggctcggcagcccccctcgcggaggagctcgacgtcgaggtcaatgggcgcgacgtcatgagcggcctgcccaagacggtccgcatcgagagcgaggagatccgccgcgcgctcgacaagccactcgacgaggtcaccaaggccgtcaaggacgccctggacgtcacgccgcccgacctcgccagcgacctcatgtactacggcgtgctcctcaccgggggcggcgggctcctccgtgggctcgaccagcgactcagggacgagacgggcgtcccggtgaacgtcagccccaccgcgctggagaacgtggtcaacgggtgcgcgaaggtcctcgaggccaacgcgctctcgggtggcttcgtccagagcgccgggctgtagggtagccggcatgcctttgggaggaaacggcctcaagggcgcgcccggggtgaggaggaacgagccaaactccggcatgcgccttatgatcgtgctcaccgcggtatccatcgtgctgttcacctttggcgcgcgcgagtccagcggcggtggcgtcttcaccaccatccgtggcgccgtctcggtcgtcaccacgccggtgcgctacctgggtgctgccgttacggctccgttccagggcctgggcaacatcttctccaacctcaccgccaaccaggagaccctctctgacctaaaggccgagaacgagaagctgcaggcagagaacagcaagctccaggagtcgcagaagaccgccgagaggctcgagaacctcctcgcgctgcagagcacctacaacctcacgtcggtcgccgcccgcgttatctctggccccaccgactcgtggagccagtcggtgaccatcgacaagggcaccacctcggggctggccgtcggcatggcggtcaccgactccaacggggtgttgggccagataaccgagtgcggtgccacgtcggcgaccgttcgcctcatcaccgacgagaactccggcgtgtcgtgcatgatccagtccacgcgtgcccagggcatgctcaagggttccgccgacggctcgctgagcctcacgctcgtctcggttgaccagaccgtgaaggtgggggacaacgtggtcaccagcggcctgggtggggtatatcccaaggggctgcccgtcggcaaggtcaccagcgtgagcaagaccaacgggggcctgtactacgacatcgacgtccagccgctcgcctcaacctccacgaccgaggaggtccttgtcatcacctcgctgagcgaggaccagaaggcgagctcggaggacatctcctctgccgacgcccaggacaccacgacctccgcgtcgtccgcgtcctcggacagctccgccgactccagcgcgagcatcggccagtagggaggcaccgtgcaggttaacgacagcaacaggaggagaaggagcatagggaggctcgggctcgtctgcctcgtgctccagctcgccctcgcgcccaacatcggcatcgccgacgggcgcatcaacttcgcgctcgtgttctccgcctacgtcgccctcaccatcggcggcaggacgggggtcctctgcggcttcctcggcgggctcgccttcgacctctgcaccaccggtcccttcgggctcatgacgctcctgctcacggtagggtcgttcgtgctgggaatggaggaccgcaaccgcatcgccgaggacctctcgggctccatcacgatcttcctcatcgtctcgttcatcgtcacgctgctctaccacctcgccatgttcctggtggggcaggcgagctcgttctacgacgtcttcgtgctcaggacgctgcccaccttcgccctcaccgccatcgccttcctcccgttcgcgttcgtggggtcccacggcagcggggcgcccctgtcctccctcaagggcggggcggggtccgtgcgcaggcgctccggcaagttcgacctcggcaacctctaaggtcacgccttgaaccctgtcctcatcgtcatagccatcctcgcggtcatcctggtggcgctcctcgtcgtcttcttcctcgtcggcaggggagaggcacgattcaccttcgatatcggggggaacgcccccaaggcgtcgggcggctcggacacctcgtccgagaccgggttcaagacccggctcaacggcctggggatcttctccggctccatcatcgcggtcattctcgcccggctctggtcgatgcagctcatttcgtcggacgactactccgctcaggcggagtccaacaggactcgcaccatctcggtcgacgcgccgcgtggccggatcctcgaccgcaacggcgtggagctcgtgaccaaccggtcgtctctcgcggtcatggcaaagagcgacgtcgcaaacgacgagatcgagtgcaagcttctcgccaacctcatcggcatgcccgagatggccgtaaagcgcaaggtcgaggacgccaccaccggcgcgcagaacctgaggaccgtcgccgtggacgtctcgcggcgcgtcgtcgcctacgtggaggagcacccctcactcttcaccggggtgtccatcgagcagaagacgcagcgtctctaccccaacggaaccctgtgcgcccacgtgctgggctacactggctccatcacccaggagcaggtggacaagctcgactccgaccagtccgcctcgtccatcgactacgagctgggcgacacggtcggccaggcgggcgtcgagtaccagtacgagagcgttctccagggcgtcaagggcgagcaggtggtctacgtggacgccaacgggtccgtgctgtcccagtcaagctcggtcgacccgcagagcgggtcggacgtcacgctgaccatcgacgcgaccatccagaaggcggcggaggagtccctctccaagcacatcgagtcgctcaggacctcgggcaagaccgagtgctacgaggggtgcgccatcgcgatggacgtcaccaacggcgagatcatctgcatggcgagcgagcccacattctcgccgagcgtcttcatcgggggcatctcgtccgacgactggtcggcgctctcgtccgacgactcccacacgcccatggtcaaccgcgccatatcgggccagtacccctccgcctccaccatcaagcccctctccaccttcgccgcgctcaactacggcatcgccaacgtcaactccacctacgactgcaccggctactggacgggctttggctccgcgtacggcaagtactgctggaaccattccgggcacggcgtcctggggctcgtgggcggcatcacctactcgtgcgacgtcgtcttctacgagatcggcaagggcttctactactccgacaacaaggaggggctgcaggagacctacaagcagtggggcctcggcagcaaggagggcatcgacctcccgggcgaggccgagggccgcgtccccgacgcggagtggaagtggaactactacaagtcgtccgacaacgacgcccgccagtggcagggcggcgacgacgccaacctggtcatcggccagggcgacctcctcgtgacgccactccagatgctctgcgtgtatgcggggatctcgctcgacggtgtcacgtggaagcctcacgtgctcaagtccgtcaactcgaacgtgggaagcggctcggtcgtggagtacaaggacagcaagctcaggaccgtgaacgagcagtccgagtacatggacctcgtccacgagggcctctccggggtcatctacaaggagtcggaggcccaggcctcgcacttcaccaacctgtccgtgcaggtcgcgggcaagactggcaccgccgagacgtcgcacgcggacccgacgggatggttcattgcctacgccccctcggacaaccccaagtacgtggtcgcctcggtcatcgagaacggcgggttcggcagcgacggcgccatgtacgtggtccgcgacatcctgggcgctatctacaacgagccggacacctccaccgaagtcgactcctcgggcgtgaggtagggaggtacgagatgtcgggaaagcccacgctgccaaccgagagacgccaggggggtccgctgggagggctcctctcgcggtttggctccacccgcggccgcggcagggtccgtgcgggcaggggagggctgttctacctcccgcagctcatacccgccatcggcctgatcgtctacggcgccgtcgtgatctggtccgcctcgctcaccatctcggacgcgtcgttccctcgccacctcttcggcattgccctgggcatggtcgccgcctacctcgtgtggcgctacgactaccgggcgctcgccaacatgtcaaaggcgcttctggtcatcgacgtcgtgctcatgctcctgccgagcgtccccggcctcagccactcggcgctgggcatgacggggtggatcaggatccccatcatcggcttcacgttccagccgtccgaagtggccaagctcgtgaccatctacctcatggcgtctctcggtgcggagtacaacggcaagatcgagcacctccgggactacctcaagctgtgcggcatgctcgcgatacccttcatcctcatcctcacacagcccgacctgggaaccggcctcatcatcctcgtgacgggcgccgccatcatcatctgctccggtgccaagaagacctgggtcatcgcgaccatcgccggcatcgtggcgctcgccgccctcgtggttgccacgtccatgtcgccggggctcccgcacctgctcaagacctaccagctcaagcgcctcattgtgttcgtggacccgtccgtggacccctcgggcgacggctacaacctggcccaggcaaagatcgcggtcggctccggcgggctgctgggcaagggcatcggcaacgcctcgcaggcgggcagcggtttcctccccgaggcccataccgacttcgtgttcgcccttttggccgaggagttcggcttcgtggggtcggtgctcctcctcgccctgttcggcgccatgatcttcgccgccatctcgctcgcccagcgcgtcgagtccccgtttggcaagctcgtcctcgtcggctgcgtggccatgtggtccttccagctgctcgagaacgtgggcatgtgcatcggcatcatgcccatcaccggcatcccgttgccgttcatcagctttgggtcgtcgtccatgctcgcccagtgcgcctcgatcgggatggtgcagtccgtgtggcggcacaggccaaaggccgcatagggcaccgcttgccgctgcggttggcgggggagagggccgggcgccctttgttgacgccgcccccgcgggtagaatggcgtcgtcgcacattggtttaggggctattcggtttggcaggagagcggtatggcgagaaggcattccctcacgctgggtgacatcgctaagatcatggggtcggggcgcgagtcgcagcgccgccggtcggagggggtgtcgcttgccgtgatggttggcgagggcgcgtcggcgaccatcgcgcgcgccgtcagggaggccctcctcccgcagaacgagaccaccttcgtctcggcgctcccgctcgagggggccgtccccgcgggcgtggacgctgtggtcatcctcccgggaagccccgaggcggccgccgagcgggcggtggatgccgcgcgcatgggcatacccgccgccatcctggtgtgctctcaggtcgaggagcgtcccgtgcaggcgggcgaggacgtcgcgagcctggtcgcgtacctctccgccgccaacgagcgcgtggcggtcgacaagctctgcgagtggctcgtgggtgcctgcgcctccaagtccattgcgctggccgccgggatccccgcgtgtcggcagaacgtggtccgctcgctcgtcaggtcgtgcgccctcgccaacgtgggcgtgggcgtcgtcgacctcctgcccggggcggaccttcccgtcatggcggcaagccaggcgcgtctcgccttcgacgtggcggcggcgtacgaccgcaggctctccgcctccgactttggtctgattgccggcggggtcatgctcgcggggctgggctaccgctccgtctctcgctctgtctcccgtgcgctccctccgctcgcatgggcggttcggggcggcgtcgcctttgccgggacggtcgccacgggggcggtcgcccgcgcctgcgcctcggggacgacgccgcagcgggtcgccgaggcagccgccgggggcatcgggaagggcatcgaggagctgtccgcgcgtctctcccagattctttcccggcgggggagagaggaccgcggccccgttggccccggctacatctcgttgggcggtgagggcgagtgaggcttccgaggcaggactggtacccccggctcgagccgctcctgggcaaggtcgagaagccgtcgcgctacctcgaccacgagtggggcgccgtggagagccaggacggccccttccacgtgtgcatgatctaccccgacgtctacgacgtggggcaacccaacctgggcatcgcgattctctaccaggccatcaaccgccaggagggcatgtcgtgcgagaggggcttcctcccctgggttgacatggcggacctcatgcgggcggaggggatcccgctcctctcgctcgagacgtcgtcccccgtggcgtcctttgacgtcgtggggttcacgcttgctcacgagatggcgtgcaccaacatcgtcgaggccctggacctcgcgggcatacccctgcgcgcggaggagcgctccgaggacgacccggtcgtcttcgccggcggcccctcggtgtggaactccgagccggtgagccccatgttcgacgccatcctcctcggggacggcgaggagggcctcgtcgagatgtgcgccctcgtccgcgacctcagggggaggggcgcggcacgctccgacatcctcaaggcgctcgcacgcctcgacggggtgtacgtcccctccctgtacgatgtcgagttcgggccgaccaccacgcggtggggcagggccgtccccaagccggggagcggcgctcccaaggtcgtgaggaagcggtgcatccccgacctctccgtgacggacccgctcccccagaagatcgtcccctacgtggggctggtgcaggacaggctcgcggtggaggtcctgcgcgggtgcgcccgggggtgccggttctgccaggcgggcatcacctaccgcccggtgagggagcgccccgccgagcaggtcgtcgaggccgccgaggaggggctggcgcggatggggtacgacgaggtctcgctcacctcgctctcgaccaccgaccactcccagtgcgcagggatgctgcaccggctcaacgcggacctctccccccagggcgtcagggtctccatcccctcgcagcgcctcgactcgtttggggtcgagatggcgcaggaggtcggcggatccaagaagggtggcctcacgttcgcgcccgaggccggcacgcagcgcctgcgcgacgtgatcaacaagaacgtgaccggggacgacatcgacgccgccgcgcgcaacgccttcgagcgtggctggaggcgcatgaagctctacttcatgatgggtcttcccaccgagacggacgaggacatcgtcgcgattcccgaggtcgcgcagcgcgtgctggacattgggcgcgaggtcgtgggaaggggccgcaagagcggtgtctccgtctccatctcggttgccgtgttcgtgcccaaggcgcacacgccgttccagtgggccccgcagctcgagctgtccgaggtgcgcaggcggcaggccctgctcctctcgtccacccacgaccgcgacatccgggtgagctaccacgacgccgaggtctccctcgtggaggcggtgctctcgaaggtcggccgcggcggcttcgacctgatccttgaggcatggcggcgcgggtgccgcttcgacgcctggacggaccagttcgacttctcgcgctgggaggaggcggcacgggccgtcggcatcgacctggtcgaggtcgcgagcgcgcctctcgccctcaatgtcgaattcccgtgggagcacacgagcccgggcgtctcgaaggggttcctccagcgggagtggaggcgtgccgccgagggcgtgaccaccccggactgcaccatgaccagctgcacggggtgcggcgtgtgccccacgctcgaggtcgacaatgtgatctggggtgaccgccatgccaggtagggagcagctccacaggcttcgcgtcgagtacggcaaggacgggcgcctggcgtacctgggccacctcgaggtgataaacaccatgggccgctgcatccgccgctcgggactcccgttctcggtgggcaacggcttcgcgcggcgcatcaggctccagttctcccaggcgctccccgtgggtgcgtcctcgcgctgcgagtactacgacctgctcctgaccgaccgcgtgaacgagggcgaggcgctcgtcaggctcaggggcgcgacccccgcgggcctcgcgcccgtatggtgcgggtacgtccccagggagcttcccgccctcgaggcgtggctcacccgctccgcctgggaggtgtccttctcccggggggttgaccgcgatgccctcgacggcgcgctgcggcagctccgcgaccgtgggtccctcgagtacatgaggggggagaagagaaaggtcgtggacctgggccagaccctcgtcgggtgggactgggacgagccgggggtgcttacgctccagacgcgggcaaccaatcaggcgtcgctcaggccggcggtcctgctctcagccacccagggggtccttgggcgagaggtgccgccctactcggtgtgccgcgtgggcctgtggcacgagggggttgatggttctcttgtggaggggctcgatacgaggtcagggtaggcgtttgcccgctattctgtgcaaggcgtggtctgttcgcgaagtgtggcgttctgttgaccgggcggcccatcgctagtatgatagttggctgttgcactacaaccagtaatgaagggctcacacatgtacgcaatcgttaccactggtggcaagcagtataaggttgccaagggcgacatcattgatgtcgagaagctcaacgcgcagcctggcgactccgtcgagcttgacgttctccttctgaacgacggcaagcagaccatcgttgacgctgccacgctcgagggcaagaaggtcaccgcccaggtcctggaccagttcaagggcgagaagcagctcgtcttcaagttccacaagcgcaagcgctatcaccgcaccaagggtcaccgtcagaacctcaccaagctccagatctccgagcttcccctggagggcgctgcggccaagtccgccagcaccgaggagtagcgttcatagcttcgtaacatcatcagataggcaggtatcacaatggcacacaagaagggtctgggctcctctcgcaacgggcgcgactccaacgcccagcgtctcggcaccaaggtctttggcggccagtccatcaagaccggtcagatcatcgttcgtcagcgcggcacccacatcaccccgggcgagaacgttggccgcggcaaggacgacaccctgttcgcccttgcggacggtacggtcgagttcaccaagggtgcgaagcactacgtccacgttcgtactgcgtagccctatcgcatagaatgtttggcgccccaatgttcccattggggcgcctttttgcatcaagagcggggattccccgcatgcgccacaaagtggggaggccatcatgccaaccagcacgtttaccgacctgtgcaggatcaacgtcaaggggggcgacggaggggccggctgcatgtcgttccgtcgcgaggcattcgttcccaagggcggtcccgacggcggcgacggtggccggggcggcgacgtcgtcctcgcgaccgacccgcagctctcgtccctcatcgacttcaggtacaagcaccacttcagggccgagcgaggcacccacggaaagggcgcccgcaggcacgggagcgacggggaggaccttgtcctgcgcgtccccctcggcacggtcgtgagggagctcgaccccctcaccatgaagccgctctaccagatcgccgacctcaccaaacccggtcagagggtcatcgtggccccgggcggcctgggtggcaggggcaacatccacttcgtcacctcggtcaggagggcacccgccttcgccgagaagggcgagcccgccatcgagcactggatcgagctcgagatgaagctcatggccgacgcggcgctcgtggggatgccgtccgtgggtaagagctccatcatcgccaggatctcggcggcacgccccaagatcgccgactaccccttcaccacgctcacgcccaacctcggcgtcgcgcgctccaagctcggcgactccttcgtcgttgcggacgtccccggcctcatcgagggcgccagcgagggcaagggcctggggcaccagttcctgcgccacatcgagaggaccgccctcatcatccacgtggtggacgtcacgggcgggtacgaggggcgagaccccgtggaggactaccacaccatcaacgctgagctctccgcctatgccagcgagcttgccgagaggccccagatcgtccttgccaacaagtgcgacatccctgggtgcgaggaggccgtggagcgcgtccgcagggaggccgaggcagacggccacaggttctttgccgtctccgccgccaccggcgaggggctcgaggacttcgtgaccgagtgcgcgctcatggtgaaggaactcagggcacaggccgtggtcgaggaggaggacgggctcaccaaccaggagatggagtgggagcgccagaggagggaccgcgccatccacatcgcccaggagtcaaggggcatctggagggtctcgggcggcgccatcgagcgcatggtggtccagaccgactggaacaacgacgaggcggtctcgttcctccagcatcgcttcgaccgcgcggggcttgacgagaagctcacgcgtgccggcgtcaagccgggcgacgaggtccgcatcctgggcttctccttcgagttcgagggcgagggcgcgcaggacgactactccgagctcgacgactccgacgacgccctggtcgaggaggtcgccggggaccaggcgggggaggagtcctgatggagggtaggagggtcatcgtctgcaagctcggctcctcgatcctggtggggcgagacggcaggccggaccgtgcgttcatctcgtccctctgcggccaggtctcgaccctggtgggcgagggctacggcgtggtcgtcgtctcctccggcgcggtcgcggcggggctcgagcgcctctcgctcgaccggcgccccacggacatggccacgctccaggcctgcgcctcggctggccaggcctcgctcaccgaggcgtacgcggaggagctcgccaagcgcgggatcccctgcggccaggtgcttctcaccaggcgtgacgtcgcggaccgcgaggggtacctcaacgcccgcaccaccctcacgcgcctcctcgagctcggtgccgtgcccgtggtcaacgagaacgacaccgtctcggtcgccgagttcgcctttggcgacaacgacaccctgggcgccatcgtctcttcgctcgtgggggccgacctctacgtgatcctctccgacgtggacggcctctacaccgccgacccgcaacgcgaccccaccgcacgcctcatccacgtcgtggacgagatcaccccgcagatcgccgcgatggcgggcggggcgggttcctcggtggggacgggcggcatggccaccaagcttcgggccgcccgcgcatcgctcgcggcgggaatccccatggcaatctgccgcggcagggaggatggtgcgctcgtgcggaccgtgcatggcgagggcacgggaaccctgttccggcccagcccctccaacccgcgcgagagcggccgaaagctctggatcgggctcgccgaggtggtccacggcgccatcgtcctggacgagggcgccacgcgtgccgtcacgcagaacggcgcctccatcctccccgtcggcatctccgaggtccgcggtcccttcgaggagggggacgtggtcaacgtcctctcgcccgacgggttcctcctgggcaggggcgtcacgcgcttctcgtccgacgacatggtccgcgtgcgcggcctcaggctcgacgtgatcgcgcgcttcctccccgagaaggccgggcagcccgcgatccaccgcgacgagctgctcgtgctgtaggggggcgggcatggcactccaggagcacgagatcgagcggctggcggagggcgtcgtccgaaggggcgacctcccgctcctgggccgcgaccccaaggtgacctatcggctgggcatcatgggcgggaccttcgaccccatccacaacggccacctggtcgccgccgagcaggcgtttgacgacctgggcctggacgtcgtggtgttcatgcccgccgggcggcccgccttcaagctcaacaagaaggtcagctcgggggaggaccgctatgcgatgacgctgctcgcgacgtcggacaacccgcacttcgtcgcgagcaggttcgaggtcgaccgcccgggggtcacctatacggcggacacgctcgagatgctccgtggcatctatgccgacaacgtcgagctctacttcatcaccggcgccgacgccatcgccgacatcgtgaggtggagggacgcggggcgcatcgcccgtctcgcccacctggtgggtgccaccaggccggggtacgacctggcgcgcgccgagcgcgcgatcgaggggtccccgtaccagtttgacgttacctacctcgaggtcccggcgctcgccatatcgtccagctatctcagggggcgggtctcgcgcgggcagagcctgaggtacctcaccccagacgcggtgacgggctacattcacaagcacaacctctacggcgtgaggcagaccaggtacggctcggttgagggggatgcgtatggaaggcgttcgtgacgaggggggcctcgatgcggggcaggagcgcatcgtgcgccgcctggagggggacctcaagaagaggatggcggaggttaagcccaagcggtacgcgcactcgctctccgtcgccaggaccgcccaggacatggcggtcgagtacggggcggaccccttccaggcaagggtggcagggatcctgcacgactgggacaaggtcgtgcccacctccgagctcgtctcccgcgcgcgcgacatggggatcgacatgggcgtggacctcgaactcgtcgcgcccctcctgcacggcctcaccgcggcccgcgagctcccctcgcgctacccggagctcccgcaggcggtgtggagggcgatctcgctgcacaccgtcgggtctgccacgatgggcgccctcgacatggtcctcttcgtcgccgacgggatcgagccgcttcgcaaggggtctgcggggattgagcacgtcagggacatggtcaggagacacgccccgctgcacgaggtgtatgcggagtcgttctgcggcggcgtggagtacgtggtccagacgcgcaggtacctctatccgggtaccattgacatatacaaccggctcgtcctgggacggacgggcgcctaggcgcactcggaaggaattcgaatgacagtcacaccgctccagctcgcaaaggtcgccgccaccgcggcggacggcaagaaggccggcgacatcgtcctgctcgacctctcccaggtctcggacatctgcgactactttctcatctgcaccgcgcagaacaagccccagatggacgcgatcctcgacggtatcgaggagaaggtcaaggtcaactgcggcgagtcgcccctctccatggaggggcgcgggggctccgactgggtcctcctcgactacggcagcgtcgtggtgcacgtgttcaagcccgaggccagggacttctatcgcctggagagcctgtggggcgaggcgccgagggtcgaccttgggctcgccgcccccaaggacgaggcggcaccggaggagtagcccgcgggcggctcagtcgcccctcagcctgaggtccctcccgtagccaagggcgtcgtccccaaacttgcgtcttacctcgtccgccacggacgagaggcgacggagcgaggggtcggcgcccctctcgtcgtccgacgcaaagagcgagagctgcgtgggcctctgcggcccaaagtcactgaggccaacgcccaccaggcgcacgggcgtcccctcccgccagaggccgtcgagcagggagagggccacagggccaaactcgtgctcgtcgtcgctggggcaggggagcctcctctgcgcggtgtgggtgtgctgccggtcgaacttgagcttgagcgtcacgaggctccccttgagcccgcgctgccggaggcgcctgcccgtgagctcgctcacgtgcccgatcgccgcggcaagttcctggcgggtcacgaggtcgcgcgggaaggtgcgctcgtttgagaccgacttgggctcctccgcatccgagagcatcgacaccgggcttcgctcctggcctgcggcgcgcagcacgagcgtgggcccaaaggatcccagcagcctgcgcatgcgctccttgtcttgcgccgccagctgtcccagggtcctcacgcccatctcctccaaccgcctctccgtggcaggtcctatcccgctcatggcggcgacgggaaggggggagaggaactccgcctcggtccccggggtcaccaccgtgaggccgcggggcttctgccgctccgaggcaatcttcgcgaccgtcttgctggttcccagccctatggagcaggtgatccccagggcgaagacgcgcccctggatgcgccggcagatggcgacggggctctcgtgggaccacctcccgggcgtgacgtcaaagaacgcctcgtcgatggacatctgctgcacgcggggcgtctcgtccgagaggaacgacatgacctcccgtgacacctcgcggtagcggtcaaagtgaccgtgcgtccagatggcctgcgggcagaggcgctgtgcctgaaacgagggcatggcggagtggacgccgaagcgcctcgcctcgtacgaggcggtcgagacgacgccacgctcctcgggcgaccctcccacgatgaccggcttcccccgccactcggggtggtcgagcatctcgaccgacgcgaagaaggcatcgaggtcgaggaggcctatcgcgggaccatgccatgccggcgcgtcaaacggttgttcgcttctctcatccatggcaagaagtatagggaaaagggccccgggggagacgtcacccgcggccctttggcaaggcgtcgacgctacagcgtcacggtgaaggtggtgccgtccgccttggtgctcgtggccttgatggttccgccgtggacctcggctatgcccttggcgatggcgaggccaagcccaaagccgccctgctcgccctcgccgcggctgcgtgccttgtcgctgcggtagaagcggtcaaacaggtgcggcaggtcctcggggtcgatggggtcgccctggttgttgacgctgagcacgatgtgctgcgacgtccgcttgagggtcaccttgacctcggtccccttgcgggcgtacttcgtggcgttgtcgatgaggatctttgcgaggcgccccagccactcgcgatcgccctgcacgtggatgccctcctccacgctcgcgtcgagcgtgacgccccggtcgaaggcgaccgcgtcaaactccagcgcgcaggagtcgacgatgtccgagaggttcacgtcctccttggtgaaggcggaggtggcgccacccgccccctcgtccgtcttcgccagctgcagaaggtcgttgaccaggttcttcatgtgcgtcgcctcgtcgtgcgtgctctgcacccagcggcgtgagtcgtcgctcagattgccgtcctccaacaggatctgcgagttggcgaggatgaccgagaggggcgtcttgagctcgtgcgacgcatcggagatgaaccgcctctgacggtcccaggcgtctgcaacgggcttgagcgaccagtccgcgagcttccacgagatggcgaacatggcgagcatggcaagcaccatgatctcggcgtcacgcacgacctggttgctgaagctgcggtctgcggcagtcgtgtccaccatcgagatgcgcacgctgccgtcgctctggaccgcgcgcttccaggcgatgtgcctctccgagatgaccccgccgtcatccgccgacttgagggcagtgcggatgaccttcctcagggtctcagtgctgatgagggcggggtagtcgctcgtctgcaggatcaccccgtcgtccgagactatgacggcgatggagagcatcccctccccgtgactcgatccctggggcccacctatggtggggacggagttgaggtcgccctccaggttcctctccagcgcgtggtcgatcagctccctctgtgcggaccagctcgcgtgcagggagaaaccaaggacgctcgcgagaaccacccccacgagcgccatgacgatgactatgaacttcttcttgagcctcttgagcacccctcggccctcctactgctgggccttgaactcctccaggcggtatccgagcatgcgcagcgtggtgatctgcacgttggagtggatgtgcgccatcttcttgcggaggaacgagacgtacgcctcgaccgagttctcggaggccgcgctgtcggtgccccacacgcgggtgagcaggtcctgcttcgagaccacgcgcgcggtggggctcatcaacatcttcaggacttcgaactccttgccggagaggtgcacggtgcgctcgccgcagctcaggtcgtgggtgttgaggtcgagcttgaggtcggcaaacgtgagctcgtcgatgacaacgtcgccctggcgcctggtgagcgccctcaccctggcgaggagctcgggggcctcgaacggcttggtcatgtagtcgtccgccccggcgtccaggccctctaccttgtcgttggttgaggtcctcgcggtgagcaccatcacggggatggagttgccctcgtgcctcagctcgtggaccacggagagtccgtccatgccgggcagcatcacgtcgaggatgaccgcgtcgtacatgccggtctgcgcggatgcaagccctgccttcccgtcgtaggctgcctctgcgttgtatccgccgtcctcgaggatgtggacaatggcgtcggcgaggtttcgctcgtcctctacgaccaagatgttcaatgcgacctcctagaaaggaaatgtccgtgtcccaaaagccactcccattggctttcagcagctttggctagcttacttcgcagtactgaaatcctgcttaacatttttcccgcgggggcgttttttgagggcttatgctaaaagctctccacatttctgagttccacacaatttgtagcggggtggcatctctcggtggcgtatgatatacaggcttttgtgtggtttagcgacgcatcacatcaccgaccacagcgtcgctcgtaagaaggagttcaactttggcagtcaagattcgtctcgcccgtcacggtgcaaagaagcgcccgtactaccgcgtcgtcgtcgccgacggccgcatgccccgcgatggtcgctacattgagcaggtcggccgctacaacccgctcaccactcccaagacgatcgagctcgacctcgagaagatcgacgagtggatctcgaagggtgcccagcccagcacgactgtctcgcacctcatcgacatcgtccgcaccggcgctcccgctcccgagaagaagcagaagctctccaagaaggccgctgccaaggctgctgccgcagccgagtccgcggagtaggtgccgtgtccgaggaaatggcggatcaagccgattccctcgaccagaccatgggctccgatgaggagcttccctccgacaaggtcgcggatctcgtcgagtacatcgtctgtggcctcgtgaacaacgaggacgcggtctctctcgacgtcaccgacagcgagggctcggccctcatcgaggtctcctgcgacgaggaggatgccggtaggatcatcggcaggaagggccgcacgatcaaggccattcgcacgctcgctcgcgcgcttggctctcgtgtcggaacctccgtcgaggttgaggtcttggggtaggcagcttgcatacacgctacagagccatagctcgcgtgaccaaggctcacggtaggaggggggaggtcgtgacggtttccgttcacggccttccccctctcctgcatgatgggctcgaggtcagcattgtccctcccgctctcaaggggccgcgcagccgcgccgtcacgtccgtctccggtgacgagggtggcatgctcgtctcgctgtcgggggtcgaagacctcaacgccgcggagcgcctggtgggccgaacgctgctcgcccgttgggatgaccttcccgacgggttcgagcttcacgacgccgacgccctggtgggcagggaggtccatgacgcccggcttggtgacctcggccacgttaccgaggtcatgcgggggccggcaaacgacgtgtgggtcgtggagggacctcacggggaggtcctgctccccgtcatcgacgaggtggtgtcctccgttccgcctgcgggggccatccaggtcagcgccccccagggtctgattgggggtgcgcagtgaggttcgagacgctctccgtctttcccgaggtgttcgccccctacctcgacgcctccatcatggggcgcgcgcagcggcaggggatcctcgagttcgaggcctacgacctgcgcgactggacgcacgaccggcacaggacggtcgacgacgcgcccttcggcggcgggcagggcatgctcatgaagccggcccccatcttcgaggcggtgcgggacatctccgggcgcggagaggcgcgtccgcacgtcgtgttcttctcgccctgcgggacgcgctacgacgagggcgtcgccgagcgcctctcccatctcgaccgcgtgctgctggtctgcggccgctacgagggcatggacgagcgtgcgtacacgctcgcggacgagacgctctcgctgggcgactacgtcctcacgggaggggagctcgcggccctcgtcgtgatcgactccgtcgtgcgcctgctccccggggcgctcggggacgacatgagcgcgagggacgagtcgttttcggacggcttgctcgagtacgcgcagtacacgcggcccgcggactatgatggtctgcgcgttcccgaggtgctcctgtcgggggaccaccagagggtgcgcgagtggcggaggcagagtgccatacgcaggacggcgtcctggcgtcccgacctgctcgaaggggcggggctcacgcccggtgagtgggagctggcgcgcagcgtgatcgacgagcgagaggggagtgtggaccatggcgaggagtgagggcaagggacatcgcatccccggttggctcgagctcgtcctctgcgtcgtcgcgggtctcctggttgcgctcgtcatccgcaggtacgtcgccgaggtgtacatcgtcccctccggctcgatgctcgagaccatccaggagggcgaccgcctcataggcgagaaggtcagcatcaagacctcatcggtgtccgcggggcagatcgtgaccttcacggatcccgatgacccctcgacgacgctggtcaagagggttatcgccacgggtgggcagacggtcgaccttgtcgatggcaaggtctacgtggacggcaaggccctggacgagccctacacgctgggcaagccgtcctacccgctggaccagcactcgaccagcctgcaggaggccatctcgtatccctacacggtcccggagggctatgtctgggtcatgggagacaacaggaccaactcgctcgactcgcgctactttggcgccgtgagcgaggacagcatcacgtcgcacgtggtctgcgtcgtctggccgccaagcgacatcggcgcgctctgaggcgcataacgacaacgatgggagaagtttcacgatgagcagcgataaagcgctgacgttccaggacctgatcctggcgctcgagcactactgggcggagcaggggtgcaccgtcatgcagccgtacgacagcgaggttggtgcgggcaccttccacaccgccaccacgcttcgctccctgggccccgacgcctggcgcacctgctacccgcagccgtgccgccgccctgccgacgggcgctacggcgagaaccccaaccgcatgcagcactactaccagttccaggtgctcctcaagccctcgcccaaggactcccaggacctctacctgggctccctcaaggcgatcggcctcgaccccgcgcagcacgacgtccgcttcgtcgaggacgactgggagagcccgacgctgggtgcctggggccttggctgggaggtctggctcaacggcatggaggtcacgcagttcacctacttccagcaggtgggcggcatcgaggtcgaccccgtcccggtcgagatcacctacggcctggagcgcatcgccatgtacgcccagggcgtcgactccgtgtacgacctggtgtggagctatctccccgacggcacgcccatgacctatggcgacgtcttcctcgagaacgagcgcgagttctccgcctacaacttcgaggtcgccaacgtccagatgatgcgccagaagttcgacgactacgaggcggagtgccactcctgcctcgacgcagggctcccgctgcccgcctacgactgcgtcatgaagtgcagccactcgttcaacctcctcgactcccgcggagccctctcggcggtcgagcgcgccaactacatcctgcgcgtgaggaccatcgcaaaggcctgctgcgaggcgtacctcgccaaggtcgcggagaagggcagccagaagaagggggaggtggcctaggtggccgacagcaaggacttcctactcgagatcggtaccgaggagatgccctcggcacccctcaacaacgcggtcaggcagatcggcaccctcgtgaagaaggggttggacgaggcggggctcgcgcacggcgacgtccgcgtggtctcgtcccccaggaggctcgcggtgctcgtctcgtccgtggccaccgccaccgacgaggtccacgaggtaaagcgcgggcctgcggccaagatctccttcgacgaccagggcaaccccaccaaggcggccgccggcttcgctcgcaagttcggcatccaggcctccgagctcgtgcgacgcgtggacgccgacggcagggagtacgtgtttgccgagaagagcatcccctcgctgcccgccgttcccatcctcgccaggctctctgaggagaccatcgccggcctccagtggcccaactaccgcagccagcggtgggggagcgagcacgccaccttcgtccggcccatccgctggatctgcgccatgctcgggcaggacgtggtccccgtgacctacgccgacgtcaccagcggcaacgtcacgcgcggccaccgcgtcctcggtcccggcgagcacgtggtgagcgagccctccgcctacgagggcgtgctggagtcctgcggggtcctctcggccgagaggcgcaggcaggtcatcctcgaaggcgtccgcaaggtcgaggaggagcgcggcggcgcgagggtcgacatgcccaagaaggtcttcgacgaggtcgtcaacctctgcgagtggcccacggtcctggtgggcaccttcgacgaggagttcctcgccgtcccgcacgagatcatctgcgagtcgatgctctcgaaccagcgctacttccccatctatgacgcggagggcaacctcacgcgcgagttcgtcgtggtctccaacgccgaccccgcctgctccgagcgcgtggtggacggcaacgagcgcgtcgtgcgcgcccgcctctacgacgcaaagttcttctacgacgaggacctcaggcacccgttggagtactacgtgcccaggctctcgtcggtcgtgttccaggagaggctcgggaccgtgctccagaagacggagcgcatggaggccatcgcgcccgccgtcgcgaagggtgccggcgagggcgaggacatcgcacgtctcgccgggcgcgctgcgcacctcgcaaaggccgacctcgtgacccaggcggtcgtcgagttcaccagccagcagggcgtcatgggcggctattatgccaaggcctcgggcgaggacgaccgcgtggcggacgccatcagggaccactaccgcccacgcttctccggtgacgagctgccccagggcatcgtcggcaagtgcgtggccgtcgcggacaagctcgacaccgtctgcggcatgttcgccatcgacgagccgcccaccggctcctccgacccctttgccgtccgtcgctccgccctgggcgtcatcgccatccttcgcacgctgccgcaggtctcgcttcccgcgctcatcgagtgctccctcagggcgtacgccgaccaggggctcgagttcgacgcggagagggtcgcctccgacgtcgcgtccttcttcgcgagcaggctctcggccatcgcccgcgacgaggggatctcgcccgacaccatcgaggccgtctcgtccgtgggcgtcatcgacccggacgagttcctggagagggcgcacgccctcgaggacgcccgctcggaggccccggagctcttcgacgacctcgccaccgcgtactcgcgcgccgcgcacctcgccgacccgagcctggggagcgaggcggacgaggcaagcatgggcgaggcggagctcgctctcctcgaggcctgcaggcagggtgaggccaatgtggagaaagcgttggcaaaccgtgactatccggccgtctgccgcgccctcgccgagctgagggaacccattgaccgtttctttgatgacgtactcgtcatggacgaggacactaaggtaagggagaaccgcctcaggcttctcaaccgcttcgccggcgtgttctcgggcgtcgccaacatcggggcgctctccaagaagaagtagggtcggcgccgccccgccccctcgggggcggcgcactttagagttgggaggaacgcacatgccagaagattcccttgacgatgacgtcatggagcacgtgacgccggtcgtcttcgttctgtccgacgcgcgtggcaagaccgcggcaggcgtggttgaggctgcggcggaccagtttggcgaggacgccgtcatcatcaagcagctcggcaacgtccgctcggtcgacatggtcaaagactacctcgaccgcaacctcgaccccggggttcccgtcgccgtgttccacactctggtcgaccgcaacctcaggcgcgacatccgccgcgagctggacaagaggggcatcccctcgatcgacctgcttggacccgcgatcacggtcctctccacgctcaccgaccaggagccaatctaccagcccggccaccgcaccgacaccgaggtccaggaggtccagtagcaatcaggcccatggtacccctaggccgtcccaaaggtgggcacggtcctctcacgggcggataagcgccgttgaatggaccgacaaacgcataaacgggatgctggatacaataaatcccgatattgaaaatgtctgcgtcgacaggttcgatgtcagacattttctgtatggaacggttcggcagttccgggccagcgtctaccagaaggagtgctatggctgagaagcatgtgtatcgcttcgggaaggacgagaacggcgacaacgtgaccgaggtcgccggcaagaccgtcgacgaggcgaagtggatcacgggcggcaagggcgccaaccttgccgagatggccaacatcggcctgcccgtccctcccggtttcaccatcacctgccagacctgcgtcgcgtactcgggcgccggcaacgtgtggcctgatggcgtgctcgacgagattgacgtctaccgcaaggacctcgagaagcgcatgggcaagaagatcggcgacgccgacgaccccctgctagtctccgtccgctccggcgcgcccttctcgatgcccggcatgatggacaccgtcctcaacctgggcctcaacgacaagtcggtcgagggcctcgccaagcagaccaacaacccccgctttgcctgggactcctaccgccgcttcgtccagatgttctccaacgtcgtcatgggcgtcgatgggcagctgttcgaggacgccatcaacgagaagaaggccgagcgcggcgtcaagctcgacaccgagctcgatgccgacgacctcaaggacctcaccgagacgttcaaggagatcttcgcggtcaacgtcgactccacggctcaccccgaggtcgcgcccgagggcgtcgcctccttcccccaggacccctacctgcagctccgccttgccgagcaggcggtcttcggctcctggaacaccgagcgcgccatcctgtaccgcaagcagaacaagatcgacgacaccctcggcaccgccgtcaacgtccaggtcatggtcttcggcaacaagggcaacacctccgcaaccggcgtcgcgttcacgcgcaacccggccgacggcaccaacgagcgctacggtgacttcctggtcaacgcccagggcgaggacgtcgtcgccggcatccgcaacaccgagcccatctccgacctggtgaagatccccggcctcgaggaggcgggcaaagagctctaccacgtcttcgagatcctcgaggaccactacgccgacatgatggacctcgagttcaccatcgagaacggcaagctctggatgctccagacgcgcgtgggcaagcgcaccgccctctccgcgctccgcgtggccatgcagatggtcgaggagggccgcatcacgcgcgagcaggccatcatgcgcgtcgccccctcgcagctcgaccagctcctgcacccgcagttcgaccccaaggaaaaggtcaaggtcgtcgccaagggcatgaacgccagccccggcgcagccgtgggcgccgtcgtgttctcctctgacgccgcggtccactaccacaacatcgagaagccctgcatcctcgtgcgctgggagaccacgcccgacgacctcaagggcatggtcgccgcggagggcatcctcacctcccacggcggcaagacctcgcacgccgccgtcatcgcgcgcggcatgggcgcgccctgcgtctgcggcgccgaggcgctgaagatcgacgccaaggccaaggagtgcagcatcagcgggaccgacatcgtcctgcacgagggcgacgtcatctccatcaacggcaccaccggcgacgtcatcctgggcgaggtgcccctggtcaggcccgagctcaccggcgacctcgagaccatcctcgagtgggccgacgaggtccgtcacgacgcctcccgcggccgcctgttcggcgttcgcgccaacgcggacaaccccgccgacgccaagctgtcccgcgacttcggtgccgagggcatcggcctcgaccgcaccgagcacatgttcctgggcgaccgcaagcagatcatccagaccttcatcctcgccgatcgcacgggcgacaagcagacggccctcggccagctgctcaaggcccagaccgacgacttcctggggatgttcgaggccatggacggcaagacggtgatcgtccgcctgctcgacccgcccctgcacgagttcctcgacaacccgcgtgactacgccgtcgcgctggcgcacgccgaggaccgcggcgagaacgagacccaactcaaggcccgtcgcgacatgctggcccgtctggactccttccaggaggccaaccccatgctcggcctccgcggctgccgcctgggcatcgtctaccccgagctcaccgagatgcaggttcgcgccatcgccggcgccaccgcgcacctcaagaagcgcggccttgaccccaggcccgagatcatggtcccgctggtcggcacctaccaggagcttcaggtcgagcgcgagcagatcgaggccgtcatcgcctccgtctccgagcagaccggcgtcgacctccagatccccatcggctgcatgatcgagatcccgcgtgccgccgtcaccgccgacgagatcggcaagtacgccgacttcttcagctttggcaccaacgacctcacccagatgggctttgggtactcgcgcgacgacgtcgagggcgcgttcgtccccctgtacctcaagaagaagatcctcaagtccaacccgttcgagacgctcgactacggcatcgccaagctcgtgaagatgggcgtcgagggtggccacaaggccaacgacaagatcgtctgcggcgtctgcggcgagaccggcggcgacccggactccatccagatgtactacgacctcgggcttgactacgtgtcgtgctccccgtaccgcgttcccatcgcacgcctcgcgggcgcgcaggccaagatcaactccaacggaggcccgcacacccttcccaccaagtagggcagagggctgagctagctcgctagggggcgccgccggaatgtcggtggcgcccccatctgtgtgggtttggaagattggggagacgcacctctccaatgtttgcgcttatcgccatgcggggctattattctctcttgtgtgtaaacctatgtgccgctcggtactcgacggcacctctagagacgaggaaaccatggactacatccgggcaatcgagcgtcagcagatccgcgaggacatccctcaggttcgcgttggcgacaacgtcaaggtgcactaccgcatcaaggagggcgaccgcgagcgtgagcaggtcttccagggcgacgtcatccgcatgagcggcggcagctcccgcgagaccttcaccgttcgcaagatcagctttggcgtgggcgtcgagcgcaccttccccctccacagccccaagatcgccaagctcgaggtcgttcgccacggtgccgtccgtcgcgccaagctgtactacctccgcgaccgcgtgggcaaggccgctcgcatccccgagaagcgctaagtccaattttggagtagagaggagccgtcccatgcggggcggctctttttgtgaggaggcatcatgtccgagggccctcggggcgcgaccgcgcgagagatcgtcgcgatcatcaacgacgcccccctcgaggaggtcgaagacctcgtcaggcggtatggtgacgacccgcgcaagcaggtcagggccgccgtggcccgcgccgtccgtcgcggtgacgccgagcgtgcggagcgggaccgcgtgagggccatgtacgagctccaggcgcagatgggcgggaccggcctggtgatgggcgtcgacgaggtcggcaggggcgccatagccgggccgctcaccgtcggtgccgtgattctccccccagagcccatcatctgggggctcaacgactcaaagcagctcacgccggctcgcagggaggtccttgcggcccgcatcgccgaggtcgccacggccatcggcatagcccacgtggagcctgcctccatcgacgccgtgggcatggcctcggcactcaggttcgccatggccaaggccatcgatgacgcgggcgtggagcccgactgcgtcctcatcgacggtaaccccgtccacgtccacccaagggagaagaccctggtcaagggagacgcccgcatcgccgcgatcgccgccgcatccatcgtcgccaaggtcacgagggactccatcatggttgcctacgacgaggagtacccgggctaccaccttgcggagtgcaagggatacgggtctgcagcgcacatcgcggcgatccgagagcgtggtctcacccccatccaccgcgtctcgttctgtgggaactttctggagacgccccctctcttctaggtctcgcgtcgaaccccgcgccgtatcggctgatggctccgaccagcttggccctgcgtgcccgatgcgccttgcccgctctgccagcctcacgccctgccggggcgagtcccgcgccaccctcccgtgcgaagatcgccccactgtcgtgcgaggcaagggaggatgcgatgtcaggtctggaagggtgccccttcgagggccgcgaggacgagtccgcggagaccatggagggaacgcgcgtgtgcgtgaaggagccggtgtcgccaaccccgcccgaggagtcggacggatgtccctgcccccgtcgcggggagcgcggaggaaagggcgccagggaactctcgccccacgagctcggcaggcgcggggaggagcttgccgcatcctacctggagagccgggggctcgagatcgtggagaggaactttcgctgccgctccggggaggcggacatcgtcgcctgggaggacggggagtacgtccttgtcgaggtcaagaccaggcttgccatcggacgggagcgcgagagccttcccgagctggcggttgactccgacaagcgggagcgctaccgcaggatcgcgctcgagtacatgatgctccatcccgaggtctcgttcgtgcgctttgacgtgattgccatcaacgtggtgggggagaggcaggcgagcctccgccatttggtgggtgcgttctcatgggacgagtagatgggcggctcggtctgcgtcaccggggcctgcgtcaggggcgccgaggccctgcccgtctcggtcgaggtcgcatgctcctctggcatcccggggatctccctggtgggaatgccggactccgccgttggggaggcacccgcgcgggttcgctgcgccatctccgcctgtgggttcaaggtcccaaggctccacctcgtcgtcaaccttgcccccggcgagctgcgcaagaccgggacgggacttgacctgcccatcgcggtcgccatcctcgcggccacgggacagatcccgacggaggggctttccgagtgcctcttcgtgggcgagctctccctggagggcgaggtgcagcccgttcgaggcgccgtcgcctaccagaggctggcgggaacgctcgggctcaggctcgcctgctcccgtgactgccgcctcgtgccggactggggcgaggtcgccgtcatgtgccgccttgcggagctcaggcagggcacgaggtcgctccccgtcccgccgccctgccctcccgtcgcagatggaggggaggattccctcgacttctcgcaggttcacggacaggaggaggcgaagcgggccatcaccatcgccgcggcggggtcccacgggctgctgatggtcggcccgccgggggccggcaagaccatgctcgccaggagggttcccggcatactccctcctctcaccgaggacgagagggaggaggtcctgctcatggcctcggttgccgggcagcccaccgagtccgcgttgcggggcgagaggcccttccgctctccccaccactccgtctcgatggctgggctggtgggcggcggcaggccggtcatccccggggagatttcgctggccgaccatggcgtgttgttcctcgacgagctccccgaattcgccggcaacgtcctccaggcgctcaggcagcccatggaggaggggcaggtgcggctggtcagggcggacggtacgtacgcgttcccctgcaggttcctgctcatcgccgcggcgaacccgtgcccctgcggacactacggggaccccggcaggcggtgcacctgcccgccggggcgggtcgaacggtaccgctcgcgcatcggagggccgctcatggaccgcatcgacatccacctgggcgtgaggcgcccggagtcgggcgaggtgctgggaggcgacggcggagccacgacggcgcagatgagggaccaggttgcacgggcgcgcgagttctcctcgtggcgtgagcgtcggggcgacgactcggggagcctctcccggcggctcgggctggacgagagggcaaccgcctgcctggaggggcttggtaggaggaactgcctgggagggcgctccatagtcaaggtcgcccgggtcgcgaggaccatagcggacttgcagggccgggagacggtctcgagggacgacgtcaccgaggcgtccctgtaccgcgggctgcaataggaggggacatggaagagagggtcatcctgaggcgtggcggggagggctacccaccccggctcctcgacctgcccgaaccacccgagcgcctctacgtcaggggagaccccgatgcgctcctccaggagagcgtctcggtcatcggggcccgcaaggcgactccctacggcatcgcggcgtcgcggctcgcgggcagggtcgcggccgagtgcgacctcacgctcgtctccggtggcgccatgggctgcgactccgccgcggctcggggcgcgctcgacgccgggggaaggacggtcgtggtgtcggggtgcggggccaaccgggtgtatccgcggtcgtccgaggacgtgttcgagcgtgccgtggcgcagggcggcgccgtggtctcgctggagggctgggacaaccctcccaggaggtactcgttccccaagaggaacccggtcatcgcagcgctctcgagggccgtcttcatcgctgaggcgggggagaggtccgggaccctgggcacggcgctcgccgcggagcaggtggggagggacctctacgtcgtgccgggcagcatcttctctcccacctcgcagggggcgaaccagctcatcgcggacggcgcctacgtcatcacttccgagcgggacctcgaggcgaggatatcgctcgactacgacgtggtgcgtgcgtcggtgggcgatggggacggaaggcccatgggcagggtgctgagcgcgctcctgggcgagccgatgcgcgcggacgaccttgcccgccacctggacgcgcccgtcctcgacgtcattcggtgcgtctcggactacgaggcccgcggggtggtggagcgcatgcccgacgggaggttcagcctcagtgccgaggcgtacctggcgagggagaggacgcacgtcacggacgggcagggcaccttggggcttgcgatggagggggacgcgggcgcctggcgtggaggcgcgcccccagggtcgccctcgacgtacgccggcgcccctctcgggtagaatccctaccacgagagggcccggtgccgcactggcgaccgggcgcctgggggatcttggagaggagccgccttgtcggagcaggtaacggtcatcggtggggggctcgccgggagcgagtgcgcacttcagctcgccatgaggggggttcccgtgaggctctgcgagcggaggcccacggtcgcctcgcccgcccatcacaccgaccggctcgcggagctcgtgtgctccaactcgctcaaggcgactcggcacgacagtgccgcaggcctcctgaaggaggagcttgcggcgatggggtcaaggctcctctcccttgccagggaggcgtccgttcccgcgggaggggcgctcgcggtcgacagggacgccttctcgctcgccgtcacccgggaggtagaggacagcccgctcatcgaggtcgtgcgcgaggaggtcgaccagatacccgacgggtggtgcgtgatcgccgcgggcccgctctgctcggacgggctgttcgacgccctcacccgcaggctggggtccgagcacctggcgttcttcgacgccgccgcgcccatcgtggacgcccagaccctggacagggacgtcatcttcgagcagtcgcgctatggcgaggagggtgggggagactacctcaactgccccatggaccgcgaggagtacgaccggttctacgacgcgctggtgtccgccaagcgggtcgtttccaaggagtttgagcaggcggacctcttccaggcatgccagccggttgaggaggtcgcacgcaccaaccgcgacacgctcaggcacggggcgctcaagcccgtgggcctcaccgaccccaggacgggccggtggccctgggcggccgtccagctcagggccgagaacgccgagaggaccgcgtacaacctcgtgggcttccagaccaacctcacctggggggagcagaagagggtgttccgcatgatcccggggctggaggaggccgagttctttaggtacggtgtcatgcaccgcaactcgttcgtggactcccctcgggtcctcaaccgcaccttcgcgatccctgggacgcactgcaggctggcggggcagatcacggggaccgagggctacaccgaggcgatcgcctcggggctgctcgccgcgctcaacacgtacgcgcagatgggcggcctcccgccggtggagctcccgcgcaccagcgcgcttgggtcgctcgtcgcctatgccaccgaccccgccaccgagccctaccagcccatgcacgtcaactttgggctggtgcctccccttggcggggggcggcgcaagaagcgggagcggtacctggcgtatgccgaccgggccaccgaggacctctcgcgctacctggcgtcgaggtcggacctcttcccgggtggccccagccgtggctgacgctcccgcgacccccgaccgcgcagccgaccaggcggagctcaggaggcaggtcccccgcttcctccgctcgctccgggtggagaggaacctctccccgcagaccgtccgtgcctatggctccgacctctcctcctactgcgactgggcggagcgcgagggcgttgaccccctgctcgtgtcgcaccggcagctgaggggctacctcgccgagctcgtctcggcgggatacgccccccgcacggtgagcaggcacctctcctcgctcaggacgctctaccgatggcttctccgcgagggcgtcgtgtcggtcgacggcgcggccgccgtctcgagccccaaggcgggaaggccgctcccgcgtgtcatgagcgacgcggaggcgtcccggctcctctccacgtgcgacatgggcgacgcgtgcgggctcagggaccgcgcgttcctcgagctgctctatgccacgggcgcccgggtctcggaggcctcggggctcgacgtgggtgacgtcgacctggcccagggacaggtcaggctcttcggcaaggggtccaaggagaggatcgtccccatataccgggggtgctgccgcatcgtccggcactacctcgaggagtctcggcccgcgctcgccgccaggcgaaggggcggcgagcccacgcgggctttgctcctctccaccaggggaaggaggatgtccgccgacgcgctgcgcacgtgcttcgagcgccacgtggcgcaggcggggctcgatcccacgctcacgccgcacgccatgaggcacaccttcgccaccgagctgctcgcggggggcgccgacctcaggagcgtccaggagctgctgggccatgcgagcatcgccaccacgcaggtgtacacgcacctctcggcgcagaggttgctcgaggaggcgcggcaggcgcatcccagggccgagtgagttcggcggggctcgactttgggcgcggtgcgcttccatggcaacttgtggagcgcccatgtgcgggagagcgggttggcagctgggtttgcacgttgctataatgtgaactcgctgtgcagaagcatggcgacaagacacacgcgtgacgactcgcgggccatggtgcctggggcgcagccaagccccgggtggttccgacggggatgacatcacgcggaggacaaaccaacggaggtttacacatggctgtcaagatcaacatccgcacccttctcgaggcaggctgccactacggtcaccagacccgtcgctggaaccccaagatgaagccctacatcttcggcgagcgcaacggcatctacatcctcgacctcaagcagaccgtcgtggacgccgacaaggcctacaccttcctcaaggacacggccgccaagggtggcaagatcctcttcgtgggcaccaagaagcaggcccaggagcccatccagacccaggccgagcgctgcggcatgccctacatcaaccagcgttggctcggcggcatgctcaccaacttcgtgaccatgcgctcccgcatcgaccgcctcgaggagctcgaggccatggtggaggacggccgcatggccgcccgcggcaagaaggagcagtccgtcctcaccaaggagctcgagaagctccagcgcaacctgggcggcgtccgtgacatgcgcaccctcccgcaggccctcttcgtcgtcgacaccaagcgcgaggagatcgccatccgcgaggccaacaggctgcacatccccgtcgtcggccttctggacaccaactccgaccccgacgtcgtcgactacggcatccccgctaacgacgacgccatccgctccgtcaacctcatgtgcgagctcgtcgccgacgccatcctggccggcagcggcaaggagcagatctccgagcaggagatggcctccggcgagacgacccccgcggtcgagacctccgcagccgaggctcccgcagctgagtagcgttcgaacgcattagataggagagatacatggcacaggttactgccgcactggtcaagcagctccgcgagatgaccgactcccccatgatggagtgcaagaaggccctcgtcgaggccgatggcgacatcgacaaggccgtcgacgtcctccgcaagatgggcgttgccaaggccgtcaagcgtgccggccgcgacaccaacgagggcaccgtggcagcgtacgtctccgaggacggcaagaccggcgccctcctcgagctcacctgcgagaccgacttcgtgggcaccaaccccaagttcaccggcttcgccaacgacctggccaaggtcgtcgctgagaacgaccccgccgacgtggacgccctgctcgcgctccccatgggcgaggacaccgtcaaggacgagcttaccgagatgatccacgtcatcggcgagaacatgaagatcgcccgcttccagcgcgtcaccgttgagaacggcgcgctcgccagctacatccacctcggtggcaagctcgcggacatcaccgtgttcgagttctccaagcccgagaccgcgcagagcgaggagttcaagaccttcgcccacgacgtgtgcatgcaggtggcggccatcgcccccgtctccgcccgtcgcgaggacgttcccgaggacgtcatcgcccacgagaagtccatctacatggcgcaggctgccgactccggcaagcccgagttcatccaggagaagatcgccctcggcaagctcgagaagttctacaaggagaacgtcctcaccgagcaggagttcatcaaggactccagcatgaccatcgccgacctggccaagaaggtcgacaaggccacgggggacaccatccagatcacccgcttcgtgcgcttcgcattcggcgagtaacgggattcctagcaggggaagggccgatgcctcagggcaccggcccttcctgtgtgtctagaccgtccgctcgcctttgggtgggggaggcgcgttggcgcctctgatagaatctgtggggcatcgtggaaggcttgcgtgcccttcaccacaacgtgacaggaggctcgacttgtctgactacaagtacaagcgcgttcttctcaagctctcgggcgaggccctcatgggctcgaaggagtttggcatcgaccccggcgtccctcagaagattgccgacgacatcaaggcagcgcacgaggccggcgtgcagattgccgtggtcgttggtggcggcaacatcttccgcggtctctccggtgcggcggcgggcatggatcgcgcccagggtgacaacatgggcatgctcgccacggtcatcaactccctcgcgcttcaggacaccttcgagcacaacggcatggagtgcagggtcatgagcgccatcgagatgcatgcgatttccgagacctacatcaggcgcagggccatccggcacctggagaaggggcgcatcaccatcttcgccgcgggaaccggcaacccgtacttcaccaccgacaccgcggcagcgctccgcgcgtgcgagatcggcgctgaggtgctcatgaaggccaccaaggtagacggcatctacgacatggatcccgtctcccaccccgaggccaagaagttcgataccatcagctacatggaggtactcaaccgcgacctccacgtcatggatgcgacggcgacggccctctgccatgacaaccacatgccgatcatggtcttcaacctcgacgagaagggcatctttgacagggccctcaggggcgagagcgttggaaccaccgtcgtagacgaatagggaggctctcatgagcgagtacggcgactttgccaagaagcacatggacaagtgcatcgaggggctgaggcacaacttcgcgaaggtccgcacgggccgagcgaacgcgcacgtcctcgatgacatcaaggtcgactactacggccagcccacgcccatcacgcagctggctggcgtcaaggtgcccgaggcctccatgctcgtggtggagccctgggacaagacggccctcaaggccatcgagaaggccatcgagtcctccgacctggggatcaccccctccaacgatggcgtctcgatccgtctccccttccccaagcccaccgaggagcgccggcgcgagctcgccaaggagtgcagcaagtacggcgaggaggccaaggtcgccatccgcaacgcccgtcgcgacgccaacaacaaggccgagcgcgacgaggacctctccgaggacgacgtcgcccgcgtgaagaaggaagtccagaagatcacggacgactacgtcaagaaggtcgactccctgctcaaggagaagaccgcggaggtcatggagatctaggcaacgccactggcgcacagtcgcttgagttggcgcgacagcccgtttcttgcgggcggtggacctaggagagagcgtgcccatccctcgacggaggggtgggcatctgcttttggcgcctgcatcaaggctggcggcaggggtggccttggaaaaccgtttgcggggcgaggttccgttgccggcatgcctctgcccgcgcgacccttgaaacacgcgtttctctcatagggaatgcaaataaattgcactgccgagcgtttgtgtgcatccatggaaagtgcgtcccaaatcaaaacgcgcactgtcgttatggcacactactcgcataatggaagcgcttgtgcatggacgctggcacaatgcttagttcgggataaccacttggccgagatggggtttcaggtgcagcgagacgaggggaagctccgcgagtactttgccgaggcgccgacggacatcagcctgggggacatcgacctccagcgcattccgtcgcacgtctccatcatcatggacgggaacggtcgctgggcccaggcccgcgggctcgaccggtccgagggacacgtcgccggcgtggactcgctgagggagacggtcaccacgagcgtgaggctggggcttgacgtgctgtcgtgctacgccttctccaccgagaactggaagcgcccgcagcacgaggtcgacctcctcatgcacctcttcgcgaccacgctgctcaacgagctcccgctctttcaccaggagaacgtcaggctgcgcttcttcggcgacctcgaggcgctccccaaggagaccttcgacgtgttccaggaggggcttgccgagacgagcggcaacacggggatgacgttcgccctcgccgtcaactacggctcccgtgccgagatcgcccgtgccgcgcgcctggtcgcggaagccgtggcctctggggagctcgctgcggacgacgtggacgaggaggcaatctcgtctcgcctgtacaccgccggcctgcccgatcccgacctgctcatcaggacgtccggggagctcaggctgtctaactacctgctgtggcagctggcatacacggagttcttcgtaaccgacacgctgtggccggacttctcccggtgggacatgctccgcgccatcaagtcgttccagtcgcgcaagaggcgctttgggggtgtcgtgtcaaagtgagcgagacaaacggggggacgagcgagtcgtctgagtccaaggagagcgcaatcgaccgagagatcgacaagctcgagaagaagcgcgaggagcaggaggacgacaggctctccggcaacctcaagagccagaaggcccgcggatggaccgagaagatgatcacccgcaccacctcgggcgccatctacgcaatcgtgaccgtggggtgcctcttctggggcgtcatccccaccgccgttctggtgtctgccatggcgtggctgtgctgctccgagttctatcgcatgtctcgcatgggcggcaggatgcccaacgagatcgtggggctcacggcggctatcctgttcccgctggcgcccgtcatctcgccccactacggcctcctggttgttatcctcctgctactcatcgcctgcgcggtgtggttcgtgttcaacctgcgcgtgaccatcggcgacgtcgcgatcacggcatttgggcccatctacacgtcgctcatgtttgcgtgcatcgtgctcatccgcaagtccgaccccgggttctggggcgggctcctcgcgtttggcgtgatgggctcggtgtggctcaacgacaccacggcgtacttcgttggctcgcgcttcggtcgccacaagctcgcacccaagatctcgcccaacaagagcatcgagggcttctggggcggaatcgtggggaccgtcgtcgtatggctcatcctcgcgcgcctcggcgtcgcgggcattggctacggcaccgccgttgcctgcggcatcgtggtgggcatcacctccgtggtgggcgacctcttcgagtcgcgcatcaagcgcggcgtgggcgtcaaagactccggcaacatcatgcccgggcatggcggccttctcgaccggtccgactccatgctcttcgcgagcatgaccgcataccttcttctgcactttggggggattctttgagcatattcgaggacacggccccaagggcgccccgcaggcgcccgatgcgcgtggccatcctgggagcgtctgggtccatcggtacccaggcgcttgacgtttgcaggcagcacgccgacaagctgagcgtcgtcacgatctccgtcaactcgtccaccgagcgcgccgtggccatcgcccgcgagtttggcgtgagccacgtggtcgtcacggacgagacgcaccgcaacgacccggtgctgcgcgaccttcccgccgggtgcgactgctcctttgggcctggcgcgctcgaggatgtggcctggatggacgacgtagactgcgtcctcaacgcggtcgtcggggcggcaggcatccacgtggggtacgccgcgctcaaggccggcaaggttctgacgtacgccaacaaggagtccatcgtcatcgccggcgacctccttatgccgctcgccaagcccggcatgctcgtccccctcgactccgagcacagtgccatcttccagtgcctggtgggggagaggcacgcggacatccactgcctgtggctcacctgctcgggcggtccgttctatggtctctctcgcgaggagctctctcgggcgaccgccgcccaggcgctgcgccaccccacgtggaccatgggtcccaagatcaccattgactcggcgacactaatgaacaagggacttgagatcatcgaggcccatcacctgttcgacgtccccatcgacgacgtccgcgtcctggtccagcgtcagagccgcatccactcgatggtcgagttttcggatggcgtggtgaaggcgcaactgggcccgtcggacatgcggattcccatccagtacgcgttcagctacccggagcggtgggcgacgccttccccgcgggtggactacgcggcgggcgagccgctcacctttggcgaggcggacgagaacaccttccgctgcctggcgctggccaagcacgccggcagggtcggcggcacgctcccgtgcgcgatgaacgccgccaacgaggtcgccaacctcgccttcagggaggaccgctgcgggttcctcgacatcgagcgcaccgtcgaggccgtcatgggcaagaccgacgtcgcgcccgtcgagagcgtcgagcagctcgccgaggtcgacgcttgggcgcgccaagaggcggagtcgctgctcggggggcacaagtgagtctcggcggggttgcgtcggcggtcttctggggcatcgtcgtgctctccgtgctcgtgttcgtgcacgagggcgggcactacctggcggcacgagccagcggcatgcgcgtgaccgagttcttcctggggcttccctgcaggttccggctctcgtggcgctctcgcaagacgggtacggagtacggcgtgacccccatcctgctgggcggctacacccgcatctgcgggatggagggcgcggacgacgagcttctcgccccctgcctcgagctcgtgcaggagcgcgggcgcgtctccgcgtcagacgtggcgtcagggctccgggtgaccgaggagcgcgcctatcgcctgctcgcgtccctcgcggacctcgcctccatcgagccctggtacgacccccgggcgggggagaggcccggtcagcccacgtggcccgagcacttccagacggtcgcccgcgacgctgtcatgctcaccgcctacgacagggggcacgactttgacgccccaggtttctcgcccgcgggggagagccgccccatccagggggaccccggggagttcctgagggccgagcaggcccgcacctacgagggcaagggcttctggccccgcgtggcgaccctgttcgcggggccgctggtcaaccttctctgcgcgttcctggtgatggtcctggcgctgacgatctgcggcgtcagcgtggtcaggaacagcaacaccctgggcgcggtggaggcgggctcgctcgctgagagggcggggctcaaggccggcgacacgctcacccagattggaggcgaggcggtcaccgactgggcgagcctgggcactgccatcgacgacgccctctcgtccggcgacgacttccagatcgcgtacacccgcgacggcgagccgcacaccacgaccgtggacgttcccgacgacgggtcggcgaccatgctgggcgtcgacgcgcagaccgagacccaccatcccaccgtcctcgaggcgtcgcgctccgccgtctcctacggggcccaggtcgccacgttcgcagcgcggctcatcattcccgcgcacacggtcgagacgatgcagagcacctcgtcggtcgtgggcatctcgaccatggcgagccaggcggcgcaggcgggcccctacgagctcgccctgttcgtggcgatgatctcgatgtcgctggggttcatgaacctgctccccatcccgccgctcgacggtggcaagatcctgatcgaggtcatccaggcggtgtcgcgccaccgggtctccgcacgcgcgcaggccatcgtgggctacgttggcctcgcgttcttcctcgtcctcttcgcgtttgcgctgaggaacgacttcgtcaacatcatccttcgctagggggtcacatgagcgagacgagcacggcgggcgcacccgcacggtcacgcacgcaccaggtccacgtgggaacggttcccgtggggggaggcgccccggtctcggtccagtccatgtgcacgacccggaccagcgaccccaaggcgaccctggcgcagatctcgcgcctcgccgaggcgggttgcgagatcatccgggtcgccattcccaatgcgcaggcgctcgacggctttggttccatctgcggggagagcccgctgcccgtcgtggccgacatccacttcgaccacaagctggccatcgaggccgtctcccgcggcgcctcagcgattcgcatcaacccgggcaacatcgggtctctcgaccgggtcgacgcggtcatcgacgcggcgggttccgcgggcgtgcccatccgcatcggcgtcaacgcggggtccctggaccccgaaatcgacaggcgagaggaccttgacccgtcgcagaagctcgtcgcgtcggccgtctcgttcgtccgccacttcgaggagcgcgggttccgagacgtggtcctctccgccaaggcgcactcggttcccacgaccatccgcacgtatcgtactctctcgcgcgagctccccaccgtcccgctgcacgtgggcgtcacggaggccggcacgctccgccagggaacggtcaagaacagcgttgccgtggggaccctgctgcaggacggcatcggcgacaccatgcggctctcgctcaccgcggaccccgtggaggaggtgctcgtggcctgggacctcctctcgtgcctggggatgcggcgcctgaggcccgagctcgtgagctgccccacctgcgggcgctgccaggtggacctgatcgacatcgcccgccaggtgtcggaccggcttgagggcatgcgcgcgcccgtctccgtcgccgtcatgggctgcgtggtgaacggtcccggcgaggcgcgcgacgccgacctgggggtcgcctgcggcaacggccaggggctcctcttcgagaacggcaagcccctgcgcaaggtcgcggaggacaagatagtggacgagctggtctccgagatcaagagccgctacgaaggctgagccgcggcgtatgatggtcagcgtgtgtgaagtaactcggaaggaagaaaccttgagcacctacatgaagatgtcccgcctctacgcaccgaccctcaaggaggaccctgccgaggcggagctggccagccacaagctcctcctcagggcgggcatgatccgcaagggggcctcgggcctctacagctacctcccgctcgcatggaggtcgatcctcaagatcgagcggatcatccgcgaggagatggacgccatcggcgcgcaggagatgcaggtccccatcctcaccgacggcgagctctggcgccagtcgggccgctggggcgtgtacgggcccgagctcatgcgcctgaaggaccgccacgagcgcgagttcgcccttggccccacccacgaggagtcgttcaccgacctggtgcgcaacgagctccgcagctacaagcagctccccgtgaccctctaccagatccaggacaagttccgcgacgagctgcgtccgcgcttcgggctcatgaggagccgcgagttcatcatgaaggacggctactcgttctctgctgacgaggagtccatgcgccagtgctaccaggaggagaaggaggcctacgcgcgcatcgcggagaggtgctgcgtcagggcgcttcccgtggtggccgactccggccagattggcggcgactcctccgtggagttcatggcgctcgccgacgcgggcgaggcggagctcgtgtactgcgacgactgcgggttcgcggccgacgtggaggcggccacggccaaggtgcacgtgaccgagggggcggagggcgagctcgagcgcgtccacaccccgggggcgggttccatcgccgacgtgagcgcgcttctcggcgtggagcagagcggcacgcgcaaggccctcgcgctggtggatggcgaggggaaccccgtcgtctgcttcgtgcccggcgaccacgacatgaacgacgtcaaggccgagcacgcctttggtgcctaccacctcatgaccgacgaggagcttgagcagtacggcctggtcaagggcttcatcgggccggtcgggctgccccagggcatccgcgtctgcgcggacgagtcgctcagggagtccacgtggtggctcgtcggtgccaacgaggcggactaccacttcatgcacgccaagcgcgggcgcgacttccagattgccgacgacgcctgggtggacgtcgtgaccgccaagccgggcgacctctgccccaagtgcgggcgtcccctcaagggcgcgcgcggcatcgagatgggccaggtgttccagcttggcaccaagtactcggaggccatgggcgccaccttcgccgacgtggacggccacgagcagccgctccagatgggctgctacggcatcggcgtctccaggaccgtcgcggccgtcgtggagcagcaccacgacgacaacgggatcatctggcccgtgtcggtcgcaccgtacgaggtcgaggtcattcccctctccattggcgacgacgtcgtgtggcccgtcgcgctgcaggtggcggacgagctcgccagccagggcatcgaggtcgtgctggacgaccgcaaggagcgcccgggcgtcaagttcaacgacgctgacctcatgggcttcccgtaccaggtcgtctgcggcaagaaggccgtcaagaacggcaacgtcgaggtcaaggaccgtgcgacgggggagaggagcgagcttcccatctccgagctcgctgccacgcttgccgcccgcgtccgctcccagcgcgcgtagggtgtgctcgtaggccatcccaggcaatgaccaatgcagcccctcggacgaaatgacgtccggggggctgtttgtttgagtgggcgtcccgtcatcggaacactacgaaatcatcgatagatactgtcacttgtggcccaaattttggaccacagatttcggtcgccaggctggtacgttgggcgtatcgaaaggttcgcatgcttaaggcaaccggactttccactgctagccatgagacgcacattgaagcaactagggcgcgcgtttttggcaggggacaaactggcgaatcttgagcagcgatatttcaatcgatatttctgctttacccccatggaactctctggtaagatgctccatgcgctgagggcgattggctcaggggtagagcacttccttcacacggaaggggtcgctggttcgaatccagcatcgcccaccatgacattaaggcgacggcttcggtcgtcgctatttttgtaagggcccatggcgcaacggttagcgcaggggactcataatccctgggttgcaggttcgaatcctgctgggcccaccaccaaagcgacgcccctggcgagtattcgctgggggcgttttagcatctttagacttatgggtcggggtcgcttgaccggagttcgccagggcaatgggcgtgttctttacgcccattgcatccccaatcgcgcagcgacaaggacggatcctccgaggacagagggctcggcgtagcgggcggccagcactaaaaactccagtcacttctggccgccttccgaagcgtcttgaggaggtgcctgggtcactacatgtcgtggttcgcgttgctggattgagcgaggcaatagttgccaaagcgtccacaatcgggttgcagccccttgaggcgaccgggccggactgcgagacgcccagggtggtcgagcttctcgagaggctctgcgtggtcgcggcggagggccaggatgcctttgacctcaaggcgtgggggaccgaccggatcgaccaggaccgtgggctcctggagagcctgatgggcgtgtccctaagggcgttcctgtcccgctatggggcggaggccaggtacgacgtccgtgggggcgataaagggccctcctatctgtggatgctctatcttctccccgaggggatggagccgtcgtcggggtatgcgagcgtcacccttcctgccggtacgtacgtgcaggccaactattgcggcccctggggcggggtgcgccaggcctaggtcgcgtttgggcatgggctgccgagcgtagctcccgctcgaagggccctggtacgagttctgccgcttctccgcgctcgaccacggcccctcgagcgacgtgtaccgctgcagggtctcccttctggtcgatccatcgcgtgaggagtgagcgaccagaacgacggctgcgcccggggcaggggagaggcgcgccgccggcgggatcggcgccaaccacgctggccgcgcgtctctcgcccgctgacgcccctgccgtcaccgacctctcgcctacgccgtgggaatgcggcacctgcgcgagggtaaactcaggtgtgttgcagccgtctggcgccaggcgggggagtgccgccggcacgcgccccgggccatggccgtgagacacgaaaccaaagaggtgcacatgaaccagagtatgaagaggatcaagatcgcctgcatcgccgacctcgtcgtcggcctcgtcaccgtggtccttggcttgatcgccatcgtctccaaccccctgtccgtctcgcactacatgctgaccctggtgggggtcaccggggcgtacctgggcctgagggggtcgatctgggcaaacgtcccgtctaacgccaagcgcatccgcgacaccagctcggtgatggtgctggtcgagttcatcgcgtcgatcttcgtggtcatgccgcccgtgcgtgccgaccgcaacacggtctacatgatcctggtcctgctggtgctcgccctggcactggtttcgtttgctaacgcccgccaggtggtcgccgcgcagaaggccaagtaggggcctgttcggcgtcgagggtttgcccaggtgggaaggcgcatccaaacttttttccaaattagtcaaattcccgcttgacccattttgagcctttggtaatataactaccgcaccaacgcgaacggggaattagctcagttgggagagcgcatgactggcagtcatgaggtcaggggttcgaatcccctattctccaccatgtaagatatgcccgggcatctttgatgtccgggttttttgttagctcgagcgagaggggactcccatgacccaagaggaagatccggtccagctgtttgacatgcacatctcccacatcgggatcaacgccagcaccgacgaggaggcggagcggatcgtctcgcagttccagacgctgatggggttgcagcgcaacgtggtggcgcccatctccgtgtttgccggcacgctggtggaggtgatgcgtcccggtagcaacaggggagagaaggggcacatcggcctctacgtcaacgacatcccggctgcagagcgctggttcgaggcccgcgggttccagatcgaccagaacgcccgcgcgctcaaccccgacgggtccacgcacctggtgtacttcaaggaccagattgcggggttcgcgatccacctgacctgcgacgagtaggggtcgcgggaagggcgtgggctcacgcgtggggtgcgctgcggttctcgcgtgctatgacctgtgcggctttgggctaagaaggggcacgcacgaccgggtgcgcgggctgcggctgggtctgttgcgtgtgtctcgcttggcatatgtgtggtggggggctccacggtatgggtggggcccctttttgggcgttcaagctgacctgggaaagaccggcgaagaacgggccgcatcgtgagggcggggttgctctgttgcggcttggactggaacggcgaggtgcttaaagaattcggggcgcgggcgcgatggagaaggttgatgcttagagaaaccgaggcgagtacggtttattgcggtcgcaagccgttctggccccagagttattaagcatttgggaatgaaatgagtcctcgcccctgactttctaagcgcagggtgttggttatccctgcaggctccgggaatgttaagcagatgactccgccgtgcgaacgggtaccgacgtgagcaagcgggtggaatgagctggcgacctccgcgagtgcaagatgcatggtgttgggggtatcgggctcagtggccttgggcgtcacgtataatcctagggattatgcctgaacgtcgaaggggtacgcttgattgctcttgcggacaagatcagcaagtcctttggcggccgtgtcctgtacgcggccgcaactctgcagctgaacgccggcgagcgctggggcctggtggggcccaacggcgccggcaagacgaccctgctcaagatcatcatggggcaggagtcccccgacgagggaaccgtgagctttgccaaggacacgaccgtcggataccttgagcaggagaccaagctcgagggcggcaagtccgcgctgcaggaggtcgttgactccgcgcacgagatcaaggacctcgaggcacgcataaaggagatggagcagcgcataagctcgtctcagccaggtcccgagcaggacgccctcctcgccagctacggcagcgcgcaggaccgcttcgagcgcctgggcggctacgagctggaggcccgcgcgcggcagatcctctcgggcctgggctttcccgtggaggacttcgacaagccagcggaggagttctcgggcggctggcagatgcgcatctccctctccaagctcctgctgcgccaccccgacctgctgctcctggacgagccgaccaaccacctggacctcgagagcgtgaagtggctggagcagttcctctcgtcgtacgacggggcggtgctgctggtctcgcacgaccgctcgttcatggactcctgcgtgagccacatcgccgcgctggagaacaagcgcctggtcacctacgtgggcaactactccagctacctgcaccagcgcgaggacaacctggagcagctccgcgccaagcgcgaggcccaggagcgcgacatccagcacctggaggttttcatcgagcgctttaggtacaagccgaccaaggcgcgccaggtgcaggagcgcatcaagatgctcgagaaggtcaagtccgagctggtggtgctgcccgagtcgtccaagaaggtgcacttcaagttccccgagccgccccgcacgggcgacatggtcgtgagcgtggacgacgtgtccaagcactacgaggacaacgacgtgtacgaccacgtgagcctcaagctctaccgcggcgaccacgccgtgctcgtgggccccaacggcgccggcaagtccacgctgatgaagctgatcaacgggcacgagcgccccacgagcggccgcatcgagctggggcagaacgtgacacaggcctactacgcccagcaccagctcgagaccctgcacgagggcaacaccgtgctgcaggagatggacgcagccgcccccggctggaccacctccgaggagcgcaggctcctgggcgccttcctgttccacggggacgacgtggacaagcgcgtgggcgtgctctccggcggcgagaaggcccgcttggccctggcccgcatgctcgttgcgcccgacccgctgctgtgcctggacgagccgaccaaccacctggacatcgactcggtcgacgtgctggagcaggccctggtgacgttcccgggcacgatcatcctgatctcgcacgacgagcacctggtgagggccgtggccaacaaggtcatcgacgtgcgcgaccacaaggtcaccgtgtacgacggcgactacgactactacctgtataagcgcgccgagctcgaggcgagggagcagggcggtgacgccgctgccgccgccaagtccagcgcaccgcaggcggacgactcccgctcccagggccgcaacgtcaagaccaaggagcagcgccgtgccgaggcccaggcgcgcaacgccgccaaccgggccctgaaggaggagcgcaagaggctccgccaggtggaggcggccctgaagcccgcgcagaagcgctacgacgagctggtgggcatgatggcggacgaggagctgtacaacgacgccgacaggttcgacaagtgcatgagggagtacaacgccctggcgaagaagatcccctctctggaggaggagtggctcgagctcagcacccggatcgaggagggtgccgatgcctaggttcaggcaggacgacaccgacggcgacctggacaagacggtacttgcgagtggggcgggggcgcacgtcgcagaccccgccaccaggcgcatgcagcagcggcctcgccagcaggcgggcgccgcctacggccaggacccgtacctgcctcaggccaaccagacctacgggcaggacccgtactaccgcccgcaagcaagccctgcgtatggccaggacccgtaccagccgtacggcgccacgtcacggccgcagtaccagcagcgccaggccgttcccagcccgccccaggcagacccgtaccttggtgagaggaacgagcgccgctcccgcaagccgtccacgggccatggcggaggggcggtccccgtgctcctctccgtgctgtccgtcctgtgcaggatagcggcgatagcgctcgcgctcctctccgttgccaacgccttcgtgctggggtcgctgcgcatcaggctcgtggccatcacggccatggtgtcatcgtggctccccccggcgctctcgggtgccttcgtgttcgagacgccctttggcggcgtcctgcgcggcgacttcatggtcgccgccgtggtgctgttcgtgatcgactgggcgctggccaaggccgcgcactccctgaggaggtagggatgctctccctctcgctgtcgcgcatcctggggtcgctcgcctcggtcgccctggtcatggtcgccgtgatcccccacgaggtggcgcatggctgggtggcctggaagctcggggaccccaccgccaaggaggcagggcgcctatcgctcaaccccctcaagcacctggacccgtttggctccgtcgtgctgccgctgctgatgtcgctcctgggcgggccggtcttcgcatacgccaagccggtgccgtacaacccgtaccgcctgcgcgacgagcgccgggacgaggtccttgtcgcccttgcgggcccggcctgcaacctgctggaggcgctcgtctccgccatcctgttccgcgccctcctcacgcagtggagcggcgcgcaggacgccctgtactgggtgctcgtggcgctgtcgcagttcacctacctcaactgcgggctggcgttcttcaacctgatcccgctgccgccgctcgacggctccaaggtcatctccccgctcctatccgcccagggacgcgagcgctaccgcatgatgcaggcctactccatgcccgtgctgatcatcctgctgtacgtgctcccctcgctcgcgggcatcgaccccgtgagctggtacctggacgcgaccgcatatgggttgggtggtcttctccttggcgcgtagcggctcatacaaggtcaggacgcaggcgtacagcggccccttcgaccttctgctgcagctggtaagccggcagaaggtcgacatcggctccatctccatagccgaggtggccgaccagtacatcgacgaggtcgatgccatgggggagctggacctggacgtggccagcgacttcctcctggtggcatcgacgctgctcgagatcaaggcggcctccctcgtccccgagcaccccgtttcgagggtccgcgacgacgaggaggacgaggacgacgacctctcgggcctctcgcccgacgaggcgcgcgaggtgctggtggccaggctggtggcgtacaagcagttcaggaacgccgccgcggccctgggcagcaggctcgaggccgagggccgcatggtcccgcgcacggcggggcccgacccggagttcctgggcctgatgcccgactacctcaaggggatcacgctgcgctcgcttgcggtgatctgcgcggatctggacagcaggcgtcaggggttcctgctggaggccgagcacgtggcgcccaagcgcctcccgatcgccctcaccgtggcctcggtggaccgcgtcacgcgcgcgcatccgcagaccacgttcagcgagctgttggacggggacgagcgggccgagaccctcgtggcgaccttcctcgccatactggagctgtgcaagcgcgggatggtcacgctttcgcaggcgagggtgttcggcgagatcgaggtcgcccgcgtggagggcgccccgccgttcgagctggacaactccgacctcacgagcattgaggaggactcctgatgcaggatctagagaaccttggccccgactccaccaagggggccctggaggccctcctcctggtctcgtccgaccccgtccccgctacggacctggcgggcatcctgggcatagccccaagcgaggcggcgtcgcttttggcggagctctccgccgagtacgcggacgccaaccgcggctttcagctgagggaggtcgccggaggctggaggctgttcacgcaccccgcccaccatgatgcggtggagaggtacgtgctgtcctgggacacccggcacctctcgcaggcggcgctggagacccttgcggtcatcgcctaccaccagccggtcacgcgcgagggcgtgaaggccgtgcgtggcgtcaactccgacggcgtgatctcgtccctccgcgagaagggcctggtgcgcgaggtcgggcgcgagggcgacaggagccgcgccgccctctacggcaccacgcgccgctttttggaggagttcggcctcaagtcgctccgcgacctgccgcccctggaggacttcgcgcccgacgaggagtcgcgccagttcatacgcgagcgcctctcgggccgtgccgtctcgtccaccctggaggaggcctccgaggacatggaggacgagcgcgagctgctgggcgacgacttcggcggggacgagggcgacgaaggcggccagcaggctgccgaggccgcgcaggacgggccggcacagccggtggacgcgggcgagacgagcgggggtgacggcgagtgagcgacgcggacggcatccactacaccatgcggctgcagcggttcctcgcgcgcgcgggcgtcgcgagccgccgcaagtcagaggacctgatgaccgccggtcgcgtgagggtcaacggcgaagtggtgaccgagctggggagcaaggtcacccccgacctcgacgtggtggaggtcgacggcaggagggtccgccttgaggacgggcacgcctacatcatgctctacaagccggcgggctacctcaccaccatgagcgacccggagggccggccctgcgtggcctcgctcgtgcccaccgaccgctacccaggactgttccccgtgggcaggctcgacggcgacacgacaggcctgctgctgttcaccaccaacggggacgtggcaaacggcatgctccatccctcgcgtcacgtgtggaagcactacgtggccctggtcaggggcgtccccacgcagcaggagctggggcggctgcggagtggcatctacctgcgcggcggcagcgcgcagcccgccaaggccaaggtcctctcgccccgtgaccccgccgccgtacccgtgatccccgaggggctccccatggggatgtcggtcgtgggcctgcgcatccacgagggccgcaagcaccaggtcaagcgcatgctcaaggccgtgggccacgaggtcgtgcgcctgcaccgcgacgagtttggcccgctggagctgacggggctcctgcccgggcagtggaggccgctcacccccgcggaggtccgctccgtggagacgctcgcgacgggggagaggggagacgaccgtgcgtaggcagaggatcctggtcacccggcatccggagaccagggcaaacatcgcaggcacgctctcggggcgcagcgacgtggacctgtcggctgagggcgaggaccagatgtaccgcgccatccgcgccatcgtggcgtggcggcccgaccgcatctggacgtcgcccctctcgcggtgccagtccatcgcacgcgaggcggccaacgccctgggcatcccctgcgaggtcaaccccaacctggccgagatcgagtttggccgggcgcaggggctcacgctggcccaggtgagggagctgggctacgacttcccctggcagttggacgacgagggcaggtcgcaccccatccaggggggcgagagcttcgagcacctgtacgcgcgggcgggagccctgctggaccagctgaggccgctcgagggccgcacctcgtgcgtcacgcacggcggcttcaccagggctctcctgggcaggatgctcaacgtccccctcgacaccttctggaacgtgcgcatccccaacgtgagctcgcaggtcgtcacctgcgacgacggtacgtttcggctggcctcgctggggctcgcccccgaggaggtcgtccgcaggtccgagaaccccgccctgctgggcagggacaccaccgagaagctttctgggagtgatgacgagtgatagtagccatcgacgggccggcgggctcgggcaagtccacggttgcgcgcgcggtcgccaagaggtgcggcctcacgtacctggacacgggcgcgatgtaccgcaccgtggcgctgaggtgcctgcagcgctcggtcgacctctccgacgccgaggcggtcgcagcggtcgcgcggggctgcgacatctcgttcggccttgccgaggacggctcccagacggtgagcgaggcgggggaggacgtcacctccgccatcaggaccgccgaggtcgaccacaacgtctcggccgccgcggccgtgcccgccgtgcgcgaggccatggtcgcccgccagcgcgagctcggcagcgccggcaacgtggtggcagaggggcgcgacatcggcacggtcgtgttccccaacgcggaggtcaaggtgttcctcaccgccgaccccaaggcgcgtgcgcaccgccgtgccgtgcagcggggaggcgaggccgcgggcgccgacagcgccgaggagcagaggatcctcgacgacctggtgaggcgcgaccgcatcgactccaccagggaggactccccgctcaggcccgccgagggcagcgtgaagatggactcgtcctccatgaccgtcgaggaggaggtccagaggatcgtctcgctcatggtcgccgcagggtggcgtggcaagggcgccgacgcggcggacgggggagaggggcctggccacgaggtcgcggcggatcccgccggcgccacgggtgcctccaacgggacggcaggccccgagcccgtggcggacgtcactgatggggcaactcccaaggaaggcgctgccgaggcgaaggctgacaccagggccgggaagcccggggcgccagagggtggggcaaccggcgagagcgcaacgcgcgtctcccccaagccagccgccgcgcccgagccccccgcccgcaagcgcgaccgcatgcgcgcctttgccggcaactcgtttgacgactacttcgaccacgacatgagggacttccccgcccccggccgcgcgatgctccgctttgtcgccgccgtggtgggcggcgtgaccaaggtgctgtggccgtggaccatcgaggacgccgacaagctctggggggaccatcgcgggcgcgtgatcgtgatgaaccacacctccatgctcgaccccgtctgcgtgatcgtgagcaccctgttccacgggcagcgcgtgaggtgcgtgtacaagagcgagttcgactccgcaaagatcgtgacctggctgttcagccgtgccggcgccatccccgtggtcaggggcaccgccgacgtcaaggccgtgcgcagggccgagcgcgccctcaagcgcggcgagatggtgctggtgttccccgagggcacgcgcgtgaagtcggacgaccaggaggtcaccatccacggcgggttcgccctgatggcgcagctcgccaaggctcccgtgcagcccatggccatcgtgggcgcgcgggacatcacgcccagggggtcgcacgccaagcggtttggcagggtgtacctcaaggtcggagactgcatcaccttcgacgagctgggcgtgaagggcaagaaggcgcgcaacgccaagatggaggaggtcgccatggggcgcgtgtaccagcttcgcgacgagctccgccgcgagcatcccggaaagatgtaggaggctgccatgagggtcgaggtcgcaagccaggcgggggcctgctacggcgtggagcgcgcgctgcggctggtcagggactccgtccagacggagcggggccaggtgcacacgctcgggccgctcattcacaacccccaggtggtcgaggagctggcggaggcgggcgtctcccccgtgtcgtcgcccgaggacgtcgatggcggcaccctggtgctgcggacgcatggcgtcaccccgcaggaggagcgcagcgccagcgagcacgccgaccgcgtgatcaacgccacctgcccgttcgtgctgcgcgcccaccagagcgcacgcaccctgtacgatcagggctaccaggtcatcatcgtgggcgagaagggccaccccgaggtcatggggaccctgggcaacgcccccggcgccgtggtggtccagggcgcctccgagctcgacggcatcaaggtcggcaggcgggtgggcatcgtggtccagaccacgcaggccagggacaacctgagggcgatcgtctcggccctcatcggcaggtgcgaggagctcaggctgtgcgacaccatctgcgaggccacctccagcaggcaggcagcggcggcggagctctcgtcccgcgccgacgttatggttgtgatcgggggcaggaactcggccaacaccacgcgcctggcaaagatctgctcggcccggtgcccgcgcacgcaccacattgagtcagcctccgagctgcaggcggggtggttcgacggggccaacctggtgggcatcaccgcgggcgcgtccacgccgcaggagcagatcgacgcggtccgctccgtcgtcgagggaatgggcggcgcgcgatgagggccagccagcagggcagggccgactacgcctccacgcgtccccaggccacgggcgccgtggtggcgagcgtcgaggagggcagccccgcctgggaggcgggcatcgagcccggcatgcgcgtggagacggtcaacggcaagccgctccgcgacatcatcgactggcggtgggaggcctccgacgccacctgccagctgagcgtgttcacccccgacgacggtctcacctatccctgcacgctggagcgcgaggcggggcaggactggggcatcgatttcgaggacgtgctgttcgacggaatccgaacctgcgtcaacgcctgccagttctgcttcatgcgcatgctgcccgacgacgcccgcgcctcactcagcctgcgcgacgacgactaccggctctcgttcctccagggcaacttcgtgaccctcaccaacgttacggacgacgacctggcccgcatcatcgggtgccggctggagcccatgaacgtctcgctccatgccgtgtcgcccgacgtcaggcggtcgctcatcggcccgcatgcccagcgtggcctcgacgtgctgcaggcgctctgcgacgccgggctcgaggtccacgggcagatcgtgctctgcgccgggatcaacgacggcgaggagctccaccgcacgctcgactgggtggaggagagggacaacatcacgtctttggcgctcgtccccatgggttacaccaagtactcgcggaacttctcccactcgttctcggaggacgtggaggcgtcccgcgaggtcgtccggctcatcgagccctaccagcgccgtgcccgggagcgactggggcgcacgcggttccagctctcggacgagttctacctcgacgcccagctgcccgtgccggagtccgagacctacgacggctacccgcagttctacgacggcatcgggatgctcaggagctttctggacgaggcccgtgacatctgccaggaccacgcggaggagctcgacggcatcgtgggcgggctccgctcgcgtgggctgcgtgcgctcgcggtgtgcggcgaggcggccgagggtgtgatcagtggcttctgcgccgcctgggcgcaggggctggtctcggcccttgccatccacaacgactactacggcggcgacgtcaacgtgacgggcctcatcgtgtcggtcgacctgttggcgcagctcccacaggacctctctgggatggtcgtgcttctccccgaagtcatgttcaactttgacaaggtcacgctcgacggtggctcacaggggcagatcctcgacgagatagaccgtcgcggcggcagggcggtcgtgtgccagacgaccccctccaccatggtcgaggccctccgctgccagctgggcttggcgtgaccgcgaagggccgatgcggctctcgcaagagggcccttctggttgccctcgcagccgtgacctgcgctgtcggatgcgtgatgggcgccttcctctcccgataccagcgtacgtccgccgaaaggcccgccaaccagtacgaccatgctgtcccgcagctccacagcacggtcgaccgggacggcgatgggatcgacgaccaggcggacatcttgcagggggccctcgcctacgtggggacgcatcccaaatacaagagcgagtattgcgagggaggataccccgatgacgggtatggggtctgcaccgacgtcgtcgcgtttgcgctgaggtcagccggctatgacctgagggagctcgtcgacgccgacatcagggaggatcccttcgcgtatggcatcgagacgcctgacaaggacatagacttcaggcgggtgaagaacctgcaggtgttcttccgcagaaatgagaccagcctctcgacggacgttcacgacatcggcagctggcagggcggggacatcgtcgtcttcagcaatcacatcggtatcgtctcggacaggaggaacagggacggcgtgccgtatgtgattcaccacaacgaccccctccaggcgtcctacgagcaggacatcctcgagagccgggacggcgtggtagggcactacaggatgtccgagtgagcgagtgggcgctgacagacggcctcgtagcgccgtaggcccctttattgaatggggttgacgcttcgtctttgaccgcagcgctcgacttcctcgacgtcaagagcaaagtctgagaaatggcggaggccgttgtggggtgggatcgccaaccgcgatggaggggctgcaccaacattgactgcgacgcatcgtgcttaatcgcactagccctcctgcctgattcgggacatgatgcttaatcccgctggcactcttgtggatttcggagctaattgcttaatcgtcctagccctcatgtgagttgggggagagagaaacagcatgaggcctagcatcgctaagcatccaggggcggaatccacaagaggccgggatacgttaagcagccacggatttcccctctccgcaacgccatttcccgccggatgtcgcacgcataaccatcctctctcttgcccattgaggatcaacagatgagttaatgcacgagtctgcatggctgacccccatctctttcaaccctgagacaagtcgctgccctctccacgcccgtctcgcccaagtgcgtcacgaccttctcccgcgccgctggcacggggtgtccaacctttggttggagcgggggcaaaacagaccacaagaaaatatatggttatagaagggtaggaattgctcggcccgtggtcgcgatacggtcgcatgctagacttcacgggatggaaccagagcaaggagagacatgcccaagccaatcgtggcggtcgtaggccgccccaacgtaggaaagtccaccctggtcaaccgcatcgccgtgagcagggatgccatcgtccacgagtcgcgcggcgtcaccagggaccgctcgtaccacgaggccgactggaacggccgcgacttcgtgctgatcgacaccggtggcatcgagtccgtcaagagcaaggacgtctttgcccccaggatccgcgagcaggcgctcgccgcctgcgaggaggcggacgtcatcgtcttcgtcgtggacggctcggtgggcgtcacggacgaggacgaggaggtcgcccgcgtggtcaggcgctccgacaagcccgtgatcctggtggtcaacaagatcgacaacccatcgagcgaggacgaggcgtggcctttctactcccttggcgtgggagagccacacaccatctcggcaaaccacggctacggcacgggcgacctgctcgacgaggtcgtggccaacttcccgcccgaggacgaggagcccgaggaggacgacagctacctgggcgtggcgatcatcgggcgccccaacgtgggcaagtcctcgctcgccaaccgccttgccaagcgcaaccgctcgatcgtctcggacgtggcgggcaccacgcgcgacgcagtggataccctcatcgagtggaagggcaaccgcatcaggctcgttgacaccgcgggcatgcgcaagaagtcccaggtgcacgaggacgtggagtactacagcctggtgcgcgggctccaggccatggaccgcgcggaggtgtgcatcctcgtggtggacgcctcggtgggcgtgaccgagcaggaccagaagctgctgggcatggccgtggaccgcggctgcgccgtggtgatggccctcaacaagtgggacctgatcgacacccaggagaagcgcgaccgcgtgatggagtcgctcgacatgaggatgggctacgcgccctgggtgccctacgtcaacatctccgccctgacggggcgcgccgtcgacaagatcctcgccgcaacgctcgccgctgcggaggcgcaccagcgcgaggtcaagacctccgacatcaacaagctgctcgcccagctgagggagggcggccacaccgtcaccgacaagaaccgccgcctcaagatccactacggcacccagacgggcaccaggccgccctcgttcaccttctggtgcaacgcgcccgacctcgtggacgacaactacgagcggttcctcgagaaccgcatgcgctccaccttcgactttggcgggacccccattcgcctcaagttcaagcggaaggacgacaccagaaaatgacatccctggtcgtggcgacgcttgcctgctgcatcgcgtcgttcctcgtctgcggcatcccctttgggctcctgatcgccaggggctcggaggggcacgtggacgtgcgcaaggtgggttcgggcaacatcgggatgaccaacgtcgcgcgctccgtgggggcgcgcgccgccctcctcacgtttctgtgcgatgccggcaagggcgtcctgtgcaccgtcgtggcgcgcctggtcatcgccgccgtcgcgtttggcggagacgcctccatggtggcgccgatcaccccgtttggcctcgcgtccacgctggtgtacgcctcctgcgtgctggggcacgtcttctctccctacctgcactttcacggcggcaaggggatctcggtgggctttggcgccggcctgggcatgtactggcccgtgggcgtgggcctgctcgtggtgttcctgctgttcgcggtgccctcgcgctacgtctcgctcggctccgtctgcgcggccgcctcgctgccggtgatctgccttgccctgggctttgggccgctcaacacgctgcccatggcaatcgtggcggtggtggtcatctggtcgcaccgtcagaacatcaggaagctcgcccgccacgaggagcgccggttcaccgtccgcaaggggggcgagaggtgatgggcacccagcgggtcgcggtcatagggacgggctcctggggcaccgctgcctccgggcttctcgccaggaactgcgctgacgtcacgctcctggcgcgctccgaagccgtcgcagactccatcaaccaggcgcacaggaacccgcgccacctgcggggctacgtgctccccgacaacgtgggggccaccacccaggccgcggaggcgctaaagggctccgatgccgtcgtggtcgcgacgccgtcggccttcctccgctcgaccatgcgctccgtcgcaccccacgttccggacggcgtccccgtcgtggtcctgaccaagggcatggaggagggcaccttcgagctgatgagcgaggtcgtgggtgacgaggtcggcgagcccggccgcatcgctgccctgagcggtcccaaccacgcggaggagatctgccgcgacatggtgtcggccgccgttgtggcctcgcccgacgagggggtcacccgggccgcgagggacatgttcgtctcgcccgacttcagggtgtactgctcccacgacctccgcggcgtggaggtgtgcggcgccgtgaagaacgtgatcgccatcgcctgcggcatctgctggggcctgggcacgggagacaacaccctggccgtgctgatgacgcgcgggctggccgagatcggccgcatcgtgagcgccgtcgggggcgaccccatgacgtgcatgggactcgcgggcatgggcgacctggtggccacctgcacgtcgtcgcactcgcgcaaccgcacgtttggcgaggcctttgcccgcggcacctcgctcgaggagtacgaggcccgcacggggatggtcgtggagggcgccaaggccgtgaggggcacctgggagctcgcgtgtgaacgtggcatcgagacccctatcacgagggccgttcacgctatcctgtatgagggcatgcccatggacgaggcgcgccactcgcttttggacagggacccaaacgaggagttctacggcctctgacgggccgggacaacggaatacggaggtaggacccatgacgcacagggctgcgcgcatcgcaccctctattctctctgccgacttcaccaagctgggggaggagctcgactccatagcgggggcggactacgtccactacgacgtcatggacggccacttcgtccccaacctctcgtttgggccgggaatcctgaagcaggtcaagcggcacacgcagatgccggtcgacgtgcacctgatggtcgacgacccggagcagagcgtggagtggtaccttgaggccggtgccgacatcgttaccttccactatgaggcgcagcgccacgcgcacaggcttgccacgctcatccgcgagcacggagccctggcgtcggtcgccattaaccccggcaccccggtcgcggcactgtccgccatccttccctacgtggacatggttctggtgatgaccgtggaccccggctacggcggccagagcttcatcgagggatcgtgcgagaagctcgccgagctccgctcgctctgctcctcgctgggcgtgtcgccgctcgtcgaggtcgacggcgggatcggcgtcgccaacgctgagcgcgtctgtgccgcgggggcggacgtcctggtagcgggaagcgccgtctttggcgccccggacaggggagttgcgatagagacgatccgcgaggcaggaacccgcggcatagctgggagggcctagggaatgccgcagcgctacgtgtacctggactacgccgcctctgcacccatgtgcgaggaggccctgcgggcggaggccgactacgagtcgtcccgcatcgcgggggcaaaccccaactcgcttcacacccttggacgcgaggcggaccgggctctggacggcgcgaggagagacctggcaaggtgcctggggggctcgttccgcccggctgacgtcaccttcacctcgggtggcaccgagtcaaacaacctcgccctgtttggaatggcggcgggcgcgcgggaccgcgatcgacatcgcacgcgcgtggtggtctcgtccatcgagcacgactccgagctcgacgttatccccgcgctacgcgaccgcgggttcgaggtgtcgctcgtctcgcccaaccgcgacggcgtggtgaccgcggaggccgtgcaggagctgatgggaagcgacgtcgcgctcgtctccgtgatggcggcaaataacgagacgggcatcgtgcagcccgtgggggaaatcgccaaggtcgcccgctccgcgggggcgctgttccacaccgatgccgcccaggcctttggcaaggtgccgctcgacctctcgggcgtggatgcggtgagccttggggcgcacaagatcggcggccccgtgggcatcggcgcgctcgtcatccgcggccgctgccccttcaggccgcagacctttggcggtggccaggagcaggggagacgcccgggcacccagagcgtgagggacgccctcgccttcgccgccgctgctcgtgcgtgctttgcggacctcgacggtacggcgcggacggtccgcgacagggctttgcggctcacggagcggctgtgcgcggagggcaccggcatcgtcgccacctccaacgtccccgtgggccccggcagactccccggcatcgtctctgtcatggcgccagggctggactccgagaccctgatcctcaagctcgaccaggaggggtttgaggtctccgccggctccgcgtgctcgtcgggctcgctcgacgcgagccacgtgctcactgcgatgggcatcccgcgcgagcaggccctgggttcgctcagggtctcgtttgaccagagggttccccaggacgacctggacgccttcgcaagcgcgctcctcgggatcgtcgccgtcgagcgcggcaccaccagataacgtccccgtgccatccggcaaaggagagtggaacatgtccgaatcacaggctctgctgcggctccaagagatcgacctgcagctcatgcgcgacagccatgccctgaggcagatgccccagcagaagaggcttgcggctctcgcccaggccaagaagaagctcaagtccgagctgcagaagatcgtgggccagcgcaaggacgcccagatggagctggacgacaacgaggagcgccatatcaggctgctccagatcatggacgaggtgagggagaaggcccaggagtccggctaccgcggggtgggggacatcgagtcccagctgacctcgctcgccaagaaggtcgagaagctggagtttgcccacggtgagcttcaggcgtcgctcgggaagctcgagaaggccgaggccaacgcgcgtgcgctcgccgagcgcctggaccgcgagggagaggagctcgaggcctcgtacaagcgcgacagcgccgacatcatggcgcgcgtgagggagctggcccgcgagcgcaaggcggtcctggcgcagctctcgccccacaccgcgcagacctacgacgagaagtccaagcgttttggtgggcttgccgtcgagcggctccagggcaatgtgccctccgtgtgccgcgtcaagctgcagcccagccagtacggcgacctgaggagcgcgggggagcccattgcggagtgcccgtactgccaccgcatgctcgtggtggagggtgccctcgatgcggagtagcgagggggagagccgcggctacgtcctgctcgccgtgtgcggggggatcgccgcgtacaaggcgtgcgaggtgctgcgtgccctgcagagggcaggtcgggacgtgcgcgtggtcatgaccgaggacgccacccgcttcgtgggcaccgtcaccttcgaggcgctgtccaagcaccccgtggtcacctcgctttacggcaaccccggcaaccccatcccgcacatcagcctggcggagggggcggacctcgcgctcgtggttcccgccaccgccaacgtgatggcgaagatggcggcgggcatcgccgacgacgcgctcacgtccacgctgctcgctacgacctgccccgtcctggtggctcccgccatgaacgtgcacatgtggaggaaccccgccacccaggcaaacgtggcgacgctgggggagaggggcgtgcgttttgtgatgcccgactccggcctgctggcatgcggcgaggtgggggagggcaagctcgcccccgtcgacgccatcgcctccgcggcgctcggggtgctcgaaggggacgaggcgccccgcggcctcgatggggtccgcctcctggtgacggcgggtcccacgcacgaggccatcgacccggtgcgctacatcgcaaactcctcgagcgggaagatggggtacgccgtcgccgctgccgccgcctcccgcggggcggacgtcacgctcgtgtcggggcccgtctcgcttgccgcccccgcgggcgtgcgcgtggtgccagtcgtatcggccaatcagatgcgggaggctgccgtcgccgccttccacgactgcgacgccgccgtctgcgcggccgccgtctcggactacaccccggccgaccccgccgatcacaagctcaagaaggcgagcgagcccctctcgtccatacggctcgtcgagacggccgacatcctggcggagctctgctccgtgcgagggggccgtcccgtggtgggatttgccgccgagaccaccgacctgctccagaacgcggagcgcaagctccggtccaagggcgccagcatgatcgtggccaacgacgtgtcgtgcgacgactccacgtttggctccgacaccgaccgcgtggcgctcgtctccgccaatggcgtggagcagctcccctgcctgcccaaggccgaggtcgccggccgaatcctcgaccgcctcgcccccatgatccgggtggcgcgaaggtgaggggagaggcgctctgcctgggctgccacctctccaccgccggcggatacgcggccatgggcaggaccgcccggtcacttggtgccacgaccttcgccttcttcaccaggaacccgcggggcgggaacgtgcgtcccctggatcccgacgacgtcgagggcctgaggcgggtcatggacgatgcaggcatcggacccctggtggcgcacgcgccctacaccatgaacctgtgctccggcaaggagcgcaccgtggagtttgcgcggcgcaccctcgccgacgacctggggcgcatggagtcgctccccggcaacctgtacaacctgcacccgggaagtcatgtgggccagggcgtggacgagggcatccgcctgatcgtcgagggcctcaaccagtgcctggtgccggggcagcgcaccaccgtgctgctcgagaccatggcgggcaagggcaccgaagtgggctcccgctttgaggagctggcgcgcatcatcgacggcattgagcacgacgagctcgtgggcgtgtgcctggacacctgccacgtgagcgacgcgggttacgacgtcgccggtgacctgaacggggtgctcgccgagttcgaccgcgtgatcgggctcgaccggctgcgcgccctccacctcaacgactccaagaacccctgcggttcgcacaaggacaggcacgagcgcatcggcaagggcaccctgggggtcgccaccttcgagcgcatcgtgaacgacccccgcaccagggacctccccatgatcctcgagacgccaaacgacctcgagggctatggggacgagattcgtctcctcaggacgctggcccgggagggaagggaacactgacgtgggaatcctgattggctgcgagcacctctcgatggagtggccgggcaagacggtcctcgaggaccagaccatcggcatcaacgagggtgagaggatcggcatcgtgggcaggaacggcgacggcaagtcgacgctcctcgacctcgtcgcgcgccgcgtgacccccgactccggcgaggtcacctaccgcagcaacatcaccgtggggatgctggggcagtccgactcgctggacgacgaagagacggtcggtcacgccgtggtgggcgacgtcccggagtacgtgtgggcctcggaccccaaggtccgctccatcgtggacgagctgctgggcgacgtcccctgggacgcgcgcgtcggcgagctctccggcgggcagcgcaggcgcgcggacctcgcgcgcgtgcttgccggcgactgggacgtgctgctgatggacgagcccaccaaccacctggacatgggggccatcacctggctcgctgaacacctcaagcgccgctggccgcagggcacgggcgccctcctcgtggtgacgcacgaccgctggttcttggacgaggtctgcgagcacatgtgggaggtccacgacggggtcatcgaccccttcgagggcggctactccgcctacatccagcagcgcgtggagcgccagcgccaggcggccgcgagcgaggccaggcgccagaacatcctgcgcaaggagctcaactggctcgcccacggcgccaaggcgcgttcgagcaagcccaagttccgcatcgacgccgccatggcgctgctcgcggacgaccctcccgtgaggaacgaggtcgagctcaagcggctcgcggtgagcaggctgggcaagcgcgtcatcgagatgaaggacgtgaccgtctcgtacggggaccacgtggtgctgtccggcatcaactggctcatcggcccgggcgaccgcgtggggatcctgggcgagaacggcgctggcaagtcgtcgctgctcaaggtcatgacggggaggctcctccccagcaagggctacgtcaagatcggcaagtcggtcaagttcggcttcctgtcgcagaacctcgcgcgccttgccaagagcgaggacctgcgcgtctccgagctcatggccacgtacaagagccactactacatcgacggcaaggagcagacgcccgagcagctgctagagcgcctgggcttctcgcgcagggagttccccaccttcatccgcgacctctccggggggcagcgcagacggctcgccatcatgtgcgtgctgctggaggagcccaacgtcctcgtgctcgacgagcccggcaacgacctcgacaccgacatgctcgccgtgttcgaggacctgctggacacgtggcccggcaccctcatcctggtctcgcacgaccgctacctcatggagcgcgtcaccgacgaccagtacgccatcctcgacggcaatctccgccacgtcccgggcggggtggacgagtaccttggcctcttgaatgcgtcccaacaaaagagggatgtgacttctgccacctccggccctagcctagtggaggcacccaaggcggccgcggagggggagaaggccctctccaacgcggagcgcagggagctcaagaagcggtttgacgccgtcgcgaggaagctcgacaaggtctctggcgagccggaccgcatacgcgccctcatggcgcagagcgacccatccgactacgagggcctcatgaggctccagcagcaggcgcaggacgcgcaggacgaggtcgactcgctcgagggcgagtggctcgagctcgccgaacgactgggaatagactaggaaggcggaatcgcgtgacggagctgctctctaggttcctcgggccctaccgggggaaggtggtcctggccgtcacgacgaagttcgtcgaggtgctctttgacctcctcacccccgtcatagtcgcccgcatgatcgaccgtggcatcgcaaatggcgacgttggcctggtggagaggtacgccctcctgcttgtgctgttcgccgcgctgggctactgcttcaccctggtctgccagaagatggcggccctggtctcgcagggctccggcaccgacatgagaaacgcggtcttccgccgcatctgctccctctcggcggcagatgtcgacgcgctgggcggagactcgcttgtgacccgcgtgaccaacgacgtcaaccaggtgcaggtcgccgtggccctaggcattcgccagctcgtgcgctggccgctcctggccatcggctccatcgtcgccgcctgcctgatcgacgcctctctcgggtcgattctgctggggtgcatggcggtcgtgtgcctggtcttctggctggtcatgtcgcgctcggtcccgctcttccagcgcatgcaggagggtctggagaggatcaccctcatcgtgagggaggccctctcgggcgtcagggtgatccgcgccttcaggcgcgagtccttcgagtcggggaggtttcaccaggcgtcagacgagcagacgcgctccgcagtgcgtgcggggacccttggcgccgtcctcaacccggcgacgctcatcgccctcgacctgggcatcgtagcgatcctgtggtccggctcgttcaggatccaggccggcacgctcacccagggcgagatcgtggccttcgtcaactacatgacgcagaccctgctcgccgtcgcctacgtcgccaacctggtggtcaccttcaccaggggcgccgcctcgggcgagagggtcatgcaggtcctgcaccgcgagccctccgtcacggacggctcggccacgccgctcgcgctgccccccgcgggccaggcggccgccctcgagctgaggggcgtgggcttctcctacgaaggcagcgcacgtccagcactggacggggtgacgctcagggtcgccgaggggggcacgctcggcatcataggcggcacgggctcgggcaagtcgagcctcgccaacctcctccccaggctctacgacgcgaccgagggctccgtcctggtcctggggaccgacgtgcgcgggtatcccctggcccagcttcgcgacgtggtctcgctggtaccccagcgcgcctcgctcgtgagcgggaccatccggagcaacctgctctggaggaggccccaggcaaccgacgacgagctctgggaggcgctccgcatcgcccaggcggaagacttcgtgagccagaagcagcgcggcctggacgagccggtcgaggcgcgggggatgaacttctccggcgggcagcgccagcgcctcaccatcgcgagggcactcgttggccacccccgggtcctcgtgctggacgactccgcctccgcgctcgacttcgccacggacgcgcgtctgcgcggcgccctcgccacgctccccgggaccactaccgtgatcgtctcgcagcgcgtctcggccgtgatgggggcagaccagatcctcgtgctggaccacgggaggcaggccggcctgggcacgcaccacgagctcctgtcctcgtgcgggctctaccgcgagatcgtggagtcccagctctccagggaagaggcgatgcgctgatggcaaacccctacacctcgtccgcgacggcacagggaacgctctccaacgtgcgggggttcgaccccggcgaggggggagacgcgtccctggacgaggccgccctttcctactcctcgggccaggtggtcggcagggtcctgaggtacgccgggccccacgcatggctcctcctgctgtccttcgcctgcaccgtggcgacctcgatcctccagctgtacgtgccgatcctcgtgggcagggctatcgacacgatggtgggggagggacgcgttgacttcgcctcgctctccccgctgctggcagggctggtggccgtggtggtcgcggcggcggcgacgcagtggctcgcctcgttcgtgaccacgcgccttgcctacgagaccgtgcgcgaccttcgcaacgacgcctacgacaagctcgaccggctcccgctgtcgttcgtggactcgcacagccacggcgacctgctcacccgcgtggtcaacgacgtggacgccgtgggcgacggcgtgctccaggggctgacgcagctcttctcgggcatcgtcaccatcgtcgcgaccatcggcttcatgctatccctctcggtccccgtggcgctcgtggtgatcgtgctcacgcccctctcgatcctcgtggcctgggccgttgctcgcttctcgaccaagagcttcgcctcccagcagcgcatccagggcgagctcggtggcctcgttgaggaggtcgtctcaaaccagaagctcgtggaggccttcgcccagggcgacgccttcgccgggcgcttcgaggagatcaactccaggctctatggggcgggggagcgggcgcagttcgtgagctccctctccaacccctccaccaggctcgtcaacaacatcacctacgcggcggtcgccgtcgtgggatgcctctgcgtcatcaccggcagcccctcccccctgaccgtggggcaggtccagagcttcctggcctacgccaaccagtacatgaagcccttcaacgcggtctcggcggtggtcacgcaggtgcagggcgccttcgcctcgggcaggaggctcctcgcgctcctcgacgccccggagcaggtgccggacgcaccggacgccgaggagcttagcaaccccaggggcagcctccagctgagccacgtgtgcttctcctacgtcaagggccgcccgctcctgagggacgtggacgtcgcgattcccgccgggagcaggttcgccctggtcggtcccacggggtgcggcaagaccacgctgatcaacctcctgctgaggttctacgacgtggactccggcagcatcctcgtggacggccatgacatccagggcctcacgaggggcagcctgcgcgccgcgtttggcatggtgctgcaggacacctggctcttcgagggcacggtgagggacaacatcgcctacggcaggccgggcgccaccatggacgaggtcgtggaggcggccaagcgggcgcacgcccacaagttcgtgatgcagctccccaagggctacgacacggtggtgggcggctcgggccagacgctctcgcagggccagatgcagctcctctgcatcgcccgcgtcatgctcgccgaccctcccatcctgctgctggacgaggccacgagctccatcgacaccaggacggagctgcaggtccagggtgccttcgacgccatgatggagaaccgcacctcgctcgtggtggcccacaggctctcgaccatccgcaacgccgactgcatcctggtcatacgggacggcaggatcgtcgagcgcggcacgcacgacgagctgctcgcccgcggcggcttctacgcgcggctgtaccagagccagtttgcccagtcccccgcgggggcgtagcgctccagacgcccctcgccttcctaccgtccgccaatcgcaacgcagccccgcacatcaacgaccgtatcatcggttccgtcgctcaatcggggtccgtgcgaacaggagggggtgccaggcatgggcgatccagaatgggacgtcgtcgtggtcggggcgggggtgtgcggctgcgccatagcgcgcgagctatccaggctccaggcgagcgtcctcgtggtggaggctcgggaggacgtgtgctgcgggacctccaaggcaaactccgccatcgtgcacgccgggtttgacgcgccgaccggctcgctcatggccaggctcaacgtggagggcgcctcgctcttcccccagctgtcgcgcgacctcggctttgcctacgagcgcattgggtcgctcgtggtatgcactcgcgaggaggacgtccccgcgctccgggcgctgctcgagcggggcagggcgaacggcgtccccgacctctccatcgtggggagggacgagctggtgcggatggagcccaacgtgtccgacgccgcggtggccgcgctgtgggcgcccaccgacggcatctgcgaccccttcgacctcacctgcgcccttgcggagaacgcggcggcaaacggcgtgtccttctccctcaacgagcgcgtgacgggcctccgccggcttcccggcggcacttgggaggtctcgaccacgcggggcaaaagggccgctcgggttgttgtcaacgccgctggaatccatgccgacgaagtgcacggcatggcgtcgtcccggcccatgaggatcgtccccaggcgggggcagtacgagcttctcgacaccacggcgggcgaccacgtgcgtcacacggtgttcgcgctccccaccaagatgggcaaaggcgtgctggtgacgcccacggtccacggcaacctgctggtggggcccaccgccgaggacatcgacgacaaggacggaacccaaaccaccgcggagggccttgccagggtccgagaggcgagcgcgctcacggtacgcgacatccccttcagggagacgatcacgtcgttctccggcctcagggcgcaccgccccgagcacgagttcgccatcggggaggcgcccgacgcgccagggttcgtggactgcgccggcatcgagagccccggcctcagcgccagccccgccatcggccgcatggtcgcggggatcgtccgcgacatcctgggcctccaggagcgggagggcttcgtcgcaaccaggaggggattcccccgactcggccggctctcgctcggggagtgggacacgctcgtacgtgaggacccggcctacggccgcgtggtgtgccgctgctgtcgggtgagcgaggcccagattcgcgacgcctgccgcagggtcccgggcgccacgagcgtcgacggcgtcaagcggcgcgtgggggcgaccatggggaggtgccagggcggcttctgcacgccccgcatcatgcagatcctctgcgaggaggtgccgggcctcgacctgctcggcgtctgcaagtcgggcccaggctctgagctcgcggtggcaagggacaaggacgtgcggggaggcggggcagatgaggactgaggaggtggccaagctggcagactacgacgtggtggtagtcggcgggggctccgcgggtctctcctcggccatcgccgcctacgacgcgggtgcggccagggtcctggtcctggagcgcgacgtgcgcctgggcggaatcctcaaccagtgcatccacaacgggtttgggctgcaccgctttggcgaggagctgaccggtcccgagtacgccgcacgctacgagcgcgcgctgggggagaggcccatcgacgttatgacccatgcgacggtcctcagggtggtcccgggccagggcgtcgtggcggtgagccccgagcacggcgtgttccgcgttggctgtagggcgaccgtcctggccatgggctgccgcgagcgaccgcgtggggcgctggacatcccgggcacgcgacccgcgggcgtgttcacggcgggaaccgcgcagcacctggtcaacgttgagggcgtccttcccggaagggaggtcgttatcctggggtcgggtgacatcggcctgatcatggcccgccgcctcacgctcgagggggcacgcgtgcgctgcgtcgccgagctcatgccctactccgggggactcaagaggaacatcgtgcagtgcctcgacgactttggcatccccctgctcctctcgcacaccgtcgtgggcgtggagggtcagaggcgcgtctccgccgtcacccttgccaaggtcgacgacaggctccgtcccatcccgggcaccgaggagcgcatcccctgcgacacactcctcctctcggtggggctactcccggagaacgagctctcgcgcgaggcgggcgtcaggatcaacccggcgacccgcggagcgtacgtggacgactcgctcatgacgagcgttcccggggtgttctcctgcggcaacgtgctgcacgtccacgacctcgtggacttcgtgagcgaggaggcggctcgagccggggggtgcgcggcccgctacgcgatgggggagggggcagccgaccccggggctgccgtgagcgtggtcgcaggcgatggcgtacggtacacggtgcccagctccctccaccccaagacgatgcccgaggcggtcacgctgcgctttcgcgtcaccggcgtgcgcgagcactgccgcctgagcgcctacctgggcaacgaacgcatctcgaccaggcggcgcgacatcgtcgtgcccggcgagatgcaggagctcaaggtccgggcggactcactcgcaagcgccgggggagacaaaccgctcaccgtcgtcgtggagggggcctaggatggaacgccaaactctcacctgcatacgctgcccgaggggctgccaggtcaccgtcaccctggacgacggggaggtcttggcggttgcgggcaacggctgcccgcgcggcgaggcctacgcccgcaaggaggtcaccgcccccgcccgcgtcgtgaccacgaccgtgcccgtggatggttcggatgggtgggccgtggtctcggtgaagacagcaggagacgtacccaaggcactggtgcggtccgtcgtctcggagcttgcgaacgtgcgggccaaggctcccgtgcgcattggcgacgtggtcctggcgaacgtgtgcggcaccggcgtcgacgtggttgccacaaggaacgcgacctagccccgcccgtgaaagatgttgcccgcgctggggaacaatgcgcacggttggtcgcccgtggtctcgggcgacggttgaggggaggcaccacatggcggacgaaatcgccgtcgcaccggtcgtgaacaagcaggcacccatcttcgaggcgcgcctcaggcacaagatcctgaggatgccccaggccgcatgggatgccagcggcatcgtcatctttgggcgcaagatccgcaccctcgtgtacaccaccgacctcgccgtgatcaagaactgcaacgcggacgcggtcttcgccgtgtacccgttcaccccgcagcagtccatcagcgacgcgatcatcagcgcgtcgagcatccccgtgttctgcggcgtgggcggcggcaccacgcgcggcgtcaggaccgtgaccctggcccacgacgtggagtgccagggagccatgggcgtggtcctcaactcgcccatctccaacgtcaacctcgccgccgtgtcgcgcgccgtggacatccccacggtcatcacggtggtgagcgaggacaccgacatcgaggcgcgcctgcaggcgggcgccgcgatcatcaacgtggcgggaggggcgagcaccgcctcaatcgtgaggcacatccgcgagagcttccccaacgtgcccatcatcgcatccgccggcaggaccgaggagtcctgcgccgcgacggtcgaggcgggcgcgaacgccgttaccttcacgccgccctcgacggcggagctcttctcccagatgatgcgacagtaccgcgaggcgcctgcccccgcgcagaaggagcagacggtggcggacgtcctccgcgccgccggctttgcccgcaggcccgcgaagggagactccgaccccaacgcgcaggtgccgtccgagcagtaggggcgaggaatcacgcgagactgcatgttctccaggccagcacccctaccagtgagagaggcgctggcctggttcgtttgggggcgctcgaactgtgggcgtcctcctctatggatgcgggctcgaagtttcgaccctcgtgattgggcctcggtggtcaatgaacggaggagggtggcttctcgtcagaagattgaactcccttccatggggcgaaatggctacccatccccgctctgcggccattgagcttagatttcccggtgcccgtatccgtcggacttggcgagcgcttaatgttcgcgagggatgcacggattttcattccctgcagtcgcactgccgccgaccggcttaagcattcatcctcggaattcgaccacgcctcgggaaatttaagcggccaagccacgccatccgggcattccccggcgtagcgcccccattaccccactccttgtctccccttcgcatgcccgtcaacgtgcctgagcgtggaaacgccacggtgatcgagggcgccccccgcaggcgcgccattcctgccccgccatcggtcgcaaggcccaaccattttggactcttatgtgtgaaaggcaggtacctgaccagcaattcaggcacctgcctttcgtttccctgtagaatgctcagttgttttgcctgtccgagtgacaaatgggggaacttccaaagatgtccgacatgactaccgccatcgcgtccggcctgctgggcctggcgtccgccgccctgtgcgtgctcctcgtcttcgcccgagccaagggcgtgtggcccttcgccgcagagggagaggagaggccatccggcggcacgctcgcctacgtcggcttcaacgtgttcgtggccgtggtggtcgcggtcatcggcttcctccggcttgaccttgcgcccatctgggaggtcgccatcgtggcggtgctgctcgtcctcttctcctacctcgagctgctgagggacggcttcctcgccggccttggcgccaggttcgggaaggcggggacggtcgccaagaacatcatcgccttcctgggcgccgcctttctgggcatgtgcgccctcgagctcccctggaaccgatacttcccgttcttcccgcccaataccttcgccatcgagctcggcctgatctgcctggcactcctcgccctcgtcttcatcgcccagcgccgtgggggcgccgcggtgggcggcgtcctcgcgctgttccttatcggcatggcgcagttcttcgtgagggagttcaaggggaccgccctccttccctccgacgtccttgccgccgggactgccgccgaggtcgcgggcggctacacctacacggtcacggacatgtgcctgtggggcctgctctgcgtggctggagcggccttgctcctctccctcatcgttccctcgccgagacgggaggaccagcccgcgagtgacgccgagccctccggcgaggacggcgacgccaagcccaaggcagccccggggcgcgcacgccgcgtccttctcaacctggtcgtcgccgcggcctccgtcggagcgatcgcgcttctggtcctggtcccctcatggagggacgatctgggcgtgaccttcggcaactactggtttgctatggactactatgaccagcagggcttcctccccggcttcatcaccgccgcgcgcgacctgcccatcaagaagcccgagggctactcggactccgccgtcgagaaggccgaggagcagctcgcggccgagtacgacgcgagcgatgccgccaagacctacgcccaggcggccgcccagttcagctcgaccaagcccaccgtcatcgtggtcatgaacgagagcttctccgacctcgccaccgactacgacgggctgggcatcggctacgccggcccccagttcctgcagaccggcatgaccgatgcgctgtcgcagggtagccttgccgtctcggtcatcggcggcggcacctgcaacaccgagttcgaggcaaacaccggcaactccatggccttcatcggcgacggcaagtacccctacatgctctacgacctcacgaacgtggactcgctcgccaagaagttcaaggcgctgggatacgacacgaccgcgatccaccccaacaacggggccaactggaagcgcaaccgcgtgtatcccgagctcggctttgacaacttcctcacgatcgacgacttccagggtgccgaggtctaccacaacggcgtctcggacgaggagacctacaagaagatcctggagctcctgcagaccgacgacaacccgcagtacatcctcgacgtcaccatgcagaaccacagcggctacgagactggcaacatccccgcgagcgacctcgtggactacgaggttcccggggtagactccgagaccaactccaagctctccgagtacctggcctgcatccagaagagcgacgaggcgctgcagtacttcgtgacagagctgcgcaagctcaacaagcccgtggtgttgctgttctttggcgatcaccagcccgagttcacccccacgctccagaaggccctctatcccgacgaggacgacctgtccgcgatggagcgcacgcaccagacctcctacgtgctgtgggccaactacgacgtggcgggcaactcgcagacggccgagacggacgacatctcgcccaactaccttgccgccaagctctcgagcgtcatcggcgcgcccctcaccacgtaccagaaggcgagcctccagcttcgcaccaccttccccgcggtcaacatctacgggtaccgcgactccagtgggacctggcactcgctctaccaggacgatgggtcgacgctcgtggacgacctcgacgagatgagctcgatccagtactacaacttcgcccagaaggtggaatagcccccctggccccgggggacgggccccgaggcaggggttctcccctgcgttcgaaggctttgtgtgccgtctcgctattgcggtactatcagatggctttcactactggcacttgcggtgatatgggagttccattggccgagaccaaggaaaagatcaagaggcagggcaagaacctcgccgaccatgatgctgcggtggcccaggccgcgggaacgaccacggatcccgtcgggacccccaacaacccgtccaaccaggtgctcaccgtcgccaactgcatcacgctctgccggttcgtgctcaccgtcgccttcctcgtcctgttcgtgaacgacgggaacagggcggtcgccctcagctgctacgccatcgccgccgtcaccgacttcctcgacggccaggtggccaggcgaacccagaccgtgagctgggtcggcaagatcatggacccgatcatggaccgcgtgctgctcttcacgggcgtgcttggcctgatgatcacgggggagctccccatctgggtggctgtgttcgtgatcggtcgcgacttggtcctgttcctgggcgagctcaggctccagcggtaccgtacccgccccgtcgacgtaatctacatcggcaaggtcgccacggccctgctcatgacgggcttctgcgacctgctcctgtccgttccccagattcccgcgctccacctggttcacgtggcgtggctcccggggttcaacgacgtgggggcggcgctgggcatctatttcgtgtacgcgggcgtcgtgtgctcgttcatcacggccgtgcggtacttccagatcggcttcgccatcaagcacgaggttctcgcggagcgcgccaaggcagcccgggaggacggttcggaggattctgggagcgtgaggtagcgtgcgtgcccccatgcgtcgcctcgccgtcgccctcgcgaccctctcccttgccgcactggcgctcgtctgctccccgtcccgtgcgctcgcagccacggacgacagcgtgcccacgctctccgaggcccaggcctactgcgtcatggaccaggacgggaacgtgctgagcgagagcaacgcctacgccgagatgcccatggcatccatcaccaagatcatgacagccatagtcgcgctcgactcgggcaagtcgatggacgacacctgcgccatcaccgaggaggacttcgaggcgggagcccagctggtgggctacaacagcaccgacacccccagcttctacgacctgatgatgtcgatgctcgtctactccggaaacgacgcggcagacaacgtcgccatcaacgtcgcggggagcgtcgacgccttcgtggagctgatgaacaagaaggcgcaggagctggggctcacgcacacgcactttgccaacccctccggcctcgaggcggacgggcactactcctgtgcgcatgacctcgccgtcctggggcgctacgcgctcgagaactaccccttcatcgcgcaggcggtcatgacgcgcagctacaccgtcacggcgggcggcgcgtccgtgaccctgcactccaccgacgacctcatggacacctacgtggggctgtgcggcatcaagaccggcaaggtcgagtttggcaccagcttcctgggctcggccaagcgctggggcgtccagctcttcacctgcgtcctggggtgctcaaccaacgacggcaggttcagggacaccgagaccctcatggactgggcgttcgacacctacctcaaccacgtgagcttcgcccgcaaggggcaggtcatccgcgtggccaactgctccaccagcttctatggcaagctgctcgtgagcagcacggccaacgcgaacggtcgcgcgtaccccaaggcggatatctcgtacaccacaaacctgttcaacaccaacaacctcgtggaccccggcggggcctacggcatggcggagtggacgcaagacggcaggagggtctgcagcaccacctacgtggcaggcacgcagctctaccggattcccgcgttcaacatcttcgagctgccgctgttctacacgatcccgcagggcgacgcggcgtaggggaggactcgcaatggaacgttccccgctgtacgaggagcacctgctccttggtggcacctttgacgggggagagggacgccgtctcctgggccccagctcctatccctcgggcgagccggacgtggtggatggcagcgcgctcgtggacctcagcggcacccccaccatcctcctctcgggcgatggggcgcagcagtttgccgaggcgacccttgccgggaggcgcctcggcgtgggcgaggccgagttcgaggcgtccctcctgggcgacggctccatggcgtccgtcccccttgcctccaggaccgggcggcaggagtacgtgctctgggacctcacgccccggggcgagaccctctttgcctggctcggcttcgtgcagggcatcgagagcgggggcttccgtccctacgggggcgtcagcgtcgaggaggtgggcgagaggctcgtgcccctcctcctgtgggggagcaccgccacggccgtgctctcggactacgcccgtggcggggaggacgtccccgcccccggcggtgtggggaacctcatgctcgacggcaagatcgagtccctcgtcgcctccccgaggctgggggacgagcccgcgtacctcctcctggtgccgcccgccttcgcccgggtcatgtggaggagcctcctctcgttcccctcggtgtccccgcttgggaccacgggccttgcggcaagggtcgaccaggcgctgccctggatgccctccctcggcgtcacggataccctcaggctcgaggccgcggagctcctctcccacggcctcgtacgcgaggagggcggcttcatcggtgcccgcggcatctttggctgacgtttgataggcgcatgccctttggggtatgtagctaacgcaaccgccaaccataggcgaggcatgccccgagggcacatggctcccgcggggcggcccgcgagcgccagccagcagggaggtagcatgaagtactccatcaacgcccccggcgcacccgagcccctgggcgcctattcccagggaacgaccgccggaaggctcatcttcgcctcgggtcaggtcgccgtggattcccacgacccgcagcggctcgttgacgggggcgtgcgcgagcagaccgaccgaatcatccagatcttccagacgctcctcggcgaatgcgggtgctccctctcggacgtggcgcagaccacgctctacctcaccgacctgagcctgctccccgccgtggacgaggtctattccaggaggttccccaccccagccccggcgcgttccgtcgtgcaggtggcagccctgccgctgggcgcggtggtggagatggactgcatcgcctgcaggtagcggtatcatgttctgaaatgcaatcgatctgatgggagaagcatgcagtccaaggacacaaatgcagagatgggcgcaaccgagatctttcgcatgccctccaccgaggccacctcgcccgacatcatggggcaggcgcagcccagcaatcccaccctcaccatcgtcaaggggccgcagaccggctccgtgttcgagctcaccgacaaggtcgtgagcatcggcagggaccccagcaacagcgtgttcctcaacgacatgacggtgtcgcgccaccacgcgcgcctggacctctcgggcctgggctcgggcttcgcgaccatcgaggacctcgggtccctcaacggcacctgggtcgacggcgccatcgtcaaccgcgccatgctcaaggatggctccaccatccagatcggcaccttccgcatggtgttccacgccaaccgtcgcgcaaccaggatcgagactgggaactaaggatgcctgacgccgggtacctcacaatcggcaaggtcgtgaagaagctccaggcccagtatcccgacctctccatctcaaaggtccgctacctcgaggacgaggggcttctcaacccctcgaggactccctcggggtaccgcctgtactcgcagcacgacgtccacaggctcgagaccatcctctacctgcagaagaacaggttcctgccgctctcggtcatcaaggagcagctggacggcaagccgggggagggcggctcggccctggatgccgtcacgtctcccgccctgctcccgcaggacgaggaggcggcggagaagctccaccccatcgaccgcatgcccgagctcctgggcgtgccggtaagttttgttcgccagctctccgaggcgggcgtgatccccctcaagaagtcaccccacggcagggacctggtggacgggagggacttccccctcatccgggcgtgcgacgagctgcgccactttgggatcgggcccaagaacttgcgccagtacgtcacggcggccaacagggagagcgccatgttcgagcaggcgctcgtggtgttcgcccgcaagggcggcggggtcgagatggagctgaccgacgagaatcgcaagcagtttggcatggcctttcagcagatgctcgtgctcaccgaccaggtgcgcgacacgctcatcagaaggcagatttccaagacgttcagccagatggaacagtagagggagtaacatcgtctgcggtgtgtgacccgcagcgagaaaggaacctccgtgtctagcgtcgaccttgagaagtacatcatcgacattcccgactaccccgagcccggcgtgatcttcaaggacatcacccccctcatggcgtcccccgagggcctgcacgaggcagtggaccagatcgccgaccacttcaaggatgccggcgtcaccaaggtcatgggcgcggaggccaggggcttcctcatcggcgcccccgtcgcataccgcctgggcgccggcttcgtccccgcccgcaagcccggcaagctcccgcgcgaggtctacacccaggactacgccctggagtacggcacggacgagctccagatgcacaaggacgccgtcaccgccgacgaccgcgtgctcatcgtggacgacctcgtcgccacgggtggcaccgccgtcgccaccgccaagctcgcccttcagggcggcgccaccgttgttggcttctccttcgtcctcgagctcgagttcctgaatccccgcaaggtgatcggcgaggtgtttgaccaggacgtgttcacgctcatcaaggtgcattagaagcacacaagcactatctttgctgaaacacgcaggtagcggccccgtcattctcttggcgaggccgctctttgggttgcttgggggaggcttttggggccctcaccgccgtgggcgctagaatgtatgggtccagattacggaaggatggtctcatgaagttctcttcccacagggagtcaatcgcgcgtagggcagtttgcgctggtctcgccgcgaccctcgccctcgggagcgtgccaaccgccgccctggcggtcgaccagtcggacctcgatgcggcgtcccagaagatcgagacgctgagcaaggaggccgagtcgctccagtcctcgctctccgagacgacgcagaagctcgaggacacccagtaccagattgacgagaagcagtcccagatcgacgaggaccagcagaaggtcgcgcaggcgcagcaggagctcgagcagagccttcgcgacgactacaagtcgggcggcatcgacctcacctcggtcgtcctgggttcctccaacatcagcgacctcgtctctcgcctgtactacgcaaccaaggtgaacgagtcgcgctcccagaagatcgagtccgtcaagcagatgcaggagcagctgcaggcggagcaggcgagcctgaaggagcgtcagtccgagcagcagtccgcggtcgacacgctcaacagccaactcgccgactacaacagcaagatctccgaggcccagagctactacaacagcctgagcgcggagcagcaggcccagatccaggcccaggcccaggcggcggccgaggcgtcccagtccgacggcagcggcgactcgtccgcgaccgcggcggtgctccagcaggtcacgcagggaggctcctcctccacctcgtccacgggagcgaccacgtcctcctccaacactagcagcccctcgaacagctccacctcgggcggttccagctcgagcggcggcaaggcaaactccggttcctcgagctcgggctcgtccagctccagcaagggcaactcgtccagcggctcctcgagctccaactcgggcagctcctcgagctccaactcgggcagctcctcgagctccagctccagctcgtccggcagcagcagctcctccacgaccggtggcgcctccggcggcggcctcagcaccgcctactccatgatcggcgtcccgtacgtgtggggcggcacctccgcgagcggcgtcgactgctccggtctggtctgctactcctatggctacaagcgcggccgcaccacctacgacatgatcgcctcgctcaaggcctccggcgactggaagaccagcatgagcgacctcaaggttggcgacctcgtcttccccagtaccggccacgtgggcatctacatcggcaacgggcagatgatccacgccccctacccgggcaggacggtctgcatcgcatccgtgtatgccttcatcggcggcgggacctactaggcgcaggtcatcgcatcaccagcgagacgggacgtcggcagtgctgccgcgtccgcctcgctttttgtattccgacggctcgcgtggcaatcgtgccctaccatggagcggtggttccaggcaacgggaagggaaggtcgcagggcatggtgcttgactctgggcacaggggcgtcagctggaggctctcgcgaaggttccaggtcgacatggtgtgggagggcgtcctcgttggcctggcaggcgggggagtcgtcaccctgtaccggctgtccctctccctcgccgaacgcgtcctcaggggcactgtcgccctcgcaaggaccagcctcctcgtggcggcgctcttcgccctgttcctcctcgccgcctgcctcgccgtcgggaggctcatgacctgggagccgttcacgcaggggtcgggcatcccccagacggacgcggaggtcataggcaggctcgacatgccatggcaccgcgtcatgctcgccaagttcgcggagggcaccctgtgcgccttctcgggcctgtccctgggaagggagggccccagcgtgcagctgggggccatgggcggcaaggccgtctcgcgagccctgggccgcggcaggggagaggagcgcctcctcgttacctgtggcgctgccgccgggatgtccgccgccttcaacgcaccgctcacgggcgtgctgtttgccctggaggagatacacaaggagttctcggcccccctcatcatctcggtgatggcatcctccatcgcctccgacttcctggtgtcgcaggtgctgggcgtcaaacccgtcctccagttcgtattctcgcgcgacctcccgcatcccctgtacgcctacgtggtgctgctcgccctcttctgcggcgttgcgggggcgctccacaacagggggatgttcgcctgcacggagcgcctgtactcgcgcatcacccggggcgtgccgtactccaggatcgccatccccttcgccctggcgttccccatcgccttcctggcgccccagctcatgtgcggcggcgacgccatcctggagcagatcgccgcgcccgggaacctggcgctcggcgccatcgtgctgctcctggtggggaagtacctgtacacgaccgtgagctttgcctcgggcgcccctggtggcacgctgttccccctctgcgtcatgggcgtgctctgcggcctcctgtttggcaccttcgccaaccagttcctggggcttccctcctcctacgtcaccaacttcgtggtgctgggcatcgcggggctgttcgcctccgtggtgcaggcgcccgtcacggccgtggtactggccttcgagctcactgggagcctcgatgccatgctcagcgcctcgatcgtctccatcgtctcgtacgtcaccgcaagccttctgggggtcgacccgttctacgagcacctgctctcaaggctcctgggctccaccaggcccacgcgcggcgacggcacgggtggccagagggagctgcacagctacacagtcggtgcggggagcaagatggagggccgcacgctcgccgagattccctggccggaaggtgcccgcgtggtgaccatcaaccgcggctccaccgagatcgtgcccacgggctcgaccaagctgctggcccttgacgaggtcctggtgatcatgaccgccgggggagagagcgaccgagcggtctgggacctcgcgcgcggctcggtgaccacggagcgcacaccccgctcgcactagcggcttggggtgcagaagccgtccgtcccccgtctcgcgtgcgtgaggcgcccgcacggggtaccctcgaagggtgggccccggggagggaccacttgcgcgagggagggacagagtgacaagcgataagagccagggggacgttgagcccatggcaccgagcgagtgcccgtttgggacgcggtgcgccttccacaggaggggcgccgtctgcatgagccagatacgcctctttgcggggctcgacctggaggcaaggcgcgagctcctctcgcatgccacgcagaccacctaccagcgcggcgacatcatcgtcgccgagggcgaccccatcgactccatcctcatcgtgcgctcgggccgcatcaagacctttcgcgtggaccccagcggcgaggagacggtcctcgacatcctgcacgacggccaggccatctggcacgggatgttcctggaggacaacgtctaccactactcggtggggtgcctctctcgcgtcgaggtgtgccggatccacagcaagagcttcgagaggctcatctcccagcggcccgaggtggccatgggactgatcaggatggtctgcaccgagctcgacgacgcggaggagaaggtcatgatgctcgggatccgcgaaccgcgccgtcggcttgcgggcttcctcctgctgagggaccaccgctgcctggggggcgagatctcgctcaagctcgaggacatcgccgcctcggttggcctgaggcccgagaccgtctcgcgcaaccttgcctccctggagcgcgagggcgtggtgaagcggctcggacgcgggcgcctcaaggtgatggaccccgaggcgctccgcaagatttcgggtggctctgccgattccccacaatatgaggtatgaaattccctgaccttctcgttacttgaccagaatcatggaacgcatgcggtcccctcggatagattgtccctgtcaccaagacgaaacaatccgagggggctgccgtgctgggtagggttcactcaacagagtcgtttggctccgcagacggccccggcgtgcgcttcgtcgtcttcctccagggctgcgacatgaggtgccgctactgccacaacgcggacacctgggacagggacggcggccagctcctctcagccacgcagatcctggacagggccgagcgctaccggtcgtactggggaccggagggcggcatcacggtcagcgggggagaggcgctcctccaggcgggcttcgtggcggagctctttgaggaggcgcacaggcgggggattggcacctgccttgacacctcgctccagcccttcacgcgcgacgagccgttctttcccacgttccgtcgcctcatcaagtcctgcgacctcgtgctggcagacatcaagcacatcgaccccgagcgccacaggtggctgacggggcacggcaacgagaacatcctggacgggctcaggttcctggccgaggtgggggagcccgtgtggattcgccaggtgctggttcccggcgtcacggacgacgatgcgcagctgcaggcgaccagggagtttgtcgacaaccttcccaacgtcgagcgcgtcgaggtcctcccgtaccacacgctcggcaagttcaagtgggacgggctgggaatcccgtatccgctcgagggcgtggagcctccgagccaggagagcatagagcacgcgaggcgcatcctctgcaagggggagtagggtctctcagataatcgccagtcacgatggaaggagcaccgatgcacatgagggaagagtgggacggctttgctgccgggcattggacggacgacgtcaacgtccgcgactttgtccagcgcaactacacgccctacgacggggacgagtcgttcctggagggacccaccaaggcgaccgacaccctatggggcaaggtccaggagctgcaggcacaggagcgcgccaacggcggcgtcctcgactgcgagaccgaggtcgtctcgggcctgacctcctatggccctgggtacatcgaccccgagctcaaggacctggagaaggtcgtgggcctgcagactgacaagccgctcaagcgcgccttcatgccctacggcggcatcaagatggccgagcaggctgccgagagctacggctacaagatcaaccccaagtaccacaagatcttcaacgagtaccacaagacccacaaccaggcggtctttgacgcgtacacacccgagatgcgcgcggcgcgtcacagccacgtgatcaccggcctgcccgacacctacggccgcggccgcatcgtgggcgactacaggcgcgtcgcgctctacggcatcgacttcctgatcgccaagaagcaggaggacctcctcaactgcggtgacggcaccatgaccgacgacgtgatcaggctccgcgaggagatcgccgagcagatccgcgccctcaagggcatgaaggagatggccgccgcctacgggtacgacatcagccagcccgcccgcgatgcccacgaggccgtgcagtggctctactttggctaccttgccgccatcaagacccagaacggcgccgccatgtccgtgggccgcatctccacgttcctggacatctacctgcagcgcgaccttgcctcaggcaagatcaccgagaccgaggcgcaggaactcatcgaccacctggtcctcaagttccgcatggtcaagttcgcccgcatcccctcatacaacgagctcttctctggcgaccccgtgtgggccacgctcgaggtcgcgggcatggggcaggacggccgttccatggtgacaaagaacgacttccgcttcctccacacgctcgagaacatggggccggcgcccgagcccaacctcacggtgctgtactccaagcgcctgcccgaggccttccgccgctacgccgccaagatctccatcgacacctcgtccatccagtacgagaacgacgacgtcatgcgtccggtctggggtgacgactacagcatctgctgctgcgtctccgcaaccgagacgggcaaggagatgcagttcttcggtgcccgcgccaacctggccaagtgcctcaactacgccatcaacggcggcaaggacgcaaagttcaacgacaagcagggcaaccacatgcaggttggccccgagctggcgcccatcacgtccgagtaccttgactacgacgaggtcatgcacaagttcgacctcatgatggactggcttgccggcctctacgtcaacatcctcgacctcatccagtacatgcacgacaagtactactacgaggccgccgagatggcactcatcgacaccaacgtgcgtcgcaccttcgccacgggcatcgcgggcttctcccacgtggtcgactccctcagcgccatcaagtacgcaagggtcaagaccgttcgcgacgagagcggcatcgtggtggactacaaggtcgagggcgacttcccgcgctatggcaacgacgacgacagggccgacgacatcgccgtgtggctgctcaagaccttcatgaccaagatccgcaagcaccacacgtaccgcaactcggagcccacgacctctatcctgaccatcacgtccaacgtggtgtacggcaaggcgacaggagcgcttcccgacggccgtcctgcctacacgccgttctcgcccggcgccaacccctcctacggagccgagaagaacgggcttctcgcctcgctcaactccgtcgccaagctcccgtacgagtacgcgctcgacggcatctccaacacccagaccattaacccgggcgccctgggcaacgacgaggggcagcgcatcggcaacctggtccacgtcctggacggctacttcagcgagggtgcgcatcacctcaacgtgaacgtgtttggcgtcgacaagctcaaggacgccatggagcaccccgagaagcccgagtacgccaacttcaccattcgcgtctctggctacgctgtcaagttcatcgacctcacgcgcgagcagcagctcgacgtcatcgcacgcacctgccacgaccgcatgtagtgttcgtcagtaggtgacacacgggggagggcgaccagttcgtttggccgccctccccattctcgttgctctcttctactttacataacatatattatcgcgggttttgagagagagaaaagagggtgcctcccagctggggacgacaccctctggcatcccgcgtttcagccgacgctacccctcgagcggttggccgaggaacgtggccacgctggttgccgcgatggcaccgtctgacgcagccgtgatgacctgcctgagcggcgtgcgcctgacgtctcccgcggcgtacagcccgggagtccgcgtggccatatggtcgtctgtgacgacgtagcctcggggatcaagttccgcgagcccctcgacgatcctagagcccggaacgcgaccgacgaagacgaagacgccaaaggagccctcgtcatactgctcggaggtctcgcggccggtgaggttgtcacggagcgtgaggccgctcaggagcgtcccgcccgtcacggagacgagcgacgtattgaacctgacctccagcttgggattctggctcacctcgcgcgcgacgagcgccgtggcgcgcaggtggtccttcctcaccagcagcgtgaccttgcttgcgaacttggacaggaagagcgcctcctcgcacgcggagttgccgccgcccacaacgaacacctgcttgccgcgatagaacatgccatcgcacgtggcgcagtacgagactccgtggccgcgaaactccctctcgccctcaaagcccgcctcgcgaggcgaggcccctcctgcgaggatgaccgtcttggagtcatagctctgggacgaggtggaaacggtgaagacgcccgtcgaatcatccctcttgatggaggtaacgtcctccatgcggatgtcggcgccaaactcctccgcctgccccttcatggcatccgagaggctgaagccgtcggtatgcggaaggcccgggtagttgtctatctcgctcgtgaggatggcctgcccgcccacggcctcctgctcgagcgtgacagcgtcgagcagggcacgcgccgcatacagagaggctgagaggcccgcaggcccgccaccgacaatgaccaaatctcttataggttgggtgctcatggtgcactcccctttcgtcgactgttgcacgtataccccacatgggcatcggcctctttgttaggctgcggctcacatatctttcatgggacgtctgcatgaaaaagggacccacccttgagggcagatcccaaacccgactctgactaggaaagcctagacgagcaggaagtagacgatgaaggcgatcgtggccacccacatgaggggcttgatctccttgatcttgccggtgacggcggcgacgatcacgtaggcgatgaagccgaggccgatgccgtcggagatggagtacgtgaaggggatgccggcgatgaccatgaacgcggggaagccctggagcacgtcggaccagtcgatgtcaacgacgtcgcccatcatgaggaagccgacgataacgagggcaccgcaggtggcggcggagttgacgatggtgatgacgggggcgaagaacgcggcgaggatgaagagaacgccggtggtcaccgaggtcaggccggtgcggccgccgtctgcggcgccggaggacgactcgacgaacgtggtgatggaggaggcgccgacgaagccaccgaccgcggcggcgatagagtcgacggtcaggatctgacggatgtcctcaacgttgccgtcctcggtgaggaagtcaccctgcttggcgaccgccatggcggtgcccatggtgtcgaagaagtcggacatcatgagcgagaaggcgaacacgaggagtgcgggggtggcgaacaccttggcgatgcccatgacgccgttggcgtcggtctggaacggcgccgcgaaggtcgagaagtcaaggccggagacgatgccgctgggggcctgggtgacgcccagggggatgcctgcgaccatggcgatgatgatgccccagagcagggcacccttgacgttcatgacgaagaggatgaccgaggcgatgatcgagatcatgccgacgatgaaggcggggtcggtgacgttgccaagcgcaaccatcgtgctctcgttcgcgacgatgacgccgccgtccttgaggccgatcatcgcgatgaagaggccgaggccgaccgagatggcgtggcggagcgagacggggatagcgtccatgacggcctcgcgcaggccgcagaggaccaggaccgtgatcgcgacgccctcgatgaagacgacggccatggcggcgtgccagtcaccgttggtcataccagtgagagtgtaggcgacgacggcgttgatgcccatgcccgaggcgcaggcaaggggacggttcgcaaacagacccatgcaaattgtcatgatgccggcgccaaggcaggtagcggtgacagcggccatcgcgggaacgcccgcctcctggagaagggcggggttgacggcgatgatgtacgccatggccaggaacgtggtgagtcccgctcgcacctcctggccgaccgacgagcccctctcgcccgtcttgaagaacttgtccatgttgagacctctctcccatgccaccagagaacaacagaaaccggcgggcacctggcagcgtgcccccaccagccaatttcacggccgctcctgcggccgggaaacccaatcttggaaagtgcctagacccccgaggagccgaacccgccagctccgcggtcagtggagtccagctcgtccctctccacgaggtcgacgaagggcacctgaagaatgacgagctgggcgatgcgctcgccgcgctcgatgtggatgtctgtcttggggtcaagattgatggcgcagaccttgagctcgccgcgatagtgggagtctatgaggccaggagtgttggccatggagaggccctcgcgcagggcaaggccgctacgtggctgcacgtaacccgcatagccctccggtatggcgactgccaacccggtggagacaagcctgcgctcgaatggcttgagggtaacgtcctcgctggacctgaggtcaagccccgcgtcgccggcatacgcgtaggatggcagctcgaccccctcgtcgattcttttgaccgctatctggatgtgagcctgctcatccctgcccatctggcctccaatttgctaggactgctctttcatgatgctcttgagctcctcgctgaactcgtcgacgtccttgaagtcgcgatagaccgacgcgaatcggacgtaggcgaccttgtcgatgtcaacgagcctctggaggaccatcttgccaatctcctgggaggggacctcggtctgacccttgtccctcagctcgttctcgatgctgtcgatgagggcaccgagcttctcgatgggtatgtcgcgcttgacggtggcggcaacgaggccacgcatgaccttctgcctgttgaaggtctcctttcgcccatccttcttcacgacgagcaggggcatctcctccctgcgctcgtacgtggtgaagcgagtgccgcagtgaacgcactcacgccttctcctgatggcgtcgtggctctcggacggacgggaatctacgacttttgactcctcacaaccacactttgggcagcgcatcttcctcccacggtaggcgacgcacataaaggtatcacacaagcagcaccaaaagacaaaagacctagaaaggaaaccaagcgtttaaacgctggccccctttttccaggcctttcccataattgggccttgcggcttacctctagttgtgagcgacgggaatctgaagctgctggccggccctgagcgggctggtgccaagcccgttgcgctgggagatccactggacgagctcggtggtcgagacgcccgggaccggatggctttccgcgatcgaccagacggtgtcaccgcctgctacgctgacggtgacaacccgcacctggcccaaggcgttgtcgcgatgggaggactgtaccgcctcgaaggcgccaacaccgacgagcgagacggcacacaccatcatggccacgaggacgaggccccttacacgcgagcggaactcgccctcctgcttacggaaaggagcgtcatccgtgcgccctccctcgacgacgcgaagccggggccgctcttcgcttgcctgaagggcgagggatccgtagcactggtagccctaattctgcgatgcgcctgcatatgagctgttcatatctaatgtctccttcgaacgtgttgccgtaggtataccaaccaccccggacacaaattcgaacgacgttctgtatctggaacacgtgtactatgataggtaccgaacatgtgtgcgtcaatgcaaaatcgaacatttgtttgttcttcgcacgaccgtgaggtacacttgggtcgaagaagggggaaccatggcaaaagaccacctaagcaagcggcagcagcagatctatgacttcatctgctcctacaccaccgagcacggctatccgccctcggtgagggagattggttccgccgtgggcctcgcctccccgtccacggtccacatgcacctgaaggtcctccaggagcacggcctcatcaagagggactccaagaagccgcgcaccatcgaggtcgttgccgagggagacgcaccgtcccagccgctagccaaggtctcgcaggatcttgaccataacgtgatcacgctgccgcttgtcgggagggtcgccgcgggccaacccatccttgcggagcagaacgtggaggagtgcctctcactccccacgagcatcgtgggggactccagctccttcatcctgagggtgaggggctgctcgatgatcaacgcgggcatcctcgatggagacctgatcgtcgtgaaggagcagagcgacgcgcatgatggcgagatcgtggttgccctcatagacgactccgccaccgtcaagaccttctaccgcgaggagggccgggtgcgtctccagcccgagaacgacacgatggatcccatctacgtcaagaaccccaagattcttggcagggtcaccgcgctcatccgctccatctcgtagcgggcgtgagcggcgcagggactgcggcccgttcgacgagagcgggccgcatacactttattgactcggcgcgaggcttcaccatcctctcgatggtgttgtttcacctctgctacgacctgcgcttcatcaatggactgcaggtgcccttcttccaaccgccgttcatggacgtgtggaggaactcgataagctggaccttcctctttgtggcagggctcatgttcgcgcagtcgcacgacaacgccaggaggggcgccaagtacctgctggtgggccttgcggttcgaatcgccaccacggttgcgaatgttgacgttcccgtaaggtttggcatcttcttctgcatgggggcctgcaccctcgcctgccttctgctcgaccggtgccggctgctcccccgctcggtccccgcctgtctcgccctgatcggagccttcctcctcgtcctcggagtcaactcggggtatgtgggcgtaggcaattgggtcatcagactccccggcgagctgtactcctggggaggcctcacttggctcgggcttccctcccccacgtttgagtcgggagactactacccgcttctcccctaccttctcatgtacctctccggggcgacgctcggaatgcgcctaagggagacgggcggctatccggcctgggcgtacgcgagggggccacgatggctcgagtttctcggcaggcatacgatcgtggtgtacctgctccaccagccgatcatccttcttgccttgggggacctgctgtaggggcttcttttccgctgaagacaggcattgcacggtcctcgccctgcctgctcggacgcctattcgccctgctcttcgcagaggtacggggcaagcgtctgagccatgcgcttggatgccctcacggttgcctgcagcccgtcctgagtgtattgctcccgcacgacctggcagcgctcgtgaaccatcttgaggagaagccccttctcgtacggcacgcagaccgtgatggtctggtcgcccgaggccgcctcctgggagaccctgaggaggagtccgcgaacgccgcttccctcgagcgcgctgatcatcaccgcgtccggccggagcgcctggagtcgcaccttctcctccggggagataaggtcgcacttgttgtagacgaccacggatggtatctggtcggcgccgatctgtgcgagaacctccctgacggcggcgacctcacgctcggagttggggtccgatgcgtcgaccacgttcaggatgaggtcggcggcacgaacctctgcaagggtcgacttaaacgattccacgagggtcgtggggagcttctggatgaaaccgaccgtgtccgtgagcgtgatgcgacgcccctcctccaggtccaccacgcgggtggttgggtcaagggtggcaaacagctcgtcctgaacgtagaccccggcccccgtaagcctgttgagcagcgtagacttgcccgcattggtataccccacgagcgagacgcggaacacgccggactcccaccgagctttgctcctgacctcccgcctggtctcgacctggtcgagctctttgcgcagccaggagatgcgcttgcgcaccaggcggcggtcgacctcgagctggctctcgccctggccaaacctgcttccgatgccgcccctggtctgctcgcccaccagatggctccacatgccacggagcctgggcaggacgtactgcagctgtgcgagctgtacctggagccgtccctcgtgcgtcttggcatgggtgccaaagatgtcgaggatgagtgcggtgcggtcgatgaccttcacgggctcgccgaccgccttctcaaggttggactgctgggaggggctaagctcgtcgtcgaagatcacgacgtcggcgtcgagggcgtggacgagatggaccagctcctgcaccttgccgcttcccatgaaggtgcgcggtatgggcttgtcgagccgttgggtgagctcccccaccacgacggccccgtccgtctcgaccaggcgccccaactcggccatggattcctcgagcggccagtcctcgcggccaaggtcgatgccaacgaggatcgcacgctccgggactggcttcgtcgatatgggctcgaacctagccaatgcgacctctcctctcatccagcgcacccgagagccccttgagcacgatgtccgtcgccccctggttgtcgagggcgtccatgtcgagccagcggacgcggccatcccgcttgaaccacgagatctgccgcttggcgtatcggcgcgtgcgcgccttgacaagatcgcgcgcctcgtcctcggttgaccttccgtcgaggagctccaggacctccttgtacccgattgcctgggacgcggtggtcgagcgctccaggccctccctgcgaagccccctgacctcgtcaacaaggcccgcatcgaacatgccgtccacgcgctcgtcgatgcgacggtagagccgctgccggtccatccgaagtccaaatatcagcgcgtcgtagtggctggcccttctgtggagcccgtcgtgcgtcctggcatacgagccgccctggtcgagaagctcgagggcgcgtatcacccggcgaacgttgtgcgggtgtatgaggctcgcggactcgggatcgcgacgctcgagctcgcgccacacggcgtcgccgccctcgctctcggcaagccgctcgtaccgctccctcgcctcgctgccgcgctccccggaggggaagtccatctggtcgatcacggcatcgaggtacagccccgtccccccgcacagcacgggcaccctgccctgcacaaggagggagtccacctccgcccgggcgtcacgctggaacaggcggacggagtagtcctcccccacggggcacacgtccaccatgaggagcggtcggcgcctctcccccaccggggtcttggcggtccctatgtccatcccgctatagacctgcatggcgtccgtcgagacgatgctcgtggagagcctcgtggccacctcctcggcgagcaagctcttgcccgaggcggtggggccgacgatggccagcacaagcggcctcacgctcaatgcgcctgcccaacgagaggacccctgaggtaccacgtcctggcctcgtcgaccctgacgtcgcacatcttccccacgaggtcatcgggacgagcgccctcgggaaggtcgaacaagacggtctgacccttctcggagtgcccgaccatcacgctggcgtccttcttggaggttccctccacgagggaggtgacggtcgtgtgaagctctgcctggtttgcctggtgcgcgcagtcctcgacgagcttggcgaggcggtcgaagcgctcctggatgacctcacggggtgtctcgtcctcgatctttgcggcgggagtcccgggccggcgagagtagatgaaggtgtaggcggacgagaagccgacctcccgcacgagagagagggtctgctcaaagtccttctccgtctcgcccgggaagcccacgatgatgtccgtggagagggcgatgtcgggcatagcggcgcgaaggtggtcaacgacctgcaggtagcgctcgcgggtgtagctccggttcatggccctgagcacacggtcggagccgctctggaccgccaggtgcagctggggcatcacgttgggcgtctgggccatggcggagatgacgtcgtcacccaggtccttggggttggaggacgtgaagcggatcctctccacccccgtcttgccgacggcgcgcaggagctcggggaaacgagggctcccatagaggtcacggccgtacgagttgacgttctgccccaggagcgtgatctccctcacgccgtccgagacgagcccctcgcactcctccaccacgcgctcgaacacgcggctcttctcgcgcccgcgcacgtacgggacgatgcagtaggtgcagaagttgttgcaccccgtcatgatggggacccaggcgtggaagcgctgtgcgcggtggctggggagttcggtggagaagccgcggccctcctccacggtgtcgacctctacccttcccgcgccgtcgtccagggcctcctccaggaggtcggggagagacgcgatggcactggtgccaaacacgacgtccacgttggggatgcgctccttgagcgccgccccgtcgcgctgcccgatgcagccgcccacggcgacgatgcgacggccgcccggcgccttggggagcctgaccaggttggaggcctccccatacagatgggtgtcagccttctcgcgcacgcagcaggtcatgaacacgacgatgtccgcctcggccgcggtcttgacctcgttgcagcccatgctgtcgaggaggccactcacgcgttccgagtcgtggaggttcatctggcacccaaaggtgcggacgcaataggttcttcctacgagcttggggtgggtgggcactcctacatcaactccgggctgtctgtctgcctcgtccccgactgcgggacgagcctgtgtacgtatacggcaatgcgtatggcggtgcggttctccccgttgatctcgatgtccgagaacgtgggggcacaggagatgtcgacccccgtggggatgaggaagccgcgcgcgatggcgatggccttgatcgcctggttcaccgcgccggcgccgaccgcctgcatgttgacggggacgccgtccttgaccatccccgcgatggcccccgcgaccgacgcgggggacgatttgctcgagaccttcagaaactccatggtgactccaaagcgcaagctgctgtcttggtggtgtgttggtgccatttttgagccttgggaaattctacttcgtttaccttgccttttgaagtgagagaggcacctcagtcgccctcgctcacctcgaaggtgacggtgacgcgcccccgcgaaacccgaaccttgggatcttgcgctagcgagaggtagtagcggtccgcgaggaaagagaagtcgcgctccatgatgcgcgagaactcgtcggcgtcgtcgcgggagatgcgcagccccctcctgtcgcgctgaaggtcgacctctcggggcgagtcgccagacgacttgtgcgtgaggtgcgagagggcgctccggacgggacggatctgcccgccgatgatcctgtgtgccgtgcgctcggagaggtcgatcccgacgccgctgcacaccccaaggagctcccgcgcgtcggcggcaaccgagaagcgctcgagcgccggcagctccgtgaggtcgtcgacgaacaggaggttggacccgtccaccgacggcctcacgcgacggcggatggtggcgacgatctcggacggggacccaacgtagacctcgcagacgccccgctcctcgagcgcgaactcgcagcacgccctgacgatgttgtggggaccgcgagagacgacctgctcgccgtcgtcgtccttccccagcgacggccaggtggactggtcggtcttctcgggtagggacgaggtgtccgagacgacctggatgaccgtcccccttccgggggcggagtcgacgacgcgcgccgactcgcagttctcgcgcacggagtagagtgccatgccgcgcccgtgcacgccccagcggtccatgtgcatcgactcgagctttgaggtcacgcgcgcgtcgaacacgcgctcctgcatgtcggcggggatgcccgagccgtcgtccaggatggtgacgaccctgcgctccccctcacgtgccgtggcgacgaagatgcgccgggcgccggcgtcgcgcgagttgcgcagcatctcgaccaccgcatcctcgatgcactggatgtcgtgcttggcctggcgccgctccgcctccgccacgcggaggcggacgaagccctcgcccaggttctcctcgaccctgagcgagcgctcgccccccatggcggcaacgaagtcggcgaggtctgacgacggggaggtcatgcccctacttcgcgatgtcgacggcgcgcgactccctgatcaccacgacgcgcacctggcccgggtactccatctcgtcctcgatttgcttggcgatgtcgtgggcgaggacggtcgcctcggcgtctgagaccttctcgggctcgaccatcacgtgaagctcgcgaccggcctgcatggcgtaggtgcgctcgacgccctcgtgcgcgtttgagatctcttccagcttctcgaggcgcttgatgtaggtctcggcggactcgcggcgcgccccggggcgggcggcgctgattgcgtcggcagcctgaaccaggacgtccaggaccgtgctgggctccacgtcggcgtggtgcgcctcgaccgcgtgcacgatctcgggacgctcgccgtagcggcggcacaggtcggcgccgatcacggcgtgcgggccctcgacctcgtggtcgatggccttgccgaggtcgtgcaggagtccggcgcgctttgcgggcgtggggtccagcccaagctcggaggccatgatgccgcagagctcggacacctggatggagtgctggagcacgttctgcccaaaggacgtgcggtacctcagcgcgcccagcgtcttgacgagctcggggtgcaggtcgtggatgccggcgtcgaaggccgcctgctcgccggcctcgcgaacgcgctcccccacgagcgtctcggccttcttgtacatctcctcgatgcgggcggggtgaatgcgcccgtcggcgatgaggttctcgagtgccacgcgcgcggtctcgcggcggacggggtcaaagctggagaggacgacggtctcgggcgtgtcgtcgatgacgagggagacgccggaaacctgctcgaaggttctgatgttcctgccctcgcggccgatgatcctacccttgaggtcgtcggaggggatgtggacggaggtgacggttatctcgcccgcctggtcggcggcgcagcgctggatggccgtcgagacgatctcgcgcgccgtcttgtcggcctgcgcgcgcacgcgctgctcggactcgcggaggatctgggcctcctcgcgcaccgactcggagcggacgcgatcgaggagctcctggtgcgcgtcttcgcgggagaggtcggcaatgcgctcgagctctgcgctctgccggcgcatgagctcgtccacctcgcccttcctcttgtcgatctggccctgcaggctggagagctggtgctccttgcggtcgagcgagtcgctcctgcggtcgagggactcctcgcgctgcatgatgcggttctccatctgctgcagctcgcccttgcgcttcttctcctcgttctcgctgcgctgcttgagctggaggatctgctccctggcctcgaccatggcagccttcttggtggtctcggcgtcgcgctttgcgtcgctcgtgatgcggtccgcctggctcttggcgtcctcgaccgccatgttggcctcgcgcaccttgctgttgttcttgctggtggcgtaggcgtaggcgatcgcggctccaacgatcaggcagacgagcccgattatgatctgcatttcaactcctcagatgagcgttttggtagaggttcaggagaccaccgcgccaagcgcgacggaacccgccatccgaggtatgtctcgactcatggtgaagcatgtctgcagaacaagaaacaaataacgtcggctggcatgccagcagacgagaagcaactcaaacggcctctaaatcgtatgattgattgatggaagagtcaattgcaccgggacgagcggcagaaggattctttggaccctgcacaacgtcagccttcggactcgccgcagacgaccgctcgggtcgcggcgctcgagatgtcatacgagaaccccctcccaaggaggaacctcatgcactgggcgtaggggtcctttccccggaaggacctcctcgccgcaacctcggtcgcacgctcgagctccgagcccgcctcgtccacgaactcctcgggccaccctctgacgtcttcggggtccaccccgcgtcgctccagctccagctctatgcgccgctgcccccatccagagagcaccttggaccgcgcgaacacgtgcccgtatcgcgcgtcgtccacgagccccagctccatggagcgtccgagcgtcgcctcggccacgtccctgggataccccgcccccaggagcttgcgcctgacctcgagcgatgtgtagtcgcgcctgttcacgagggccttgaccctctcgagcgagcacgttgagaggagggtggagagcctctcggtcagccgggcgtcgaccgattcgccgacacgccccgccttcctgtcacgctcgagtgccctgccaacggcaatcggaagctcgcgcgtgacggtcgagtccccgtccgcgatggagagcacggcgcgacgacgtcgaccgtatccggaggtgcccccgaaggcgctgacctcccaggggcacccgtacaggtcttcctcgaattccatgcgcagcttgccctacgcgttgtcgggggagccgttctgcgcgtccccgctcgcaatgccaacgggctcgcccacgcgctcgtcgcccagctcgaggccgcaggcgacgcggaccttatggtcgatctcgtccatgaggtcggggtttgaggcaaggaactccttggccgcctccctgccctggccgagccgctcgtcgccgtaggtgaaccaggacccggacttgtcgaccacgccgtagtcaaccgccatgtccaggatggagccctccttggagatgcccgttccgtacatgatgtcgaactccgcctgcttgaacgggggcgccaccttgttcttgacgaccttgaccctcacgcggttgccgacgatctcgccgttgcgcttgatcgagtcgatgcgccggatgtccatcctgaccgaggcgaagaacttgagcgcgcggccaccaggcgtggtctcggggttgccaaacatgacgccgatcttctcgcgcaactggttgatgaagatgcaggtggtgtttgactttgagagggaaccggcgagcttgcggagcgcctggctcatgagcctggcctggaggccgacggtggtgtccccgatctcgccctcgatctcggcacggggcacgagcgcagcgacggagtcgacgaccacgacgtcgatggcgccggacctcacgagcatgtcgcagatctcgagagcctgctcgccggtgtccggctgcgagatcaggacctcgtcgatgtccacgccaatgcgcgcggcgtatccggggtcgagcgcgtgctcggcgtcgatgaacgcgacgacgcctcccttagcctgggcctccgcgagaatctcgagcgagagggtcgtctttcccgaggactcggggccgtagatctcgacgatgcgcccacgggggacgccgccgatgccgagtgccgcgtcaagtgcgatggacccggtgggtatcgcctcgatctctaggtcgggaccgttgtccccaaacctcatgatcgagcccttgccaaacttcttctcgatctccgaggtcgtggcctcgatcatcttgtcgcgttcctcgccgtaggtcttctcgtggacctcgcgtacgggacccttgctcctagccatcttcgctccttgcctcgaatgccaagcgaatcctatacgaacatgcgttcgtggtcaagaccaggacgccatgatacaagagctgactcgcacgtccctctcgcccggctcgcacatggctgacgccggagggggaccgcaaggcagccaccctccgccatctcgcacctccccctgagccgcgcacgacgcgacccaggcaaaagccaggggaggcctacgagtcctcgattaccgcaagaacgagctcgagggcgatgcggaccgccttggcccggaccgtgcgccggtccccggagaggaggtgacactcggcgactgccctgtcaccggcgcaggccccaaaccacacggtcccgacgggcttgccgggctcggcgccggtcggtcccgcgatgccggtggtggagacggcgacgtcgctcccgaggacgcgccgggcgccggctgccatctgcgacgcgcactcgccgctgaccgccccgagagacggatcgtcgaggacctgcgagctgacccccagcacctcgtgcttcacggggatggcatagctcaccacgcccccgcggacaacggcggacgagccggggaccgatgtcagggcggcgctcacgaggccgccggtgcaggactccgcggtcccgacggtgaggctcctctcccccagcgcccgcaccacgcgggccgcaagctcccccagtccctccgggccaaggtcctccacgtcccccgcgtcctcaaaggcaagcatcactcgtcctccacgatgtacttccagccctttgcgaagtagtcgatgcccgaccaggccgtgaggatgaccgcgacgacgaggagggcgtcgaacagcatgaacatgcccgagcggagcgcgcctgcggggaacgcgccggcaaggagtatgcccgcgatcgagaccatggtggtcgcggtcttccacttgcccaggttgctcgccgcgacaacgacgcccttggttgcgatgttcatcctgaggccgctcaccaggaactcgcgcgcaacgacgatgaggagcacccaggcggacgcctcgccctgctccaggaggtagcagagcgagacgacgaccacgagcttgtcggcgatggggtcgaggaacttgccgaacgtggtcacctcgttcctgctgcgggcgagatacccgtcaagcttgtccgtgagggagagcaccatgaagaagagcgcgacggcgagtgcgggcatgctgaacgagctgccgtcacccacgccgcagacctcagccaccacgagccagatgggaacgaggcagatgcgaatgcacgtgaccacgtttgccggcgtccagattgacttccttgccactttcatacccctctcggaaccattccctagacgagctctccctcgagctcatagcagaacgaatcgaccagccgcacgcggacgacgtcgccgacgcccgcctcgccggtcctgatgtggacggcgccgtcgcagtcgggcgcctggaaccaggtgtgccccaccagctccacgccgtcatccgactcctcaacgccgtcgatgatcacgtcggcctcctcgcccacgtgcttggcggtggcggcaaaccccagctgctcggcgacgtcgagcaggcgctgggcgcggtcgagcttgtcctcctcgctcacctggtcggggaggttcgccgccttggtgccatcctcgcgggagtacgagaacaccgaggtgtagtcgaactcctcctcctggacgaagtcgagcaggcgctggaactcctcctcggtctcgcccgggaagcccacgagccccgtcgtcctgaggaccatgccggggatctgctcgcgtagtcgagcgaagagctcgcgcagctccccctccgacccgctgcgccccatgctcctcagcacgcgctcgcagcagtgctggatggggatgtcaatgtaggggagaacctcggggacgtcgcgcagcaccgagaccagctcgtcggtcatcccctcgggctggaggtacagcacgcgcacccagccgccatagggacgcacctcctcggcgacgcggcggagcagccacgcgagcgtcctgccgccgccaaggtcggagccccagatgcccgtgtcctggccgatgaggacgacctccttgacgccgccctccatgagcgtgtgcacctcctggaggatctgaccctcggggcgagagaagtacctaccccggatgtagggaattgcgcagaaggcgcagaagcggtcgcagccgtccgagatcttgacgtaggcgctcgcgccctcgatggtgcgcatcgcgcctgcaggggcgacgggccgggagtcgacgcccaggacggcgtccacgatcctgacgatgtcgtcctcctcgtcggtccgcacgagcgcggagacctcggggagctcctcgaggagctggtcgccgtagcgcgagggcacgcagccgcacatgacgatgggcttctccctgacccccgacttgacctcgtcggcgaggtcaagcgtggcgtcgatagactcggacgtggccgaagcgaggaacgagcacgtgttgacgagcaccacgtcggcgccctccacgtcctcgctctcgccgtagcccgcctcgttaaggagcgccctcatgcgatccgtgtcgacttcgttcttggcgcacccgagggtgacgtaaaggcaatttggcatgatcctacctgtagttctcgaactggaggggctgaccgtagtcgtttgcgcggagcgcggcgatgacctgctgcagggtgtcgcgcgacgcggacgataccctgagcttgtctccctcgacggtcgccttgcacttgagcttgaggtcgcgtatgtccttggagatgcgcttggcggtctccttgtcgattccctggacgagcgttgcggcctgcctgaccccgccgccgctcgacggctgcgggtcggcccacctcaggctcgcgaggtcgatgccgcgctttgcgagcttcgcggcaaggacgtccctcacctgccctgccacgaactcggacggcgcggtgagggtgaaggtgccctcccccttggagaacgagagggtggcgcccgtctgcttgaggtcgtagcgctgcgagagctctcggctcgcctgctggtaggcgttgtccgcctcctggatgtcgacagtggagaccacgtcgaagcttgattcctttgccatgtgggttcctttcgcgttgcggggatgccgccgggctagttggaggagctggcgtccgtcgaggaggacgcgtcggtgctggtgctggtgccagccgtcgtctgggccgccccgtcggccgtcgtcgcgtcggtggtcccatccgtcgtggaggtggtcgtggcggtggcgccattggaggagtctgtggaggacgcgtcggtcgaggtcacctgggtgccctggatggtgatggaaccgatgcccgaggtcttggagtcgaacttctgctgcgtcccgttcttggtgaccgtgacgacggaggggtcgctcacctggatggtgatcgagtcggtcaccacgtaggtcttctcccatgggcccgtcacctgctcggcgacctcgctcgtcccgtcacagacgatctcgacccacgacacgccgccgtcagagacgctcaccttgacgtccgtctcggtgttggccgcctcggcgtcctgctgtgccttggctgcggcagcggcggcagccgcctccttggccgcggcgatcttggagtcgttggaggcgctgtcggacgagtcgctcgaggacgccgacgccaccgagacggtcttggtggacgtctcgccggatgacatgcacgacctgacagagccgatgatgacaagcgtgatgatgaggacggcggcaagcgcgagcgttaccatggcgcgtgccgggtcggagaagaacgactccagggcgccgaggacgcccccgtggcgcgggcggcgacgcctcccccgctcgcgcagctgctccctgccggactgctggcccctgcgacgaacgttgggccgctcggtactcgcgatgttgcgcgacgagacgcgccccgtcgcggtcgaggccgcctcgtaggggctggcctcgccgtacctcatgtcgtcctggtagtcgctcggcctcacgcgccgggtggtgacccggtccgagcccctgcgcggaagctcctcgcccgacctccgcggagagccgccacgcggcgactggccgcgataccgttggcgcgccgcgccggcggagccagagctcgggacctcgcggctggtgtaacgacgctcctcgggcgggacgtccctgccagagtagctccttcggtagtcgacgagcgggctcgcctgtcccttgggtcgaggggacgacgtggtcgcgaaggacgagacgtcgcccgcatagcccccggaggtcgggagcagcccgcgcggcccgcggtacggcgtgacgggacgagacctgccgggaacctcgtacgagtccgcctcgcgcggggcgggtgccccggggacgctgcgcccgcgcctcccgccgtgctcgtagtcgtacaggtcggaggtgaactggttcacgacctgccgggagttgagccccaggtagcgggcataggacgagagcatcccctgtgcgtagccgctcttgggcatgtgctggaagtcgccctcctcgaaggcgatgagcacctgctccttgaggcgcagcaccttggaggcctgcgtgacggagaggcccagctggcgccgcctcgacaccagcatctcgctgaaccgcggacgcggcatgtgctacacctcccgatacttctcgtcctggaccctaagctcctcgaggccgtccttgtccaggagcacctcgcgcggcttggatccctcgggcggaccgacgacgccctttgcctcgagcatgtccatgatcctgcccgccctagcgtatcccaccttgagcctgcgttgcaggccggaggtggaaccgagttgagagtccacaacaatctgcgcggcctcccacaccagggggtcatactcgtccccgtcgtccgaggagccggagccgccggtctgcccggggaccacctgcgaaaggatctcctcgtggtagtccggctccgcctggtcgcggatgaagtcgacgaccgactcgatctcggggtcggagacgtagcagccgaggatgcgccgcgtcttcctccccctgaacttgaacagcatgtcgccgctgcccaggaggcgctccgcacccgtctggtcgatgatcacgcgcgagtcggtgcccgacgccacggagaaggcgatcctgttctcgatgttggatttgatgaggccggtcacgacgtcggcggagggtcgctgagtcgcaacgatgaggtggatgcctgcggcacgggcaagctgggcgatacgcacgatggacgcctcgacgtccttgcccgcgaccatcatgaggtcggagagctcgtcgatgatgacgacgaggtagggcatgggctccggggggttgtccatctcggagagcttgcccgatacgcacatctggttgtacgccttgatctcgcgggcgccggcgcgctcgaacaccttgagccttcgctccatctcggagacggcccactggagggcgctcgccgcctgccggggctcggtgaccacggggacgtaaaggtggggaagtccgttgtatccgcccagctcgacgcgcttggggtcgatcatgatgagcctgacctgcttgggcgtgcagcgcatgagaagcgacatgatgatcgagttgatcatcaccgacttgccggagcccgtcgcgccagcgatgaggaggtggggcatctttgcgaggtcggcgacgaccggctcgccctcagagtcgcgcccgatggccagctcgagcgggcctcccttggcgtagggcagcacgtctcccaggtgcacgttctccctcttcttgttggggatctcgatccccacgagcgaggtccccgggatgggggcgaatatgcgcaccgagggggtcgcgagcgtgagcgcgatgtcgtcctcaaggttcgtgatcttgttgacgcgctcgccttcgcccatctcgatgcggaaggtggtgacgagcggccccgagacgtagtccacgacccggctcttgagcccgaactcctggagcgtcgcctggagcctctgcatggtctcctgcaactcggcggtcgagctcgccgcctttgcgctcttggggttggagctgagcatggagaggggcgggagctcgtaggtctcgtcgccctcccccgggcggtgcgcgccgggcgcggccttggccctggtcaccggggacgagtccttggcagcagccgtcgcggcaacctgggagggtatgaagcccctcgccgtccccctgcgggacttgcgggaccccgacttttcgggggactcggcggcggcgcgcaggaactccggcaccgcgaggtcctctccctgcgcctcgctggcggtggcctctcccagcggaatggtcgcctgctcgggggcggtgccgtcggatgcggggcgtgccgtctccacgtcgatgtcggggtggcgcctcctgcgcaggaggcgcgtcttctggctcccctcgccctcggcgtcgtcagcctcgccgcctgcctgggctagcggggcgtccgccttgcggcgcccgcgcttcaggacggaggtcttccgcgcccccaggaaggtggtcggcgcctcggcggaggctacggccgtctcacccggctccaccgagggcgagaggcccgcgagcccctcgtcgtagggctcctcgtccgggatgtcggcggccttggactcgcgacgcgcctcgagggcgctccccgcacgctggacggcgtttgagacggagaagccggacacgatcacgcccacgaccatcaggcccacgagcacgacgtcgcccaccacctggccggtgaggttgagcagcatccaggcgatgaacccacccaggtagcccccgcgggtcacgacgtttgccgaggcgagcgcgagcgacgggtcggagctggcaagcggcgtccccatggagatgagccccaggatcgagacgacgatcagggccagccctgcggcgaccctgcccgcgatgagctccctctccctgatgaagaaggtgacgccgaagagggcgatggcgacgggcacgaggaacgcacccacgccaaagcagagcgtgaggaactcccccatcgccctggtcacgggtgcctgcgaggtgtcgagcagagacgcgcccatggccaccgcgaccacgatgagcgttacgcccaggatgtctcccccggcactgccgcgctccggcgcgatggcgcgggccgaggaagccctcgacccgcgcgccttgccgttgccacccttgttgcgctgcgacttcttgctgcgatcggcagccatttaaacctccatcaccaccgggatgaccatcggcctggtgtgagtcttgttccagaggaagttggagaggctgttgcgcgccgtcttcctgagctggtccaggttggcgccctcctgcttgacgccggaggcgatcttgtccttgacggacgcctgggcctcggagaggagctgctcgtcatcggcgaacgagacgcccctgcaggcgacctcgacgtcgcccacgcgcttgctcctgagctgaacggtgaccacgcaggtcacgattccgtcgctcgcgagcttctggcggtcgcggaacaccacggggttggcgtcggtgaccgagaggccgtcgacgtagaccacgccggagtcgacgggcttgccccagccgaccttgcccccgcgcatctcgagcgtgtcgccgttgtcggccacgaagatgtggctcggcttcatccccatggactcggcgagcttggcgtgggcgcgaaggtgcacggcctcgccgtggacgggcatgaagtagcgtggcttggtcatggccagcatgagcttgagctcctcctggctgccgtgacccgagacgtgcaccagggtgttcgacttgtcgaagatctggcacccgatcttgctgagcgcgttgatgatggactgcacgctcttctcgttgcccgggacgggcgtcgccgagatgatcacggtgtcgtccgcggtgatggtgagcgacttgtggtcgccgttcgccatgcgggcgagggcgctcatgggctccccctggctgcccgtgcagaggaccacgatcttgtcgtccgggatgtccccgatgtcgtaggcgtcgacgatgtcgttgtccgagatcttgaggtaccccagctcgcgggcgatcttggtgttggtgaccatggagcggcccgtcaccacgaccttgcgccccaccgcgacgctggcgtcgcacacctgctgcaggcggtggatgtggctcgagaacgaggccacgatgacgcgaccgggggcgttcttgatgatgtggcgcagctgggggccgacggccgactcggagggcgtgaacccgggccgggtggcgttggtggaatcggagaggagaaggtcgatcccctgcgtggcgaagcggttgatggcctggtagttgggcagcacgccatcgatgggtgtctggtcgagcttgaagtcgcccgtgtgcaggaccgagcccgccggggtgcgcatgtagacgcccagggccgcagggatggagtgcgtcatcgagaagaagtcgatgctgaacgcgcccaggttgaggtgactcccgttcttgacctcgcggaacttgggggagttgatcttgtgctcggcgagcttgccctcgatgatccccagggtgagcttgctggagtacacggggaccttgcgccccaggtccatgaggaggtacggcagggcgccggtgtggtcctcgtggccgtgcgtgatgatgatgccgcggagcttctcctcgttctcgagcacataggtgtagtccggcaggatcaggtcgacgccgggctgctcgtcatcggggaacatgagaccggcgtccaccaggaccatgtcgtcctggtactcgaacgcggtcatgtttttgccaattccgtccaggccacccaggggaatgatcctcagggggctttgcttctttaccatgctttcgtgattcctttcgaatggtgcctatgccctaggcaggacttgctatctcatcgcccgtcgctcgcacggtgcgggcaaaaacgtttcatccgatacattttaaccgcaatgcaccgctctcattcgcctgtgagcatccccgaagaaaacccacgcatgggcagaaggcgcccaaacagaagaggcggacccggtgcgatcgcgccgggtccgcctcgaactatctcgccctacttgctacgcgtcgtggtgacggcggggacggggcttgtcgccacccgcgttgccgtggtcgccgggatgacggccgacgcgcctctcacgagacttgccctcgtgctcgcggcccttgccgctgccagagggggcctcgggcttgtcgatcctgtcgaggctgatcttgcccttctcgtcgacctcgaggaccttgaccttgacctcgtcgccgatgttgagcacgtcctcgaccttctcaacgcggcccttggcgacgcgggagatgtgcagcaggccgtccttgccgggaagcagctccacgaaggcgccaaagggctggatgcccacgacgcgaccggtgtactcctcgccgacctcggggaccttgacgatggccttgatgcgctcggcggcctcctccgcggcaccgttggtgccggcgatgaagacgttgccgtcctcctggatgtcgatcgtggcgccggtgtcgtcctggatgccgcggatgaccttgccgccgctgccgatgacgtcgcggatcttgtccgtggggatctgcaggctgacgatctggggcgcggtgtccttggtgtgctcgcgcggcgcggggatggcctcgagcatggcgtcgaggatgaacatgcggccctcgtgagcctgcatgagcgccttgcgaaggatctcgggcgtgaggccggtggccttgttgtccatctgcatggcggtgatgcccttggtggtgcccgtcaccttgaagtccatgtcgcccaggaagtcctcgaggccctggatgtcagtgaggatgacggtcttgccttcctcctggatgaggcccatggccacgccagagacgggacgcttgaggggcacgccggcgtccatcagcgccagcgtggagccgcaggtggaggccatggacgaggacccgttggactccatgacgtcggagaccacgcggatggtgtaggggaaatcctcctcggagggaatcaccgggagcagggcgcgctcggcgaggttgccgtggccgatctccctgcgcttgggggagcccatcctgccggtctcgccggtgcagtagggcgggaagttgtagtggtggatgtagcgcttgccgtcgacgggctcgatggtgtcgaggcgctgccactcgttgagcatgcccagggtgcagaccgagaggacctgggtctggccgcgctggaacaggccggagccgtggacgagcgggaggtagttgggcttgatcatgagggggcggacctcggtggcggtgcgcccgtcaacgcgctcgcccgtctcgaccaccatgcggcgcatggcgtgcttctccaggctcttcagctccacggggatggcgcggtcccactcggcctgctcgtcctcgctgaactcggcggtgatggcctccttcagcgcctcgaccttggagatgcgggactgcttgtcggcatccttgagggcggcagacatctcgtcgtagtgagcccagatgcggtcgtggacctcggggatgggctggtcgagctcgtactccctcttgacgatggggccgttggcctcctcccacttggcgaagaacttcatctcctcctcgcagaaggcgccgatcgcctcctggccaaaggccatggcggcgagcatgtcctcctcggagatctccttggcgcccgcctcgagcatgctgatgaaggtggacgagcccgcgagctcgaggtcgaggtcggaggcgtcacgctcctcgtaggtggggttgacgaggaactcgccggtctcggggttgcggccgatcctcacgcaggcgagcggcccctcgaagggcacgccgcccacggtgagggcgacgctcgcgcccatgacgcagatggtgtcgacggagttgacctggtcggcgacgagcggcatggccacgatctggacctcgttgcggaagccgtcggggaacgaggggcggatgggcctgtcgatcatgcgggccgtgagggtcgccttctcggagggacgcgcctctcgcttgaggtagccgcccgggatgcggcccacggcgtacatgcgctcgatgtagtcgaccgtgagcgggaagaagtcgtagttcttgcgctccttggagaccaccacggtgacgttgaccgtggagtcaccgcaggagacgaggcactcccccgtcgcctgctttgcgagctcgcccgactccagcttgtagtgcttgccatagaggtcgaactcgtgcgaaacctttgccatttcttttcctcttatctccgcctgccccattgcaggcgggccgctaatgcaagggagcgcccgcgggcgccccctctctaccacgaagctactggatgttgtcgcggatgcccaggctcttgatcagcgctcggtaggcctcgatgtcctgcttcttgatgtaggacaggaggcggcgacgctggccgaccagcatgaggaggccgcgacgggtgtggaagtccttcttgtgggacttcatgtgctcggtcaggcccttgatgcgctcagtgaggagggcgacctggaccgcggcggagccggagtcgtttgcgtccttgccgtactgagcgatgagctcggccttgcgctccttggagactgccatgtgaaaccacctttcgacatagatacgccccgaactgggatggccgtctggcattgggcgggcctccaagtacggggtacgaacggagttagggtaccacgccacggcccgctgggtggcaggctggcccgcaaagcccgccctccacaggattcgcccattttttcgcgggcgtgctcacacgaacaggcggccgatgccgcggacggtccagcgccacatgctgtcgtactccacctggggcgggtaggcgttgatgatggtgtcgttgcccacgtagattcccacgtgccccttgtagaacacgatgtcgcccgcgcgacggtccgagatggcgaccttcttgatcttggggtccgcgaacatgttgttggcgttgtggtcctgccacgagtcgtagcgatgggcgtaggagttgtacggggtctgcatccccaccgactccatgcacgactggacgagcccggcgcagtcggtccccacgcccggggcgagggcgtagtcccacttgtagggcgtccccaggtagagcctggccgtctggaggaacgcctgcaccacctggtcacgggtggcgtcgggcgagatgaccgagtggcggatgtacgagaatggcccgctccccaccttccgcacgtcgtaggcggagacctggtagtactggctggggttctgccatccgatcttgccggtcgagagcttggagaggtgcccgccggcgtcgccgtagtaccaggcgcccgcgatcttgacgcaaccgttggtcacgacgtagccggtcgacggcaccccgtagtactggctgccaccctgggtgaagaggccgttttgcgcgaccccgtaccccctcccggtgtccacgacccggtagcggcggtagtcccccgtgtacgtggtggtgaccatccaccccgccgggctagtgcagagcctgccgtttgactcggcgagcagggtcgttccgttgcccaggtccgtcacggcgtggtagacggcaccgtcggcggccgccagcgcatagtagccggaaccctcgtcgggggtgatcacgcgggaggtcgcgagggcggcgtccgcgccgacccagtagcgctggagcgacccgtaggcgcgggtgaccgtccagaacccctggatcgcctggtgcgcggagcgggtcccaaaccacgagaccccctcggcacgccaccccaggccaacgaggtggtcgttctcgcccttgctcgcggtgaagttgtgggcgcccgccttggcgttggggttgtactgccggtagagggggacctcgctggcgtcggccgagtaccagccgatgccctcgtacctccaccccgccctcaccagcatgtcgcgctccgcggcgctggtggtgtagtggtggtcgccggcgttggggttgtacaggcggtacaccggcgcatcggagctggcgggcgccatccacgcgatgccctcccagcgccagcccacgccaaagagcatgcgggcctctcccagctgcgcggtgtagaagtgctcgccgctgttggggttgtacatgcggtacatgttggcgtcgggcgccttgggctgcgccgagcgggccgcctgtccgtctgccgccccctgggacggggcgacgtccgcctgcgagccatcgacggtgtcagcgccctgctgtgacgcggacgtctgggcgttgccctcggctgcctcatcgccggacgtggcttcgtctgccccttgggcggagggttggtctgtctcgccggcagagcctgcctgctgtcccgaggcgctgccgtctgcggatgcgacatcaccaggcgagacggcctgctgtcccgtgccctcgtcggtctgggcgcccgattcgccgggcgagacgcgcgcgatgccgggctcgccggccccctccgctggcgtcccctgcgtcccgaccccgggcccctcctccgaaggggcgggcttctcccccgccggttcgcatggctccgcggcagcggccgcctggccctccgcctgggaggcgacgacggcctccggtgcgtccgcggcgacggcctcctcggcgagcgccgcagccggcgcagcccccagcgtcgcgatcacggaggcccccgtgacccacgcagcaacatgcatcctgtcaagtcccatgcgacacccctgcccttggagatggttcagcatggttgaatgtagcccaaatgaagcctcacgaagcggcgcgtggcaaggtcatccgctaacgcacatgacgagccgccgattgcggtccgccgcagccccctcagagggcgagcatgaactcgagcgcccgcatgcgggcgtcgagctgggtcaccgcccacaggtgcgcgagcgagagcagccgacccgcctcgcccggccccacgcccatccccaggatctggtcgaatgtgccgtgcacgagggcgtcaaggtcccgcagctcggcggggctcacccgcaccgcgcccgcgacgtccttggcacagctcgcgcagagggcccctccggcggtggcggagaagcgcgacacgtcggggtcgccgcaggcaacgcacgcatgcagttcgggcatccacccctcgtgggcgagcaccttgaggacgtacgccgcgaccacgaggtcgagggactcctccgagcccgcctgctcgcaggcggtcagcgcgcgcgagcagatggggtacagaaatgggtcggggctgtcctcgaaggaggtgaggcgggccgcctcgcagagtgccgaggcggcagcgacccgcgacacgtcgccgcgaagccccacgtgggcgttcacgagctcggcctcggtgacaatgtccaggctcctgccccgggccaggaggaagtccgtctcgcagaagaggtcgctcctcggcgcgagcctgcccccgggcttccgggcacccttcgcgaccgccctcagctgctccccacccagcccgagcagggtgaggatgaggtcctgctcgcccagcttggtgcggtcgaggacgatcgcgcgctccctcagggtcctgcgggccatggggctactcgtccgcctcgtaccccaggcgccggatctcgttggcgtcgcgcctccactggggctgcacacgcacctgcaggtccaggtagcagcgcgcccccaggagcttctcgacgtcgcggcgggcctcggagccgatgcgcttgaccatgcggccgcccttcccgatgaccatggccttctgcccctcgcgctccacgaggatggtcgccgagacggaggcgtgcccgtcctccatccactcgatctggtcgcaggtgacggcaacggagtgcggcacctcctgcctcatgttgagcaggaccttctcgcggatgaactcggccaccagctcctcgtcggtcatgtccacgtccatgtcgtccgggaaccagcggggtccctcggggaggtggctcgagacgagcgatatgaacgagtccacgttgaagcccttgcgggccgagaccacgagcgagtcgtcaaagcgggcgaggcaggaggcggccgcgagctgcgcgctcaccgtcttggggtcggcgacgtcggccttggtgacgacgaggagcttgtagggcgcgtgcgaggcgtccacgtgccgcgcgacccactcgtcgccgcggccgacctccttggtggcgtcgatgaggagggcgaccacgtccacgtcggcgagctcgcccagcgcgaccttgttgagctccttgcccagggcgtccttgggcttgtggagccccggggtgtcgacgatcacgatctgggcgccctcgcggttgaccacggcgcgcatcctgcggcgcgtggtctgcgccacggggctggtgatggcgatcttgccgccgtagcacgcgttgaggagcgtcgacttgccgacgctcggccgcccgaccagcgcgacgaacccgctcctgaagggcctttcctctcccccggcgacctctgccatgactcccccactccccgctggccacacggtcagcgcacgatcgcgtttgcaaagacgatgatgccgaccactgccaccagcacgcagaggacccacacggcggcggcggagatgtccttcgccttgcccgcgaggggatggaactccggcgagaccaggtcgacgacggcctcgatggaggtgttgaggagctcggcagagatcacgaccccgcagcacagcaggatgatggcccagctctcggcatcgagcccgatggcgaggccgagcgtgatcgcgaggcagccgcccgcgagcatgaccttgatgttgcgctcctgccgcaccgccgtgcggaagccctggatggcgaagaggaagctccgcctgaaggtggggtggctcgggtgcttcccggggatcatgacgcgtcatccccgcgatgccgggtcagggtcacgtgcgagaggggcgcgtcggtgcgtaggagcgagaccagctcgtcctcgcgcgcctccatcgcctgggcctcgtcgtcgtccaggtggtcgtaccccagcaggtggagcatcgcgtggaccaggaggagcctgaactcgtcggcggccgtagtcccaaacccctccgcctggcgcgcgatgtacgccggtgcgagcacgatgtcgccgagctcgcagggctcgcccggtgccaggtcggggtcgtcgggcctttcgcactccaggctcaggacgtccgtgcagcggtcctggcccctccactccccgttaagctcgcgcatgcgcccgtcgcccaccacggagatggagaccatgcagtccctctggacgccctcctccctcagcacgaggtcgcagtcgtccctgacctcctggagggtgatgggagcctcggccccctcgtcgcacgagacgtcgtactggttactcatgtgagctcccgcccttccttcccgcacctgcgccggcctccgcccgcgcgtacgcgtcgacgatgcgcgcgacgagggagtgcctgacgatgtcgttcctgtcgagctcaacgaaccggatcccctcgatgccctcgaggacgcgcctggccgagtccagcccgctcgcgcccaccaggtcgcgctgcgtcgtgtctcccgtgatcacgaagcgcgacgagtggccaaacctggtgaggaacatcttcatctgctccggggtggtgttctgcgcctcgtcgaggatgacgaaggcgtcgttgagcgtccgcccgcgcatgaatgcgagcggcgccacctcgatgaccccctgctctatgagcgaggtcccgcgctcggggtcggtgatgtcgaagagggcgtcgtagaggggccgcacgtaggggtcgaccttctcctggagcgtgcccgggaggtatcccagcgactcccccgcctccaccaccggacgcgtgagcacgatcctgcccacctcgtgccggcgcagggcggcgaccgccatggccatggcgaggtaggtcttgcccgttccggcggggcccagcccaaaggtcatgaggttgtccctcatcgaggcgacgtacctcgcctggccctcggtcttgggccgcacgggtcgcccgcgataggtgaggaggatctcgccgggttcggagcccgggccctcggccccgtgctgcgcctggcccaccagcaggctgacgtcgtcggtggtgggcacctcgcccgcctcgaccatcgagatcaggcgggagaagaccgaggtcacgcgctcgacctcccgtgttgggccgatgatcgtgacctgcgtgcccctgacggtgaccatggagtctgcgaacgagtcctcgacctgccgcagcagcgagtcggcgggccccatcagcacggtggggtccacggaatcgggaatggtcaggcgaacgcgggtgggctccatgttcctccagtgcggacgtgtggtcgaatgtcgtgcgaatctaggatagatgaacgggcggccgggcgagaggcgcgacctacgcgggagaccccacgagcctcccctgggcgtccacggactcgacccgcaccctcaccatggagtcgagcgggagggaccggtcgacgagcgcctcgaacagccccccggtcacggccctccccgggtactgcacgatggcggactggaccgtccccacgagggagcgcgcggcgtcgagcctcatctcgcgcgcggcgtcgcgcatgcgcctgccccgctcggccatcacctgcggggggacctggtcgggataggtcgccgcgggcgtgccgggacgccgcgagtacctgaagacgtgcatctttgcaaacgccatccgacggcagaatgccagggactcctcgaagtccgcgtccgtctcgcccggaaaccccacgatgaggtcggtccccagggccaggtcgggaatgccctcccgcgccacctcgatcgcgcgggcgtaggcggcggtgccgtacacgcggcccatgcgagagagcgttcggtcgcagcccgactggaggcacacgtgcaggaacggggcgacacgcacccctcccgcccgcatcgccgagacgaggcggggcgtgacgtcgggaggctcgatggacgagaggcgaatgcgctcgacgtccgtcttggcgaggatggactggaggagaccggcgaggtcgacggacttgccgtcctcgccctcgcacgagtaccgacccaggttgatgcccgtgaggacgacctcgtgagcgccctgggacacggactcccgcacgcgcctgacgacctcctcggggctcgtggagaccccggcgccgcgcgccttccacacgatgcagtaggtgcagcggttgtcgcagccgtcctgcaccttgatgccgggccgcatgcggccggtgggcgtgggggtggcgtagtctccgtggcccccgtccgacaccggggcaaggcccagggacgagaggacctccgccgccacccgcgctttggccgagacgacgcgcacgttgggcccgagcgcctcgagctcgcttgcggcgaggcacgcgacgcagcccgtcgcgacgacgtcggggcgctgcgggagggcggcggcgtgacggacggccttgcgcgccttcgcctccgcctcgcccgtcaccgcgcaggtgttgacgacgacggcggacgcgtcctcctgcggcacgagctcgcagcccgccgccaggaggtcctgggcgatgaggtcggtctcgacgcggttgacgcggcaccccaggttgaccagggcgacgcggggcgtactcacttggcccgccagcggcccttgcggccgtgatgggggaagccctgcgcgcgcctctcccccgcatggggctcgccctcggcggagcgaccctccacgatggagcggacctgctcgagctggggctcggtgagattctcgggggtcttgacctgcacgaccgcgatgaggctgcctcgcgcggaggagttcatgcggggcatgccgtgtccggcgactcggacctgctggccaaactggcaacctgcgggaacggtcaccctgaccctctcgccctccaggatcccgtcaaccgtgacgtccttgcccacgatggcctcgagggagtcgacctcgaccttgcagaagaggtcgtcgccctgccgctcgaaccgctcgtcctcctccacgtccacgcgcacgacgaggtcgccggtgtggtcgccgcggatgcccgcctcgcccttgccgcgaacggtgaccgtctggcccgagtggacgcccgccgggatcttgacctcgaccgtctccctggagggggtgcgaccctggccctcgcaggtctcgcacggcttgtcaacgaccttgccggagccgccgcactggggacacacgccctgcgactgcatctggccgaagatcgtctgctgcacctggacaacgacgcccttgccgtggcagcgggggcaggtcttctcgctcccgccctcggccacgcccgtgccgttgcagtcgtcgcacggggctaggcgctcgtacgagatcgtcttggtacatcccgcggcggcctcggcgagcgagatctggagcctggcggccatgtcgcggccgcgcgtctgcgtggccgtcctggagccgccgcgcccgccgccgaagaacgagtcgaagatgtcgttgatcccgaagccgccgccgaagatgtccgacatgtccacgaagtcggaccccatgccgccggggccgtcaggcgtcccgtaccggtcgtagttggcgcgcttgcgctcgtccgagaggacggtgtaggcctcgttgacctccttgaagcgctcctctgcgtccggcgccttgttgacgtcggggtgaagggtgcgtgccttcttgaggaacgccctcttgatggtcttggcgtcggcgtcgtgctcgacgccgaggatctcgtaatagtccaacgaagccaacctaaccagtctcccgctttcagcctagtttcctaccgttgcaatcagcctgagacatacccgtaccccgggcccccgaacgatgcccgcccggcggtgcacgagaacatcatcgccatgaacagcgcgaggatgagtccctcgacggcgccgttgcccagcgaggcgagcgcgttcctccaccacctgcctgagtgcctgaccccaccggcaagggcgaagtagaggcccaggccaaggacgatgacgaggaagatcgccatcgacgcgagagttcccgtgaccgctccgaggacggcgaacgggaggccaaagcccacgaggcggaagccggaggcctgctgcctggtcagccgctccgaggggacgccgacgcggcagacgaagtcgcccgcctcgcgcccgttggtgcccgcgttgcccatgcctttgaccctgaccacgtcgccgtcgtgcgagcccgcggggatgtcaaccacgagctccgtcgccgtgaggacgcgccctgagccgccgcacacgtcgcaggggtccgagacgaccttgcccgtcccctcgcactcggggcactccatctccatgacgccgagcccgaagatgccggagaggtccacgccgatccgcccggtgccgtggcacgtggggcaggtctcggcgtgctcggcgcggactgacccgcgcccctcgcaggcctcgcagggggcgtagcgctggtaggtgacgcccctgcgggtgcccttgcgcgcggtctcgtcgtctatgtccacctgaaagctgacgtcggcacccgcgcgcgggttgtagctcctcgacttgcgctccgagcgcctgccgtaccccatgtcggagaacgggaacccccagccaaagggcgatgacgagaacgggtcgccctgggcggcacccccctggtacgagcccggggcggagaaggccgagccggacctcatggcatcgtacctgcgccgcttgtcggggtcggagagaacggcgtacgcctccgacaccgccttgaactgctcctccgcatccggcgccttgttgacgtcggggtggagcttgcgagccttcgactgaaacgccttgcggatctcgtccgtcgaggcgtccttgtccacgccgaggatggcgtagtagtccttctcgttcatcgaggccataggcggggtctcccgaggttcgtggtttgatgccgtggggggcatccgtgcggcgtgggggcacggaggccggttgggacggcgtcccatggcgccgcggacgggtcggtatgccctagcacgttcgagtgtcgattgtaccctcggcgagtccccacaattcaccgtaaagctcgttgcccataagccatccgcgatgcgtggggacgagcctgccgccctcgagggaggcgagaccctcctcgcacacgcgggagacggctgcgtctacctgaggggcgggtgccacctccctcgcgagccccaggaggccgtcgggaatccccgaggcgaggcgcgcggaaagcatgaggtcctcggctaccgcctgcctgaggtccaggaactccacggaaagccgaagcgaggcgagggaggggtccgcgacgatctgccgcgccgtgctcaggacggtgacgcgcgcccgcgcgacgtcgtcccctggggcgggaagctgcggggccacccttccgagggcgaggtacccctcgcggctgagcatgcccgcggcgcccgtgcccagccccaggtagggagcccccgtccagtacgagacgttgtggatgcactcctggccgggcgcggcatagctcgcgacctcgtagcggcgaaggccgctgcgtgtgagagcggcctctgcggcctccatgcggtccgcctgtacgtctggcgcgttgaacttgggggcagcgtccccgtacctccgccagaacgccgtcccctcctcgatggagaggggatacacgctcacgtgcgacaccccgcacgagagcacgtcgcgcaggctcccctcccacgactcgggactctgccgaggcgtcgcgcacatgaggtcgcacgagaccctgagccccgcggcgaccgcctcgcggagcgccccgagcgcgcgctcgggcccatggatgcgccccagcgccgcaagctcgggggcggaggtgctctgcacgcccaccgagacgcgcgtcgcccccgcctcccgcacccgccccaggaggtcgggcgagagggagtccgggttggcctcgaaggtcagctccgcctgcgcgtggggggcgaccgcccgcacgaggggcgggagagcggcccccaggagcgacggagtcccgccccccaggtagccggtgccgcaggggtcgaggaggcccgtctcccccacctcgcggacctgcctggcgatggcgcgcgcgtacgccgcgggcagcgggtcgtcggccctcgtggcgcttgaggcgaagtcgcagtaggcgcacttgctccgacagaacgggacgtggacgtagagggagctgacgcccctcaggtggtacctagcccggtcccaggcgggggcgaatgcccccgtggcctcgtcaggcacgctcgtctccctccaccagcgcgagcgcctcgcgcgccagggcgacgtagtcgtcgagcgtcacgcagtgcatggcccggtcgcgccaggcggaggcgtggggggcgccacggaggtaccacccggcgaggctccgcgcgcgcgcaaggtgcgccccggtggcggcgagcaggcgcacgtgcagctcgaaggcatggatcctggttgcgatcccgggcgtgtgccactctcccccgccgagcagcgtccgggcaccccgaaacgcccaggggtcgccgtagctcccgcgcgctaccatgaccgccgcggcgcccgtctgctccagcatgcgggcggcctcccgcggccctcggacgtcacccgagccgatgacggggacgtcgaccgcccgtgccacgcgcgagacgacgccccagtccgcctcgccccggtacagctgggcggcggtcctgccgtggacggcgaccgcgctgactcccgcctgctccagggcgcgggcgaactccggggcgacctcctccccggcgcgcctccccctgcggatcttgcaggtgacgggcacgtcggtctctgccagcaccgaccggacgatgtccgcggcgagggcggggtcgtccaggagcgcggagccctcgcccttccgggtcaccttgggcacgggacaggccatgttgacgtcgatgagcgcgagcctgtctcccaggcgctcgctgacctgcgcggacgcctcgcgaaactgctccggcctggagccaaacagctgcaccgcgatgtccggctccgcgtctcccggaagcaccaggtcccaggtcttctcgcccgcgtagtggatccccgcgaccgagaccatctcggtgtaggcgagcgcggctccccccgccctcgccatgacgcgatacgcggagtcagtgacgcccgccatgggggccatgaggaacgggttcgccgagagcctctccctcaggctccccgccctggggaagggctcggtcctgggcgagaggtgcgcggcttttgcatacctcgccagcagctccgactcgctcccggtgacgacgcgctcgtcagtcgccattgttcccgccccctccggacgtcgtccccttggcggcgaagtactcctggagtgtggcggtgaccttgtcctggtccgcctggctcaggggctcgatctgacccgttgcggtggagcgcatggtgccctcctgccagaacgtggtctcgaggaacttggaggagtccttcttgaggaagagcgagctccccaggaagtagttgggggccgagacgtccaggtagtcgagaagcgtcggggccaggtcgagcgagttgcgcccctgggcgtcgacctgctgggcagtgacgcccttgtagtagatgaagaacgggaccctgtcgaggctcccgaatgccctctggtagtcggggaacgcctggttccaccccatgtcgacgtagctggcgtggtcggccgtgaagacgacgatggtgttgtccgccaggtcggagttctcgaactcgctcatgaactggccaaaccagtagtcggcgttgtagaacttgttgagctccgggtcggagccgtcgccgaacttcttgtccggcgagtcgaacgtggcgtgcgtccccaccgtgtacatcgcgatgaagaagggcttgcccgaccctccctgctcctccatggtcttgaggaggtactcgtaggcctggcggtcggaaagcgactgggcgcccccctccgggttcacgccctcctccgagatgacctggtcgaacccaaggtcgttgagatagccggtgaagtcggagttgttgggctccacgttgatgaacgtggtctggtacccgctgagcccgagaatcccctggagcgagacgtagttgctcgtgtccaggttgcccagctgctcgcccgagaagaactgtccctgcagcccacggtaggtcgcgaaggtgtggttgtagtagttggtgaagtcgagggacctctgctcgtacgcggcgacgttgggcatgagggagcggggatcctcgaccacgctctgcgagaggccctcggtgaagatcagcacgacgttgggggtctgccccagcgcctgggcctcggcgggcttgtcgatgccgctctggaccccgtcgtgatagaacttgccggcgtcgccgtgaccgctcttcacgttctccgcgaaggcggcgttgcgctgggtctcctggagcacgagggggtacgacacgagcggcgagtagtcccacccaacggaggcgcccgcaaagcaccatgccaccacggcggctccgagcacggcgtagtcggcgacgccccgcctgcccacgcccctcgtgcggaggaaggtcaggagcacgagggcgacgatgccgatggcgtagagcgacgcacccccctggatgtcctcgatgctgcccaggttggacagcatgatggcactcacgtacgtgccgccaaagagaagcacgagctgctggatgttgaagagggcgagcagaatgcccttgatcaaccccgcggcccggggcaggcgcttgaccaggaggttggtggccgcccacagcaggaggagctcgacgagcgacatccaggcgtagcgcgggtcgtgcgagacgcgctgcgcgagggcgatcaggacgacggggaacccgtaggtgatgatggtcgtgaggtacccgcccgcggcattgtggagtgccgtgcgaaaccttgccaggggagacgggcgcctctccggctcggggggcaggcccaccggcagctcggcgacgtccaggggaggcaggtcgttgtcccagtcctcgtcgtcgaaggcgtcccggggggagagggtcgtcgcctcgtccccggcggcatcctccgcggcggcggcatcgcccgcctcgccagccctgtcctgcggggactccgcctggtcgtcaccctcgtcaggcgaagggccctcctgtggggggaagtgcgccccgacccggtcctcgggtccgcacttctcggaggggtcgtccgtctcccccagtccctccgggcgcgccccctcctgggacaggtcgtgcctctcgtcgtcttgcagcatgctcacctcaaacttcgagggcgcgccgccttcgcgacgcacccgtgttcccgcttcctgcctgtgatgtttcgcgccctagtcgtcgtccaccttgaggaccgcgaggaacgcctcctgggggacctcgacgcgcccgatcgacttcatgcgcttcttgccctccttctgcttctcgaggagcttcctctttcggctgatgtcaccgccatagcactttgccaggacgtccttgcggcgggcgcgcacggtggagcgcgagatgatcttgttgccaatcgctccctggatgggcacctcgaagagctgttgggggatgatctccttcagcttgtcgcagaggcctcgggccatgtcgtaggccttgtccctgtggacgatgaacgacagggcgtccacctcctcgcccgcgaggaggatgtccaggcgaacgaggtcggaggccctgtagtccgagaactcgtagtcgagcgaggcgtaccccttcgtgcggctcttgagctggtcgaagaagtccaggatcagctcggcgagggggatgtcaaagtgcatctcgaccgaccgctcgctgaggtagaccatgtccttggtctctcccctgtggtccaccacaagctgcatgacggcacccatgaagtcaggcggcacgatgaccttggccttgaggtagggctcctcgatgtggtcgatcctcgtgacgtccgggaggtcctgggggctggtgatctgcagcatcgtgccatcggtgcagtacacgtgatagttgaccgagggcgacgtggcgatgaggtcgagcgagaactcgcgctccaggcgctccttcacgacctccatgtggagaagcccgaggaagcccactcggaagccaaaccccagggcgacggacgtctcgggctcccacgtgagcgacgggtcgttgacgtggagcttctcgagggcgtcgcggaggttctcgtactgcttgttgtcgatggggaagaggcccgtgaacaccatcggctttgcctcgtggtacccggggcaggcctcggcgcagggccgctcgtcctcggtgatggtgtcgcccgtcttgacgaggccgggctccttgagccccgtgaccacgtagcccacctcgcccacgcccaggacgtcgacgggggtctcgagcgggcgcttgactcccacgccgtcgcacaggaaggtgtcgcccagcgccatcatgcgaaggcgggcgccggggcgtatctgaccgtcgaacacgcgcacggtggctatgatcccgcggtactcgtcaaagtacgaatcgaggataagggccttgagcggcgcgtcggcgtcgccgctgggaggagagacgaggtagacgatggcttccaagaggtcgtggatcccctcccccgtcttgccggacacgagcacgctgtcctccgcgggaatggcgagctcctcctcgatctcgtgcttgacctcctcgggatgcgccgaggggaggtcgatcttgttgatcgccgggacgatgtccaggcctgcgttcatggcgaggttggcgttgctgaccgtctgtgcctcgaccccctgggtggcgtccaccacgaggaccgcgccctcgcaggccgcgagcgagcgcgagacctcgtaggtgaagtccacgtggcccggtgtgtcgatgaggttgaagtcgtagtcctgcccgtcgtccgccgtgtaggtcacgcggaccgcgttggacttgatggtgattcccctctcgcgctcgatgtccatggagtctagcatctggctctcgaggtcgcgctcctcgaccgtgtgggtcagctcgaggatgcggtccgagatggtggacttgccgtggtcgatgtgcgcaacgatggagaagttgcgtatgtgtgaggtgtctgtcgttttcataggcgtcataataccgcagccgcgacgtttggatggcgttgcccccatccgtgcgggcacgatgcgtcccaaccgtgggagagacctggaaaatcacacaaaggtcatgtgcgtgggcgcacgctctgttatacttcgccaatggacctcgccgtgtcgggctcgggaccccactcccccgcctaaattccttcagaggcctcatggatcagaaccgaaaggaaccgtaagtggctaacatcaagtctcagaagaagcgtatcatcaccgcggagaaggcccgcgtccgcaacagggcagtccgctccgagctcaagaccgccgtcaagaaggtccgcgttgccgtggccaacggcgatgccgagctcgctcaggccgaggccaacaaggctggccgtctgctcgacaaggctgccgccaagggcatcatccacaagaaccaggcggctcagcgcaagagcggcgtgcagaagctggtcaacaccatcaagtagcccgcactcacgagcgactttgcaggggcaccccacggggtgcccctttttttgttcctcgcgcgaggtggggaggccacccacgcagacggtgccccggggcgaaacccctagcgccgtccaccaccgcagacgtccaccacgagtgacgtgaacgcgatgcgcgggtcggagccccccttgagcgccctctcacacgccgcgcagcgcctgatggcgtcctcgagctcccccggcgcaaacccgcggacccagcgcacgtggttcttgacctgccacgactgcttgtgaagctcagaggcgacctgggagccctccccacgcgcgtcgaggctgcgggcgcacacgagctctcggagcctccccgtgaggagcgagaggagcgcgatctcggaggcaccggtcatgagctggtacagcgagagcgccttgccacagtcccgcgcgcagacgctgtcgaggaagtcccagggcttgacctccgcggtgcgtgcgacgtttgcctcgacgtccgcgagcccgatctgcccggagcccctgcagaggtctgccagcgtcctcacctggcggtcgagcatggtcgttgactctcccacccgcgagatgagctccgtggccgccgcctccgtcatacccgccccgtagtgcgccgccatgcgcacgacggtcttggggagctcccagcgcttcttgggggcgcagtcgatgaccgagtgcggaccgacctttgccaccgccttgtagagcctggtcgacttggcgagggacgccgcgtccaggaggaggacgcaaccggggttggggttgcccaggtaggcgatgatcgcctccgagaccggcttgggcaggcgctccgcaccgtggatcaacaccaggcggaagccgtcccccaccggtatggtgttgagggaggtcacgaggtcgcccggctgcatgtccgcgttcgcctcgcgctcgtccaggttgaaggcggcaagcccgggcgagaggtgtgccttcatgcgcgacacggccgtctcgcgcttgagctcgtccccacccaccgccagataggcgggcagcagcccggaggccccctgtcctctcgcctgagtcatgcgtctcccctctgtcgtccccacccatcgtagcgcaagcctctcgcagcccggtgcctccgagggaaccaccgcgccgcgagacggacacccttgggccgagcgcccccggcacaaccgtaaccgtgccgacgtccttggtgcagaggaacgtcgccccggtggcccggcagacggagacgcactcgggcgatgggtgcccgtactcgttgccctcccccgcgctggcgacgcaggcggtgggtcgcaggcgtcgggcaaggggctcgtcgagcgactccttggagccatggtgccccagcttgaggacgtcgaccgggccgacgcccgcggcctcggcagcgcgcgcgacctcctcgcgctccgcatcgcccgtgagaagcgccgagaggctgcgcccgcgatcggagtacgcgaggcgcagcaccacggagtcctcgttctcgctcccgtcgcgaggcccgtccggccagatcgccccaagctcgaacctcccgacgcgcagggtgtctcccctgaggatctcgcaacagccgcctcccgtcagcagcctggcggcatcgcccaactcgctcggtacgttggccgacgcgccctcccccacgagcacggagcccaccgagacgccacccaccagcgactggaggccaccgtagtggtcgtcgtgcaggtgcgtgaccaccaccgcgtcgagcctcctcacgttgagcctggcgagctcccgggcacaggagtcgtccgcgggaccggcgtccaccaggatggcggacctgccgtcctgcaccaggatggcgtccccctgcccgacgtcgaggacgcacaggcgcgggccctggagcacgccggcgcagagggtgaggacgagcgggatgccgagcgcgagcgcgagcagtaagcggagggtacgccgtctgggccgcggccaggcaaccaggacgagggcgggagggaccagcgcgacgaggaatccccatggcccaccgggcagggggcgcgacgcccagggaaggcccgcaagcgccgagaggaccgacccgaacgcgcctcccaggaggtcgagggcgaagccgaggggccgtaccccaagcccggcggccgagagggcggcgtgggcaagcccgacgggaatcatggcgtaggcgacgggagacaggagcatgctcgcgagcggcccaaggaggggcagcctcccgaacgcggcggaggagatgggaagcgtcgccgcctgcgcggcgagcgaggcggcgagcgcgtccacgaccgcaccgcggcagcggagcatccgcctgcccgccgcactccgcacgagcgcgcgctcgaggcggggcgtgccgagcgccgcccccaacgcccacgagaggtaccggctcagggcgcacagtccgaggacggagctcatggagaggaggaacccaaggtcgcaggcaaggtgcgggtcgaacagcgtcatgcagagcgccacgacgcccgcggagctcgccgagtgcgagcgccttcccgcgagctgcgagcccaccgccacgagggacatgagccaggagcggaccgccgacacgggagacccgcacagcagcacgaaggcgccggacgcgatgacgagcagggcaatccgacaccccggccggagcctcgagcgcccgagcacgccggcgatgatccccgtgacgatggagaggtggcttcccgacacggcgaccaggtgggcaaccccacacagcttgatgagctcgtaggaggggtcgcccatcagcgccgtgcggtacccgcagcacacgcccgcggcaagtgcgcgctccggggaggcgcaggggtccagcgccccgacgagggcctcccggagcctgaggacggggccgagcacgccatcgggacccgaggagccccggacgtgcaagacgctcacggacgcgacgattccccgtgcccggcacgagacgtcgaagtcgtcgtcacccagctcccgaaggcgtcccacgcatgagacggcatggcccagccgcagctccacctgagtgctgaggtacacgtctgcgacgcgcctgccgttgaggctcgcccccgccctagtgaggtacccgcggcgggtggggtgggagtcctcgtttgtgcgaagctcgagcgacgagacggggaccgacgacaggacgtcgagcgcccgcctcccctccgccacggcggcacaggcggaaaggcctccaagggaggcaaccgcaacaagaacgcaggcccagacgggagcgcgccccagccccctccccctccgcagcagcaacgcgcccgcggacagcacaaggagcaggccgaggagggtcgtggtccccggctcggacggaagcctgcccgtgaggacggccctctccgcgaggatggcgcagaccaggggagggatcgtgacgggaaggtgggggcgatcggggaagcgctccccaggcgcaccgtgaaggctagacacagatgccgtcgcgaatcttctcgaacttcttctcgccgatccccgagacccgcatgatgtcctcgggagacgtgaaggggccatgctcctcccgctcccggatgatggaggcggccgtcgcgtcccccacaccgggcaacgccttgagctcgtccgcgccggccgtgttgatgttgacgggcccggcggtgcctcccccgccggtcgagggctgtgtagtctgcacagccgcctcccccgcgtgggggacgtggaccttggtcccgtcggcaacggcctgcgccaggttgagcccggtcgtgtcggcgtcctccgtgagcccgcccgcggcctcgatggcgtcccgcgcgcgaggcgtggcggctcgcagttcgtagacgcccgggtttgccacggcgccgtcgacgtggacgacgacggggctgggaagggattccacgcgcggcctggagtccgcctccgcggcgtcctcccccctcgcggcgtccctcgccccctgcacctgtccgtcgccacgaacgagctcgacgcccccgtccgaatgcgccctcaggacaccgaccccaaacgccacggcggccagggcaaggcacgcgatgcccaggcgcaccgagagccctccccctaacctcgaaccaccagccctcctgttcctcatgcgctgtgccatggcaccaccccctcccaccatcctcccagcgaaaagggggcgagagggacgcaggtaaaatctctccgcagcggggttgcacgaaagtgtcgccagactgcagcggcggcgtccacatccaagggacgccgccgcattcgcaagccatatgggagcgaggggccagctactgctcctccgtctgcccctccgaggactcgtcacgcggccccaactcgcggtgcctccgcttgaggctcctgggcgcgtggtacgaggggcactggtcaaagtccacgtactcgaggtggtccaccaggtcgtcgatcatcgcgtcgtggtcaaacgagtcccaggcctcgtgcacctggtcgaggcgagcgtgcgtctcgggccgacgcggcatgaagagcgtgcagcagtcgtcagccgtctggcagctgatgtcataggtgccaatctcctcggcgcgatgcatgatctcctgcttgtccgagccgatgaggggccggagcacgggcatcgagaccatctcgttgaccgcggcgatgttgtccagggtctgcgaggcgacctgccccagcgactcgccggtgacgagcgccttggcgccctcgatgcccgcgatcctctcggcgacggagaacatgacgcgccggtaggtgatgatcctgaggctctgcggcacggcgagggagatctctcgctggcgctggccgaaggggatgacgtagagcctcccgaccatcccggacggcgcgagcgcgcgcacgatgtcctgacacagccactcgctcgtgtcggccgtcatgggacggcccgagaagtgaacgggcacgcaggtcgcgccgcgacggcccaccatccaggtggccacgggcgagtcgaacccgcttgagaggagcgtcacgaccttgccggcggtacccacggggagcccgccgacgccgggcatggagtcggcgtacacgtagacgttgccctgcaccacgtagacgcacacgctcacgtcgggatggtgcatctcgaccttcttggtggggaactccttgcagagaaccccgcccaccaggcggttgatgtcgagcgtgtggagctcgtatcccgtggacgagcggcgggcgtggaccttgaaggactcgaagtcgcccgcctcacccagtgcgcggaccgccgcctggcagtactcctcctggtcgagcccgcagacgtaggcgagcgaggcgcgcgccacgccggggaccctcgagatggcatgtgccatctcgtcggtcgcctccccatcctcggtcgacacgaggatgtgcccgctgatgcgcttgatcgcatcgacgggccactcgcgaagggcacggtggaggttggtcacgagttggttctcgaaggacgagcggttcttccccttgagtccgatctcgtggtagtggacgaagcagaccctctttgccatggcctacaggttgtgctcgacgcgggcgttggagcccttgatctcgctgtcgaagtcgtccttcacgtagctcagggtgccgtcctcgatctcctgcatggcgatggagacggggtcctcgcccgagacgaccgtggtgatgtcgtcaaactcctggatggcggtgacgcgcaggtgctggcccctgaccatgttgttgatgtcgcaggcgcgcttgtacgcgacgctgcagagcaggaacgggttgtgctcggtcttggcgagcagatcgtcaatctctggcttggtgactgccatcttgggagactcctattcgctttcgtaacgctcaaatgttgcctcgagctccctcgaggcaacctcggcgtcgtcgttgactacgcgtgcgtcgtagtggggggcaaactccatctcgcgccgtgcgttggagagacggagctcgagcgaggcctcgtcctccgtccccctggcgcggagccgctgctccaggacggccatggacgggggctcgacgaagacgaggacggcgtcgggatagatgcgcctgacgttgagggcgccctgcacgtcgatctcgagaaccacggactgcccggacgagatcctcttgtcgacctcgctgcggagcgtgccgtagcagtgcccgtgcacgtgcgcccactccaggaactcgccgctggcgacgcgacgcgcaaaatcatcctccgagaggaagtggtacgagacgccgtcgacctcgccgggtcgagggggcctcgttgtggcagagaccgtcaggcccaggtcgggacgacgcttcctcaccatggagaggagcgtgcccttgcccgcgccggacggtccggataccacgaagagacgaggagtcctggccactacttggacagcacctcgatgagctgctcgcgctggcgcgcgccgaggcccttgacgcggcgggtggcggagatgccgagctcgtccatgatcttggctgccttggcctttccgtacccggggagggactcgatgagcgcggagaccttcagacggttggcgatggggtcgtcggaatcgaggacctcctcaaggctaatctcgcccttcttgatcttctcgcgaagctcggcgcgctcgtggcgagccgcggcggccttctcgagtgctgccttgcgctgctcgtccgaaagctggggtagagccattgtcgtcctccaaacataggatgctacttaggtcgcacgcccaggcaccagacgcgctggtagcaggcatgcaaagcgatagtttgccaattacgccctcattttacaagcatgacctgcgtttttgtgcgcccgatggtctcatcttcacaaaagcgcacgtataggccaccgtcgccgccaactttaggcggtgagctcgcccaccacgccctcgagggcggcgagggggtcggccgcccgtgtgatggggcgaccgatgaccagcttcgaggcgccggcctcgatcgcctcgcgcggggtggccacgcgccgctggtcgccgacctccgaacccgccgggcggacgccgggcgtcacgatgagcgcgtcggggccgagcagcgcccgcatctcccgcgcctctcgcggggagcagacgatgccgtcagacccggcgcccaccgccagggaggcgagacgggagacctcctcctcgaccggggagccgaccccgatggactggagggcggcctggtccatgctggtgaggacgctgatggcgacgagcctggtcctgtctcccccgcgactctccgccgcacgctcgacgccctcgcgggccttcgcgaccatctccgcgccacccataccgtggatggagaggatgtccgcacccgtgagcgacgcggactccgcggctcctcccacctggaagggaatgtcatgcagcttgaggtcgaggaagaccttgaggccacggtcgcgcagctcccggacgatgcgcgggccctcggcgtagaagagggtcatcccgaccttcgcccagcgggccgcgccgccaagcctctccgcaagcccgatggcctgcgccccgtcgcagtcgaaggcgacgatgatggactcgcgtgcctgctcctcgcttagcattccacagctccaatcagttcgttgacgtcggtcgccccctgctcgcgcacccagtccgtgagctcgcccaggatcctcggggcgctcgtggggtccacgaggttggcagttcccaccgagacgctcgtcgcgcccgcgaggatgagctccgctgcgtcctcgccgctggtgacgccaccgatcccgcagatggggagcgagacggcccgatgcgcctcccagaccatcctcaccgcgatggggtgcacggcagggccggagagtcccgcggtcgggcgggagagacggctcctcctggtgtgaacgtcaatcgccatggcggggatcgtgttgatgagcgagagggcgtccgccccctccgcctcgagggcccgggcgatctcagggacgtcgtggggcgccatcttgaccaccacgggcagcttggtgcgaccgcggacggcgcgcatgacctccgccgcggcctcgggggtggcgcccatagccgccccgccctggctcacgttggggcagctgatgttgagctcgagcccggaggcaaacggcgccagctccccgtacagctccacggcgcgcacgtactcgtcgatggagtgccccgccacctggcagatgacctggcacccgcgctcgcggagcccggagaggtactccccgtcctgctccacgaaggccctgattcccgggttctggagccccaccgagttcatgatgcccgacgctacctctgccatcctgggcgcggggttgccgtcccagggctcggcggagcaccccttggtggtgatcgcccccagacacgagacgtcgaagaacccctcgaactgccacccgtacccaaaggtccccgatgccgtgttgatggggttcctcatcttgatgccgccgaggtcgacggccatgctcggctcgctcaccatgccacctcccgggcatcgaacacggggccgtcggtgcagcacgccttgtagccgccggccgccatcgcgacgttgcacgtgttgcacgccccgaagccgcaggtcatcatccgctccatcgagacctggcaggcggagccggcttcgagcgccagcctcgcgacgcccgccatcatgggctgggggccgcaggtcaggacggcctcgtagtcgcgctcgcgctgcagcccctccatggccaccgtggtgaaccccttggtaccagcggtcccgtcgtcggtcgtgaccacaacctccctggcgccaagggactccgcgagccccacgccccagagcttgcccgcggtctgggcgcccagcaccacgtcgaaggggaccccacgcttcgagagctcgcgtgcggcggcgagcacgggcggcgcgcccaccccgccggcgaccaggagcgccggaccgctgactccgtcgagcctccatcccctcccacaggggccgaggaccgtcgaggcgtcaccctctcccatgcgcgagagcctcgcggtgccctcccccaccacggcgtagacgatctctatggtttgcgcctgggggtcggtcccggcgaacgagagcgggatcctcgtgatgtggctggggtcaccggggacggcgacgttgacgaactgtccgggggagagggtcggggcgagtccgggtgtgtgcatgaccatccggaagatgccgtccccgacccgctcgttggacgcgacgtcgaaggcgaactgcctcacgtctgagcttggtagcacgtcgtctccaatctctacgtgcgatggcgtggggcgggatccgccctcacgccatcgccctttgccgcttgtcagtgtagcgccgctaggcgacgaccccgttctcgagggtgcgcctgcccgccacgaacacgtcggtggcggcgcccacgagcgtctggcccaggaatgcggagttcttggacctgctctgcaggtagtcctccgtgacggtcacctcgcgctcggggtcgatcagggtcagatcggcaacggagcccctctcgaccctgaccttggggaggcgaaggacggagcgggggttgaccgccatgacctcgacgagccgctgccagctcatcttgcccgtgcggacgaggttgttgagcatgagcgggagcgaggtctcaaggcccacggtgccaaagaacgcgatctcccactcgcagtccttctcgtgcgccgcatgcggcgcgtggtcggtcacgaggcagtcgatggagccgtcgaggatgccctcgcggagcgcggccgcgtcatcgggggtgcgcagcggcgggttcatcttgaggttggtgttgtaggtggtgtcgatgtcgtcctcgtcgaggaagaggtggtgcggcgtgacctcgcaggtgacgggcaggccctcggccttggcgcccttgaccagctcgaggcccttggcggtggagatgtgcgcgatgtgcagggggcagcctgtgaggcggcagagctcgatgtcgcggtagatctcgagctcctccgcgagggcgggccagccgaacatgccgagcctggtggacgccttgccctcgttgatgacgccgtggccgctcagggtctcgatctcgcagtgcgcgatggcgacgcggtcgaactgcgcgatgtactccatgcaggtgcgcatcatgccggcgctctggacgccgtggccgtcgtcggagaacgcgacggcgccctcgagcaccatgtcgccgatctcggagagggactcgcccttctcgccgcgggtcatcgcgccgatgggacggatgtggcagagccccgccgcatggccgcggtcgatctggtagcggatgccggtgcccgtgtcggtgacggggtcggtgttgggcatggtcgcgacgtcggtgaacccgccgtgcgtggcggcgcggcttccggtctcgatggtctccttgtactcgaagccggggtcgcggaagtgcacgtgcatgtcgaccaggcccgggaccaggtacttgccggtcgcgtcgatgacctgcacgtcctgggcggcctcgaggtcgctcccgacctcggcgatgcggtcgccgtcgatcaggacgtcgacgacctcgtcaaggccgacctgagggtcgacggcgtgggcgcccttaagcagaaatgccattgctctctcctcccagaagcaggtacatctcggccatgcgcgtgaggacacccgcgttgacctggttgagaatcctggaacgtgcgcagtcggccacgtcggcgttgatctccatgccgcggttcatggggccggggtggcagatgatcgcgttgtccttcatgtggttgacgcgacgcatgtcgagcccgtagaggcggttgtactcgcgcttggagggaatggccgcgccctccatgcgctcgagctgcacgcgcagcatgtagacgacgtccatgtcctcgatgacctcgtcgaggttggaggtctgcgggcaaccgaaccagtcggggtcgtcgacctggaaggtcgggggcccgacgagggtcacgtcggcgcccatggtcttgagcgcgggcgcgagcgagccgcagacgcggctgtgcgcgaggtcgcccacgatggcgaccttgaggccgtcaaggtgcccgaagtgcttgcggatggtgtagaggtcgagcatggcctgagtggggtgctggtgcttgccgtcgcctgcgttgatgaccaccgcgtcggtgttctcggtgatcttctgcggggtgccggcaaggcgggcgcggcacacgaacatgtcgacgttcatcgcgtcgatggtctggatcgtgtccgccagggactcgcccttcacgaccgaggaggtggagccccccatggagagggagtcggccgagaggcgcttctccgcgagctcgaaggagctcttggtgcgggtcgagggctcgaggaacaggttcacgatggtcctgccgcgcagggcggggaccttcttgatgcccgggcggttgttaatcgcctcgaacgaggcggcagtgtccaggatctgcgtgatgtcatcggccgtgaggctgtacgtgtcgatgaggttcttgacggaaagcatctagttcgcacctccggcgttcttctctgcgtccagctcccagatctcgaccgagttgcggtcgtccaggggcttcatgcacacgcggacgtcctcctcgtgggacgaggggacgttcttgccaacgtagtcggccctgatcgggagctcgcggtggccgcggtcgaccatgaccgcgagctggacgctcttgggcctgcccaggtccatgagggcgtcgagggcggagcgcacggtgcgcccggtgtagaggacgtcgtccacgaggatgatgttctcgtcgtccacgctgaaggggatgttggtgccgtggatcacgggggcgacgttgcgcatcacgtcgtcgcggtagaagctgatgtcgagcgagccgagctgcggcctggtcccctcgatctcctctatcgcgtcggtcagctggcgggcgagcgtgacgcccctgcggacgatgcccaccacggcgatgtcgctagcgccctcgttgtgctcgatcacctcgtgggcgatgcggacgacggcgcgcttcatggcctgctcgtccatgatgaccgccttgggcttggcctgttccatgggactccttccttaaaaaaagatgccctgtccgtctgtcgacggcacaagacaccggaagagagtcatatgtgttgcccctgggagcataatgccttaccggtatctcgtaccgctttaaaggtcggtaagacaatacaatatttcgaccctgccacgggcgagaaattcccgccccaaaaaccagcacaaagccagggccccacacgccggcggggccctggcagacatcatatggacgcggagtgcgtgctggtcggctttgccagccccttctcggcggcacggcgccgcgcaaagagcccgaggcgagagagggcaaacgaggggccgttgatgtcccagctgtagaagaactcgttcaccaggctcccgacgtacgggaggtcgctgaacctcacggggtcgtagccagtcagctcgaagtaggtcttcttgaacgagcccgagagcgtgacgatgcccgccacgatcgcggggtccatgcgtcggaagatctgggtgacccacgcacgaacctggggctcgtcaagtccgaagtcggcgatggctccccccgcgtacctgaagccgatgacgtagaacgactccaggatgccccggtcggtcaccccgtaccgctcgatgaggtcggccatgttgttccagcgctcgaacgacagcccggccttgcgcaggaccgacgaggagcccggaagatcctcgcgatagcagtagaacggctcgtcgatgtacacgatcgccttggcgaggacgcaggtctggatcaggaacgggttgtcgacccagccggcacccggcacctccatgaaggtgatgtcgttctcctccagaaagcccttgcgatagatggcggaccagatggaggggtggtgctggatgaggcgcgggcagtccttgagcgtgaagggctcgtccacgggcttgatgcggtggtagtaggagcagttgtacaggtgctcctgcggcgtggttggcatccagacgcggatgtagggggacttcaccatgtcaggcatgtcgtggcggcgcgccgcggcgaagagcgtgtcgaacatgtggggcctcaggtagtcgtcgggctccaagatgccgatgtaggtgccccgcgcctcgcggatgccccggttcatgttggcgccgtacccggagttctccttgtcaatcaccctcacgcgcgggtccctcgcggcgtgctcgcgcatgatggcgagcgagccgtcggtggagccgtcgttcacggcgatgatctcgagcctgcagctgtcgttcatctccgccgtgctcagcgcctggtcgaggaacctctcggtgttgtagcacggaacgatgacgctgacgtcgatgtcctgacccattacttccccagattcttgtaggcctcgcacacctcgtcggtgggcccgagcatgcgctgcttgcccttctcgatccagcacaccctgtcgcagatgcgctcgacgaggtcgatggagtggctgacaagcaggacggtcacgttgtccgccgagacgagctccttgatccggcgctcgcacttcttctggaagaggaagtcgcccacggagagggtctcgtcgacgatcaggatgtcgggctcggtgatggtggcgatggcaaacgcgatgcgcgcgaccatgccgctggagtagttcttgaggggcatctccatgaagttctggagctcggcgaactccactatgtcctggaagtgctcgtcgatgaactccttgcggtagcccaggagcgccccgttgaggtagatgttctcctttgcggtgagctccatgtcgaagccggcgccgagctcgatgaggggcgctatggtcccggcgacgcggcaggagccgctgctggcgtccaggacgccggcgatgatcttgagcatcgtggacttgccggatccgttggtgccgaccaggccaaaggcctcgccgcgcttgacctcgaagctgatgtggtcgagcgcgcggaactccttgaacttgagctcgtggcgcatgagcgcgatgaagtactccttgagggagttgaactgttcggaggcgatgttgaagaccatggacacgtcgtccaccgagacaaccgtctccgcgtcgggggacgggagcggcgggcgggtgaactcgtcggtgtcgccgcaggtcatccagcggctggcggtgaccgtctgcccgtcgggcccggtgatgtcgcaggtgatgaggaacttgccctcgtggggaggggcaaagccgtactggtactcgccgttgggctcgccggaggtcccgccctctccgccgccctcgagcatccaggtgaagcgataggtgcaggcgtgagggttggcgcccttcacgatggccgtggcggccacgaagtcgccgtactcgacgagggtcttgttgaggtcaagggacgcggaccagttgtccgtgctcatctcgatgttgtcagacacgcgatcctcctagatgaacaggatgaacttgtgctcgtgccggtggaacacggcgtacccgatgcccagggagaccagggcgaagaggatgaggcggatccacaggctgagcgtcggaacgcgctggaacaggaggacgtccctgaagaaggtgatgaagagatagagcgggttgaagttctcgaacgtcctcatccagccggggaggatgtcgatgacgtagaagatgggggtcgcgtaggtccacgccgtgaggatgacgccccacaggtgcatgacgtcgcggaagaacaccgacgcggcggcgaggaagaacgagagcccgatgcagaagacggtcatgagcaggagccccacggggagcaggagcgccagcggcgtgagcgggatgcggaagaacagcatgacgagcgccacggcaatgagcgagaacgcgtagttgacgagggcggagagcaccttctggaccgggaagacccagcggttgatcttgaccttcttgaggagggaggcggcacccaggatggagcccatgccgccgttggtggagtcggcgaggagcgtgaaggtggtgttgccgatgatcaggtagagcgggaagttgacgaccgagtcgctgccaaacctcatgaaggacgagaacaccgccgccatgacgatcatcatgaggagcgggttgaggacgctccaggcaacgccgagcgcgctcctgcggtacttgagcttgaagtccttggacacgagctgcctgatgacggcaaggtcacgctgctttggcggataccacgcgtcctcgcggggcttgctcctggccccctcctcgccctcaggggtctcgacggttgcggtcttgtcgtccacgacgcctccatgtcagggattgccggggaatggtgtggccccagcttgtcggcagaaaactctatcacagcgaacagcgccccatacaattggcagaagggcaagtgcctcgtgcgcgcccggcttgcggtgccgacgcgcacggtatagccatgcctgccgcgtgggcggcaggcgtgccccgaacctccacgggattcgaagcgattcgaccggcacagcacctgcaaacgaaagcaggtcgaacagcttgtaagccatccgacctgcgaactctctggctccccgggcagggttcgaacctgcgacacgctgattaacagtcagctgcgctaccactgcgccaccggggaatctggtgtgctgcgcacgagtagttactatagcagacgcaaatctgggtgcaagcgactttccaatattttttctgccgcacccaatttgacccccagtccaatgcccgcggctatgcagagagcccatacacacctaaatatggtgtgcatgggctcctagtctgagcagggtctctcccctattcttccatataatccttaagcttcccggagcgggaaggatggcggagctttgcgagcgtcttgctctcgatctggcggatacgctcgcgcgtgacgccaaactcgcgccccacctcctcgagcgtgcggggatgcccgtcctccaggccaaagcggaacttgatgaccttgcgctcgcggtccgccaggctgtccagcacctgctcgagctgctcgcgcagcatggagtcgctcgcggcgtcggggggcgccacggcgctggagtcctcgatgaagtcacccagctgggagtcctcctcctcgccaatgggcgtctcaaggctgaccggctcctggctgatcttctggatctcgcgcacgcggtcggcggagatgcccatctccgcgccgatctcctcgggggtcgggtcgcgcccgaggtcctgcagcagctggcgctggacgcgcacgagcttgttgatggtctcgaccatgtggacggggatgcggatggtcctggcctggtcggcgattgccctggtgatggcctgcctgatccaccacgtggcgtacgtggagaacttgaagcccttggtgtagtcaaacttctcgacggcgcggatcaatccgaggttgccctcctggatcaggtccaggaagagcatgccgcgaccgacgtagcgcttggcaatcgagacggtcaggcgaaggttggcgctgatcagggcctgctttgcgtcaaggcccacctgctcgatcctcatgaggcgcctctgctcggcgcgcgtgagctcgatctcgccgttctcggccgcctcgagcttctgcgtggcctcggtccccgcctcgatcttcatggcgaggttgacctcctcggaggcggtcagcaggtcgaccttgccgatctccttgaggtacatgcgaaccgggtcgccggtgagcatcacggtcgagttgtcggtcctgcgggcgcgtgcacgcgaggaacgcttgcgggccttgctcttggggacgctgcgaaggacctcgttggcgacgcgggcctccttcttggcctcgctcacctcgctgtcctcgtcgtccaggtcgtcgtccgcatcctggtcctcgtcgtcgtcacccgacgagaccgagattcccggggcaatctgagagacgccgtcaccggacgagatgatctcgactcccttggcgcggatggcgtcgtagaggtctgacagctcgtcgtcgtcgacgtcaatctcggctatggccagctggatgtcgtcctccgtgagggagtgcgagtcggaggcctgcttcaccagtgccttcacggccccctgcaggtcgtcagagagcccagatgccttggtcgccttgttgtttgccacggatttcctttccacgtataaaccttcgtgatgatacccattttcctgggctatgcaacagtcgagacccgttgtgacagttcgttgatgcgcttctgcgtctgggtcgccctcctgaagagctccgccgcctcctcgtcgcccggcgaggcggacgaggccctgagcctggccttgatctcgcgcacctcccgcctcctcgaccacagctcgatcacgtcgaggaggaacgcgacctcctcgtccacgcccatccccgaggtgacctccaggcgggcgccggcgaggagctgcggggcctcggggaccacggactccgccgcggccaccacctccgccggggtcgcttcctcgggcgtggcgagcatggcccacgccatcgcctcgttgcgcgagtccgcccaggtgaacgaggcgatcctgtccccctgcgcccgcacggcgccaacgttggaggccatcacggcaagcagctcgcgctccgcgatcacctgcatgcgctcgtccttggagagggccgcgaggctcatgccagcagccgagggatcccggggcgagaggggcgtccccctcccctgcggaggggcggccttggtcccggcggggagcctgccaccctccccctccggtgtcggctcgggcttctgccgtatgacgcgcttgacctcctccacgctggttcccaggaggtctgccagcgtggtggcgtagccgtccaacaggatggagccacggagcggaacgaggagcgacgccatctggtcgagcgccgcgaccctgcggcccggcaccgagaggtcgatgcccgagagtcgcttggagaacacgaagtccatgagggggaccgccctttcgagctgcccgcgcagggcgtccgccccgttggcggcaaggtactcggcggggtcctgccccccggggagcacgacgcagagcagctggacgccggtcttgcccacgtactgcaccgcccgctcggcagcgcgctggcccgccgcgtcgccgtcgaacatgcagacgacgcggtccttcgcgaagcgctcgatgagcctgacgtggtcgagcgtgagcgccgttcccagggcggccacggcgttggtgaagcccgcctcatgcatggagatgacgtccgtgtaaccctcgcacacgatggccgtgcccgtggcgaccatggagtccttggcgcggtcgaacgcgaagaggtgcttgcccttgtggaacaccggcgtgtccttggtgttgaggtacttgggctttgagtcgcccatcacgcgcccgccaaaggctatgcagcgtccctgctcgtcgtggatggggaacatcacccggtcgaagaagcggtccctgagccccccacgcccctccagggcgaggtcggccgagacgatctcgtcgcgcgagaagcccgcctccctgaggtgcgagacgagcagcccgtggcccggggcgtacccaagcttccagcggcggcacacgtcggagccgaagccgcgccccgagaggtacctgcgcccctcgtccgcgccctcgccgcgccccctgaggaggagggtggagtagaacgactccgcctccgtgaggcactcgacgagccgggaccgctttgggccgcgacgcgcggagcctcgctcctcggagagctcgatcccctccttgtcggcgaggtacctgatggcgtcggggaagtcgaggttctcccgcttcatgatgtagttgaagacgtcgccgccctggtggcagccaaagcagtaccagaaccccgtggaggggatcacgtggaacgagggcgacttctcgtggtggaaggggcagcagccccagaagtcgcggccgcgctgcctgagctcgaccgtctcacccacgatctgcacgatgtcgctcgcctgccggacgcgctccttgtcctcgtccgtgatcactcgcccacctccacgccatgctgacctacctgcgtacgtacccagtcgacgttcgacagaaccgcgcgctcgagctcctcggtggaggggaagggcctcgacgccctgagccagcgggcgaagaccacggacacctccctcccgtagaggtcgcccgagaacccgaggaggttggcctcgaggaacgactgccgggggcccgagaacgtcggcggcgcccccacgttgatcgccgcggggtaggccgtcccgcccaccaccacgtaccccgcgtagacgccgtccgccggcaggcacgtggtggcggggaccagcacgttggcggtggggaagccaaaggacgtcccctctcccctgccgtgccccacgtggccgcggacgaagtgcgggcgggcgagaagcgagttggcacgctccagctgcccgtcgcgcaggagggcgcggatgcgggtcgccgagaccgtctggccgtcctcctgcagcagctcctcgccgtgcaccgcgactccctcgccgctcccgagctcccgcagcgacccgaggtccccgcacccgccgtcgccaaagcggaagttggtgcccacccgcacggagagggggcgcaccaggggcgggagcatcgtgcggaggaacgcctcctggctggtgtgctcgagcccctcgccaaagtccagcaccagcaccgcatcggcgcccaggaggaggagcccgcgcgccctgtcgcgcacctcgagcaggcgggagaggggcctctcgccctcgatgaggtcggacgggtcgggcgagaaggtcacagccacgcaggggagcgagagcgcccgggcgtcggcgaccgcgtgcgagaggagcctgcggtgccccctgtggaggccatcgaaggcgccgatgcagacgcatgcctccgagcccggggagacgggcgccgacgagcgggtgacgagggtcgccccgtcgagccggatggcgttcgcctcgacgccgccgagcagcagcgagtccctgcacagcgcgcgggagtcctcctcggtgagtgggagagcccttcccaggatcgcctcggtcacgacctcaccccatcgatgccgctggggaagttcgcgacgcaggcgagccagggcccgcggcgctcccacaccccgaggagccggccgtcgcgcacgaggcagcacctctccccctccgcaagcgcgagcggctggggcgagatgcggcgtccgcacctggcgtcgtcggcctcccgggcggtgagtgccctcgcgggcaggccgagcgcgcgcacggggtccagccgatgcgacgcgagcgcgtcgggcccgcgctcctcaagctcgtcgagggtgacgcagtcggcgagggtgaccgtgccggacgaggtcctcctgagcgcccgcaggtgggcggcggtggaggcctgcctgccgaggtcccgggcaaggctcctgatgtaggtgcccttggacacgcggaaggcgcagtcccaggcgacgggctcgccgggctctatggcgagcagcgtggactcgataatcctgacgtggcgcggcttgaggtcgacctcctcgcccgagcgggcaagatcgtaggccctcctgccgttgacgctgatggcggagtaggcgggcgggagctggtcgcactcccccacggcggacgagacgagcccggacacccggtcccggtcccccgcccacgcggggacgggcgccgtcctggtgaccgtgccctcggcgtcgtccgtgtcggtctcggtgccaagctcgatggacgcgacgtaggacttctcgtccatggtgagaagcccgagcgtccgcgtgccctggcccacgcccacgaccaggacgccggtcgccgcggggtcgagcgtcccggcgtgccccacgcgacgctcccccagggcgcgccgcacccgtgacaccacgtcgtggctgctcatccctgcgggcttgtcgatggcgaggaggcagttgatgccgctctctccccgcctcacctagcgtcgctcccctctccgtcaccctcgacgagggcgacgagcggcgggagcgccttgctcaggacctggtcgatgtccccctccatcgtgaagccggcggcagccttgtgcccacccccgccgagggaccgcgcgatgcccgagatgtccaggctcgtcttggagcggaggttgccgcgcaccatgccgtcgccgacctccttgaggaagagggcgacctcggagcccgagacgctgcgcaccacgtcgatgaggccgtcgcactcgtcgaggctcgcgcccgtgcgccggaggtcggcggcggtggcgtagctgtaggcgatcctgcccttggagaaggtcgtgatgcgccccatgacggcggactccaggtgcaggtacgagaggctgaagttctggtacacgttgagcgcggtccggcttgggacggcccccgcatccacgagcagccccgcgaccgcaaaggcctcggagtcggcgttctggtactggaagcgcccggtgtccgtgcacacggcgcagtagaggcactccgccatgtcgggcgtgatggtgacgcccaggtgcagggcgagctccgtaacgatgacgccggccgccgccgcggagggcctcacgaggttgacctggccgtaggggctctcgcaggggtggtggtcgatgatgaccgtagcccccgcccgcctcatcacgtcctcggcgaggttgagcctcgacgcgacggagaggtcgacgctcacgaagaggtcggggctctgcccgtagtcgccggcgcacacgaagccggatgccccggggaggaacgagtagatgcgcgggacgggctcccggtcggcgaggaggttggtgacctcgatcgtgggccactttgccctgatgatcatcgcgagggcgagacccgagccgagggcgtcgccatcggggctcgtgtgagcgcagatggcgacgctccggcatccgtcgatcgcctgggcgatcctgtcgaatgcctcctcctgcagggggttgcacgcaaggcccatgtcgctacttctccccctcgccctgctcgtcctggccctcctccccgtcggcgacggggtagccaaactcgtccttctccacagagagggtcgaaggcacgttctggagggccttggcaatgcgctccgcctcgtcggcggtcgtgtcgatctggaagatgagctcgggggtcacgcgccaccccagtgcgtggcccagcaggctgcggatgcgccccttggcgcgccccagggcctgcgagacctcatcgtacctgtcgcggtcgcaactgacataggcccgcaatacggacttgtcgatcgagacctcgacgccggtgagggtcaccagggagagctcggggtcgctgacctcgaacaggaggatgctcgcgagcttctccctggcgatctcgttcacgcggcgagagttgtgattctgcttcatctcgtcctactcggtacgggcgacctgctcgatgcggtacgtctcgatgatgtcgccaacgtggatgtcctggaagttgtcgaggccaatgccgcactcgaagccggccttgacgctcttgacgtcgtccttgtagcggcgcagcgaggcgagcttgccctcgtacaccacgatgccgtcgcggacgagtcggcagaggtcgtcgcgcgagacctctccctcctgcaccatgcagcccgcggcgatgccgaccttggggaccttgaaggtgttgcgcacctccacggaagcggtctgcacctcctgctcggtcggcttgagcatgccgatgcgggcggcgtcgatctcctcgatggccttgtagatgacgctgtagcagcggatctcgacgccctgctgctcggcctgggcgcgagccttggcgtccgggcgcacgccgaagccgatgatgatggcgtttgaggcgtcggcgagcgtgacgtcggtctcgttgatggcgccgacggcggagtggatcacgttgatgcggacctcgctctggtccatcttgttgagggagtcgaccagcgcctcgatggagccctggacgtccgccttgatgatgaggttgagctccttgacgtcggcgtcggccatggtgtcgaagaggttctcgagggtgacgtgcttgaccttgttctgctcctcgatgcgagccttgagggcgcgctcgtcggcgagggcgcgcgcgtctcgctcgtcctggaacacgcggaactcgtcgccggccatggggacgctctggaggccgaggacctcgacggggtcggaggggcgggcctccttcacgttcctgccacgcgggtccatcatggcgcggatcttgccgaacgccatgcccgcgacgatggcgtcgcccacgtggagcgtgccacggctcaccagcagcgtggcgacggagccgcggccgcggtcgagcttggcctcgagcacgtggcccgaggcgaacgtgtcggggttggccttgagctcgaggacgtcggcctcgagcaggacggcctcgagcaggtcctcgatgcccatgtgcttcttggccgagatgtcgacgaacatgttctgcccgccccactcctcggggatgatgccgtactcggtgagctcctggcggaccctcgtggggtctgcgccgggcttgtcgatcttgttgaccgccacgatgatgggcacgtttgcagccttggcgtggttaatcgactcgatggtctggggcatcacgccgtcgtcggccgcgacgatcaggatgacgatgtcggtcaccttggcgccgcgggcacgcatggccgtgaaggtctcatggccgggggtgtcgatgaaggtgatggtcctcccgttgatctgcacctgcgaggcgccgatggcctgcgtgatgccgccggcctcgccctccgcgacgccggtgtggcgaatcgcgtcgagcagggacgtcttgccgtggtcgacgtggcccatgaccgtgaccacgggcgggcggggcttgaggtccttggggtcgtcgtagaacgagaaggagttctcctcctccttggtcatgaccttgacgtcacgccccaggtcgtccgcgacgagctcgatgaggtcgtcggacatggactcggtgagggtgagcgggttccccagcaggaagagcctcttgatgatgtcgttggcagggacgttgaggagcttggcgaggtccgcgaccgtggaaccctgcggcaccttgacggtgtcgagctgcgagaggtcctggtcgttctcgatcgcctcctggatgcgctgctcctcggcggcctcggcctgctgcttcttgcggcgctccttgcgcttgcggcgcctgccggtgtcctggtgcgcctcctctacggcctcgcgggcctcctcgaagacgtgggagcggttgtactcctccgcctcgcgggccatgcggctgtagcggtcctcgtcctcatggccgcgacggccgcccttcctgcccttgccgcgacccttgccctcggactcgccctcggggacggggccgggcacggaggcgccgacgcgcggggtgctcgagcgcctgccgccgcgatgcgtctcctcggcctccccgccgcgcgacgggcggtcggacctgcggccgcgacccttgccgtggtcgcgggcggcgcggtcctcctccttcttcttggcggcctcggctgcctgctcctccagcaccttctcctgctgggcgatctggtcgagcaggctcgtgaacgaggggatggacttgggggcggtgtccctcacgcggttgcgctcctcctcttccttgcgcttgcgctcggcctccttgcgctcctcctcggccttcttgcgggcggcctcggcggcggcgcgcttgcgctcctcctcggcgcgctccttctcgcggcgcttctcggcctcgatgcgctccctctcggccttctcggcctccttgcgctcctcctcggccttcgcctccgcctcggctttcttctgggcctcgatctcggcggcgcgggcctcgaggatgggcttgagcttcttgcgcacgatggagacgtacgcgtcctcgagggtggacgagggcgacttggcgggaatcttcatgtcctggaggtgcccgagcatctccttgctgctcatgccatattccttggctagatcatgtacgcgggtctttgccatgtaaccaaccttccaaactgtctgacggggtgtgacgtgttagctgacctgcgactagatcagggagtcgggatcgtcggagacgggagtctcgccaagctcctggagcttctcgtggatgccgcagaagcgggagccggggcgcgccatgttgcggcactggatcccggtgggacccacgtactcgcagcggtgggagccctcctccgcctcctcgaggtcgggggcctcgtggtcctcggggatgccgcgcatgatctcgcgcgccagggactcgttcttgatgtcgatgtgcatgccggtgagacgtgcggcgagacgggcgttctggccctccttgccgatggcgagggaaagctggtcgtcgggcacgatgaccgtggcgtagttgttctcctggtcgacgaggacctttgagacgcgggccggcgacagcgcgttggcgacgcaccgggcggggtcgtcgctccacagcaccacgtccacgcgctcgccgcgaagctcggacaccacggtgcgcacgcggctgcccttggggccgacgcaggcgcccacggggtcgagcctgtcgtccaggctcgagacggcaaccttggacctcacgccgggctcgcgggcgatggagcggacctcgaccacgccgtcgtagacctcggggacctctagctcgaagagcctgcggatgaggtcggggtgcgtgcgggagaccacgatcgacggacgctggcgctcgctcctgatggggggctgggtgccgttggggtcgcggacgtcgatgatgatcgcgcggatgcgctggttgtgcgagtagcgctcgccctgcgggcgctcgttgcgctcgtcggggtagcggcgcaggtcgaagtagggaagctccgcctccacgccctcgcggatcttgatgattgcgaagtcgggcgtggtctgcaggacggtgcccgtgatgatgtcgccgatgcgctgcgagaactcctcgtagatctgctggcgctcggcgttgcgcacgatgtccatgatctcgctcttggcgtgctgggcggcgatgcgcgaggcgtccttgggagtcacgtcctcctcgtcgaactcggtgtactcgccggtctcctcgtcgaaggagtcgtcgcgcgggatgagcttgtacacgtacaccttgccggtggcgcggtcgatggtgacgcgcgcgccaaagtccaggtgcaggacctcgctgtagctcttggcgagggactgctccaggcggtcgatgaggtacagctcgtcgatgtgcttctcctggcagagggccatgagtgcttccatcatttcggatgccatgtcgtgtttcctttcaggggcgcgttgcgcctagtcgaaggttggcttgatcttgcaggagcggacctcgcccaggggtacggcgacgcgctcaccgtccaccgtgagggtcaccacgtcgtcctcgccaatcccctcgagggtgccggtgtagcgcctgcgcccctcggtggcggtggtcgagagggtcaccgtgctgccggcgaatcggcggaagtctcgcggcctcctgagcggccgcgagagcccgggcgacgacacctccagggtgtatgcacccgagatggggtcgagggagtcgagcgcctcgctcacccactgggtctgctcggacaccacgtcgagggatatgggcgcaagcccctcctccgcatggtcgatccggaccctcaccgtgggcgccttcctcgatcccacgatctcgacgtcgacgatgtcgatgccatgggtcgcggcgacgccctcgagggcctcgagaatctgtctctccagctcgcttgaggccacgcgctgctccttccctgacgttcgctcctacatacagaaaggaagcggggtgagaagttccaccccacttcctacgagtacgaatctgcttgcttcactatattgcgtgccgcgcccgggtgtcaagcttccacaattccaacaggacgcggcggcgtaagcacttggccgggccctagaccgccacgatgttgacgagccttccgggcaccacgatgaccttcttgacctccttgccctcgagctgcgaagccacggcggcgcgcgctgcaacctcgagctcctcgcggctggacgaggcgggcactgcgatgtgtgcgcggaccttgcccttcacctgcaccgcgatctcgaccacgtcgctcttggcctgctcggggtcaaactcgggccagggctcgttgtagaccgaggtctcgcgcccaagggcggcgtggaagagctcctcggaccagtgcgggatgatgggagagagcatgcacacaaggtcgtgggccacgcgctggcacagggccgggtcgcgcctctcggcggggacgtcgatgacgtacttggaggccgcgttcacgatctccatgcacgcggagatggcggtgttgaactggccgcggtcgaagtcgtccgtgcacttgatgcccatctcgttgaggacgcggttgagctccttcgagaccgggtcgaggcccgcggggttcagcgtcgcctcggggtcagcggactggcagagctgccacaccacgcgccaggcacgcttgatgaagcggttggcgcccgcgacggcctcctcgtcccagtcgaagtccttctcgggcggcgcgatgaacaggatcgagagcctcatggtgtcggcgccgtagggctcgatgacgctggaggggggcaccacgttgcccttggacttgctcatggtgtcaccgttctggtccttgaccatgccctggcagagcaggttggtaaagggctccgaggcgtcgatcatgcccaggtcgcgggcaacgcgcgtccagaagcgggagtacagcaggtgcaggatggcgtgctcgatgccgccgatgtagttgtcgacgggcatccagcggtccacggctgccttggagaagggctcggagtcgttgtgggggtcgcagtagcgcaggtagtaccagctggagcacgtgaaggtgtccatggtgtcggtgatgcgcttggcgggcctgccgcacttggggcaggtcgtctcgtagaactccttgcactcggcgagcgtgtcgcccgcgcccaggtcgaggttgtcgggcagcaccacgggaagctggtcctcgggcacggggacgtcgccgcagtggtcgcagtggatcatggggatggggttgccccagtacctctggcggctgatgagccagtcgcgcaggcggtactgcaccttcctgcggccaacgccgtggtcctccagccaggccacgatggcgtcgacgccctcggagtgcttgccgcccttaaggccggtgaactggccggactgcacgaggtagccctcggcctccatggcgccctcccagtcgacgctggtgaccctgagctcgcgctcgtccttgaggtcctcgtagagcgggtcgtccttctggcagatgatcggggcgatctcgaggccgtacttgcgcgcgaagtcgaagtcgcgctggtcgccgcagggaacgcccatgaccgcgccggtgccgtagtccatcaggacgtagtcggccacccagagcggcgcgggacgcccgttgatggggttgatcacgtagcggccagtgaagacgccgtgcttctcgcggttggtgccctggcgctcgacgctgctcaccttggcggtctcctcgcgcaggcgcctgaagtcggcctcgtactgcgtccccgcgacaagctcctcggccagctttgactcgggcgggagcaccatgaagctgacgccaaagagggtgtcggcgcgcgtggtgaacacggtgatggtgcggtcggtgggcgtcacgccgtcctccgccgccagcttgaagtcgatctcggcgccctcggagcgaccgatccagttgcgctgcatctgcttcacgcggtcgggccagccggggaggtcgtccagcccgtccaggagctcctgtgcgtagtcggtgatcttgaggtaccactgcgacagctcgcgcttctcggggatggagccgcacctccagcagcgcccgtccacaacctgctcgttggccaggacggtcttgcaggtggggcaccagttgaccggggaggtggcgcggtacgccaggcccttctcccacatcttgatgaagaaccactggccccagcggtagtagtcgggctcgcacgtcttgaccatgcggtcgtagtcgtaggagaagcccatgcggcgcatggtcctcacggcctggtccatgttggagtaggtccacgccgcagcctgggtgtggtgcttgatggcggcgttctcggcggggagcccgaaggcgtcgaagccgatggggtgcagcacgtcgtagccgcgcatgcgggcctggcgcgccatggcgtcgccgatggtgtagttgcgggcgtggcccatgtggaggtcgcccgaggggtacgggaacatctcgaggacgtacttcttgggcttggaggggtcctcgtccgtcttgtagagcttctcgtcctcccagatctgctgccacttggtctcgatggcctgggcgtcataggcggggaagcccgcctcgccgtccctctgggcactgctgtctgccatgaaagtcctcctcaaacgtgtgacctgcatactctagcatgccggtgggggcgagacgctcatcgccacgccctcgaaacgaacccggggcgcgtgccatcccctctcgcccgacaaaaaaagggccctgacctctgccagggcccaagaaggctcgtccagtcgctacgagcggaagttgacgtcggagttggagtccttgaggatgacgtcgtgcgcaccgccctcgacgagcgaggtggaggagaccagcgtgagcttggccttctggcgtagctccgccaggttgagcgcgccgcagttgcacatggtggagcgcaccttggtgagcgaggtgtcgacgttgtccttgagcgggccggcgtaggggacgtaggagtccacgccctccacgaacgagagcttcttggagccgcccaggtcgtagcgggcccagttgcgggcgcgcgcggagccctcgccccagtactccttgacgtaggagccgttgacgttgaggcgacgcgtgggggactcgtcgaagcgggcgaagtagcggcccagcatcaggaaatcggcgcccatggcgagggccagggtcatgtggtagtcgtacacgatgccgccgtcggagcagacggggacgtacacgcccgtctcctcgaagtactcgtcgcgggcgcggcacacgtcgatgagggcggacgcctggccgcggccgatgcccttctgctcgcgggtgatgcagatggagccgccgccgatacccaccttgacgaagtcggcgccgcagtcggcgaggaagcggaagccctcggcgtcgaccacgttgcccgcgcccaccttgacggagtcgccgtagttctcgcggatccactccagggtgagcttctgccactcggagtagccctcggaggagtcgatgcacagcacgtcggcaccggcgtcgatcagcttggggacgcgctcggcgtagtcgcgggtgttgatgccggcacccacgaggtagcgcttgtgctcgtccaggagctcgtcgggacgggacttgtgggagtcgtagtccttgcggaacaccagggacgacaggttgccgtccttgtcgaccacggggagcgtgttgatcttgttgtcccagatgatgtcgttgcagaccttgagggaggtctcggtccccgtggtgacgcactcggaggcgggggtcatgaactccttgaccttcttgccgcggtcgtcgcgcgagacgcggtagtcgcggctggtgacgatgccgcagaacttgccggtgggggtgccgtcctcggtgacgggcatggtggtgtggccggtgcggtcgcggatctcgagcacgtcggcgagcgtcatctcgggcgtgagcgtggagtcggagacgacgaagcccgccttgtacgacttgacctcgcggaccatggccgcctcgtcgtcaggcgtctgggagccgtagatgaacgagatgccgccctcctgggcgagcgcgatggccaggcgcgggccggagaccgcctgcatgatggccgagaccatggggatgtggagcttgatggagggctcctcccccttgcggtacttcaccagcggcgtctcgagcgacacgttggcggggatgttctgcgaagaggtgtaaccggggaccagcagatactcggagaaggtgtgcgattccccttcgaagaacgttgccatgtagggctccttgtctctttgccacgcgccgacatcgccagcacgcctcccgaaaaacttttgaccgattgtagcaccctccccacggggagagtcgcgctaggccccctcgctcatcacgtcgtcgaagttgacggcgatgtcgtgctttgtggggacccactcgaccttcttgaagagggcggcgaccgtgatggggatgtagctcatcatgaagatggggaaggtgaacaggttggtgaagatgcgccacctgcggcccttgcggcagtggatgtgcttcctctcgctcaccgtggtgaggaccgccagcaggaagaagaccacgtacatcgagaggaaggtcatcacaagcgatcccacgcacatggcgagctcggcgttggtggccacgaacccgtgcgagagcgaccccacgatgaggtaggtggcgttcacggcggcggagaggagcgtgaggatcatgccgggggcgatggtcatgagcatgtcgtacgaggcgaacctgcccttgcggatgccgtcgaggaggttcttgttgtatgagaagaacacctggtagaagcccttggtccagcgcatgcgctgcgtccaggagctcttgaagtccacgggctgctcgtcgaagaactcggcaggggcgtagccgatctggatgccgtgggcgcagcagaacgtggagaactggatgtcctccgtgagggtgtggaagttccacccgtgcatgccgcggacgatcttctccgagaccatccagccggagcccgagatggcgcagctggtgcccaccatcatgcgggcgttattcaggaactttgcctcacgcatgaaccagagcgcgtaggcggagctgatccagctggagtcgaagttcttggagttgcggtagctggtgcacaccaggtagcccgcgtcgaaggcctggttcatgacctgcacgtagttgggcgcgatgatgttgtcggcatccatcacgaagaaggcctcgtacttgtcgccgtactcgttgaggatgcggttgaagccgtagtccatgacccagctcttgcccttgcgcacgaggtcgttgcgctcccaggtgatggcacccgccttgcgcgcctcctcggcggtgttgtccgtgcaggcgtccgcgaccacaaagcagtcgataagctcgcgcgggtagtcctggctcaggatcgacctcacgaggttgccgatgaccggctcctcgttgtgggccgcgatgaagaaggcgtagcggtggttcatctttgccttgggcaggacgaccgtgccccttctccacacgcggatgatgtagacgaactggtagaagtaggcgagggtgaagaagagccagatgacgccgttgaagatgacgatgggcgtcagccccatcctgttgagttccaagacagatgcctttcgacgtaggcctaggagaggtctcccacgccaagctggggacagatgcgctcgccagcctccgtgcgacccattgaagttcccttcagcgattctaatacaccgaggaggtcgtccgggaggcggtcagcaagctctatcgtctctcccgttgccgggtggtcgaaccgtatgtgccacgagtgcaggaactgcctgcccagcatgaggttctgccgctcgtcgcccctgccgtagagctggtcacccactacctggtggccaatgtgggccatgtggacgcggatctggtgcgtgcgccccgtgtacaggtgacactcgaggagcgagtagccgtcgtcgcggcggccggcctcaaagcgctccagcgtcgtgaaggtggtgatggcctcgcgcgccatggggtcgtcgctcaccgccatgcgcagcctgtctcgcctggaccgggcgatgccggtggtgatggtcccctcggcgggcgccacgtacccctgcaccagcaccacgtagcgcctgtccagaacgcgcagcctgatgaggtcctgcagcgcccgctgggtctggtcgtccttcgcggcgaccatgaggcccgaggtgtccatgtcgagcctgtggacgatgccggggcggtcgtcgccctggagcatccccaggtgaccgtagccgcagtgcgccacgagggcgtttgccagggtgtcgctcacgtgtccggggctcgggtggcacaccaggcccgcctgcttgctcagcacgatcaggaagtcgtcctcgtagcggatgtccagcgggatgtcggggttgggcgagaggagcccgtcgccgtcctcctcgacctccacattggcggtcacgcggtccccgagcaggacgcgctcgctcttgtcgcgcgcctcagtcccgttgatgcccacctcccccgcctcgatcagccgcgcgcaggcggacctgctcggcatgccctccatcgaggcgaggaagctgtccatcctggcgccgtcgccctcggggcccaccaggaactcgcggaccacgcgcctcacgaggcgtcacccccgcggcgggcgtcccaccaccagtaccccacgagggaggctgcgatgccgcaggtgacgaagatgtccgccacgttgaagacggggaagtccatgaaggtcgtggcgaggaagtcggtgacggagcccaccgcgatgcggtcgaccatgttgcccgctcccccgccgaccacgcaccccaggagcgcggcgagccaggtgggcaggggctcgcgccatgcgagggcgatggccccggcaacgaccgcgagagcgaccacgacgaacaccgccgtggcgccctcccccatgctgaaggctgccccggtgttctccacgtggagcagctccatgaccccgggaaggaggggcctcgcctccccgacggggagggaggccctcaccaccgccttcgtgacctggtcgaggaccagggccaggagggcggtggaggcgagggccgcgaccctgcgggggcggccccccttgtcacgctcgtttgcgggcacgggcgctactccccgtccccgcaggctgcgaccgcctcggagcagcgctcgcagaggccgtcctcgcccagctcgcgccagttccagcagcgcgggcacttctcgccgttggcggggaggacctggcacgagagctcgtcgccctcgtggacgcagacctcggagcacacgaacgcctcggcgaggtcgagggcgccgtcgccggtgaggagcgcgtactcctcgtggggcagcgtgagctccgcgcgcgccgcctgggtcgtcttggcctcgatgaccccgttgcccgcggcctcctcgtacgccttggtgaacgcaccgcgggcctggaccatggcctcgtacgtggcgaggagcggctcgtactcgcccgccgccatcggtgcctggaaccagtccaggagcgcggcgtagcgctggccgtcgcggagggactcgggcaggtactgcatgacctcgtcggtggtgtagacgaggatgggctggaggtcgtgaacgagcatcgagaggatgtacgaccagacggtttgggcgctcctgcgctcgagcgagccgagcacgccgcagtaggtgcggtccttggtcgcgttgaggtagtcgttggagagctccgtgatcacgtagtcgtacagcgtgcggtacacctggttgaagcggtagctctcgtaggccctgctcacctcgtcgtggacctggcacatgcgggcgagcgccagccggtcgtacggcaggagccggtcaacgggcacgccgtcgatggcgaggtcgaactggccctcgagctctccgagcaggaagcggagggtgttgcggatcttgcggtaggcgtcacccacgtgcgagaggatcgtctcgtcgcaggggacgtcggtcgaggtgtcgaccgacgcgacccagagcctgaggacgtcggccccgcgctcgtcgcagaccttgttggggtcgatgacgttgccgagcgacttcgacatcttcctgccctggccgtcgagcgtgaagccctgcgagaccaccgacttgtagggggccacgccgtaggcgcccaccgaggtcatgagggagctcatgaaccagccgcggtgctggtcggagccctcaaggtacatgtcggcggggaacttgaggtagtcgcggtgcctgcacacggcggtgtggctcacgccggagtcccaccacacatcgaggatgtcgctgttggccttgaggttgtggctgccgcacttggggcaggtgcaggcgtcgcccaggtagtccttggggtcgtcggtgaaccaggcgtcggagcccttctcgcggaagagggcgatcacgcggtccagggtctggtcggtgatgaccgtctcgccgcagtcctggcaggtgaacgccgggatgggcacgccccagttgcgctgcctcgagatgcaccagtccgggcgctgctcgaccatggagccgatgcgcttgaccgagtgcgacgggtagaagcggaccttgcccagctcctcgagcgcctggcccctgaggccggtcttgtccatggagacgaaccactggctcgtggcgcggaagatgacgggacgcttgcagcgccagcagtgcgggtagctgtgcgtgatgtcctcgtgcaggatgagcacgccgcggtcgtcgagccactggatgatcttggggttggcctcgttgacctccatgccgccccacgggccgcccgtccccaggccctcacccttgtagaacacgccgtcgtcgtcgacgggcatcaccacggggatgccaaagcgcatgcccgcgttgtagtcgtccacgccgtggccgggggcggagtgcacgacgccggtgccgtcctcgagcgtgacgtagtcggcgtagatgaactcgccctcgacgccctggtcgccgaagatgggctgctcgtacttgttgtggcacagctcgacgccgctcatgtgccactcctggccgtcgctccccttggcgagctcccagccctcgtagccaaacttctggcagtccctctccacgagggcgcgggccatgatctcggcgcggccgtcgaccagcacggcgacgtagtcggcctcggggtgcaggatcacgcagtcgtcggcgggcagggtccacggcgtggtggtccagatgtcgacccacaggttgtccgagtacgcctcgagcccctgcggcaccgtggtcatcctgaacctcacgaagatggcggggctcacctcgtcggagtactcgatctcggcctccgcgagggcggtgtggcagtgggagcaccagtgcacgggcttgcgaccgcggtagatggcgcccttgtcgaagatctccttgaagatctcgacgtccgtcgcgtcatagtcgtgcgtgtaggtgaggtaggggttgtcccactcgcccaggacgcccaggcgcttgaacccctggcgctgcgtgtcgacctgctccacggccatggtcctgcagagctcgcggatcttgacggtggggagctggttgaacttggcggtgccgagcgtctcctcgaccttgtgctcgatgggctggccgtggcagtcccagccggggacgtacggggtctggtagcccctcatcgcccagtagcggttgatcatgtccttgctgatcttgttctgcgcgtggccgaggtggatcggtccgttggcgtagggagggccgtcgtgcagcacgaacttctcgtgcccctcgttcttcttgagcatcagtccgtagacgtcgttgtcctcccagtccttgagccgcttgggctcgttctgggccaggctcgcccgcatggggaagcctgtcttggggaggttcatcgtcttcttgtactgattcgccacctctcgctcacctctctcttcctgggtgccccagacaaagggcgcccgtcccgttctgctgggacgaagcgccctgtggcatgctccgcttgtgaaccacccagcaaggggtctcccccgaaactcggctggcctgtctcggcggccactccggcgacgcctactcacgcccgagggcgctttggggccgcagctccggggtgatcttctccgggacgcgaccgcggtctctcaccatgcccgctctctgtgggtcgcgctggcccgggtactctccccatcacagcaacagagcgcatgatagcacgctgcggcacggccctgccgcggtcggcggcccttaaccgtatcgacacctggggcgcttgccgagcgcgcccgtcacccaagccacacggacgctccacccaaaggacacacctcgcgcgctgcgccgcccgttgcggctcccccgccgattccgcggcggatatcaaagctttccccttccccgttgcgcgagaatctgcctgacaccacggcgaagggagacatgcgcatggccttggaccagagggcgaccgagcggacggcgggggacgggacggagggccccatgagcccggaggaggaacgctacctcgagctcctctcaaggagcttccccacgcagcaggcggcgttcaccgagatcatcaacctcgaggcgatcctcaacctccccaagggcaccgagcacttcatgagcgacgtccacggagagtacgaggcgttcctgcacatcctcaacaactgctcgggagtcatccgcgagcaggtggaccgcctgttctcgaccgagctgggcagcgcgcagcgcgccagcctctgcaccctcatctactacccgcaggagaagctccgccgcatgcacgaggcaggcgagacgagcgacgagtggtacgcccacacgctgttcctcctggtgcgcctggcacggcgcctgagcggcctgtacacgcgctccaaggtccgcaaggccatgcccgtctcctatgcctacatcatcgacgagctcctccacgcctcgggcgagggcgagacgagccgccacgagtaccacgagcagatcatcgcgtcgatcgtggggacggaggccacggacgacttcatcgtgtccctctcctctctgatcaagcgcctggccgtggaccacctgcacctggtgggcgacatcttcgaccgcggaccccacgccgacaggatcatcgacagcctcatggcctaccactcgctcgacatccagtggggcaaccacgacatcagctggatgggggcggcggccggctccgaggcctgcgtggcgtcggtggtgcgcaacaacgtccgctaccacacgctcgacgtgctggagggcgcttacggcatcagcctgagggagctcgcgctcttcgccgaccgcaactacgtggagtacgacgtcatctcccccatggagaaagccatcagcgtcatcctgttcaagctcgagggccagctgatcatgcgcaaccccgactttgggatggagggcaggctgctgctggacaagatcgacgtcgtggacggcacggtcaccatcgacggcgtgccgcacgcgctcaggacctgcgacttccccaccatcaacacggcccatccctacgagctggacgccgacgagaggcgcgtcctcgacgggctggtgcgctcgttcaggtcgagcgagaggctgcgccgacaggtggagttcttgtacgagcgcgggagcatctacctggtgcgcaacggcaacctgctgttccacgggtgcctccccctggaggaggacgccagcttcagcagggtcacctgcgagggcagggagtactcgggccgcgagtacatggacttctgcgaccgcatcgcacgccgcgcgtggcacgtgggcgaccaggcctcgctcgactggatgtggtacctgtggtgcgggcgccactcccccctctcgggccgtgtggtgaagaccttcgagcgcaccttcgtggacgaccgctccacctgggaggagccggaggacccctactaccggctcacccacgacgaggccgtgtgcgcgcgcatcctggaggagtttggcctggacggcgggcgcgggcacatcgtgaacggccaccgtccggtgaaggcgatcgatggcgagagccccagccgcgccggcggtcgcctcctggtgatcgacggcgggttctgctccgcctaccacaagaagacgggcatcgcgggctacacgctcatctccagctcggacggcatgcgcatcaaggcacaccgtcccttccaaagcgtggaggcggccctggacgataacgccgacatcgagagcgacgtgacggtgatagagcgcgaaccccgcgagctcaggatcgcggacaccgacacgggcgccgacatccgcaggcagatccgcgacctctctcggctcctctccgcctaccgggagggcgtcctgagcgagaggaagccctccgcgtaggggacacgccggccaacgggacgtgaagggggaggggccgccatccctggcggcccctcccccttcgtcggtgctcgtctctcccccgcctatgcctcggggtttgcctgatagcgcggcgcgaagccgtcgtcgcggttgaggatgttcatgaactcctcgcccgtgatcgtctccttcttctggaggtagtgggcgatctcgtgcagcttgaagcggttctcgcgcagggtcttgagggcggtctggtgccccgcttcgacaaggcgctggacctccgcgtccacctcgcgctgcgtgccctcggagcaggtgagctcggtgccgccgcccaggtagcggttggtggtctcgcccagggcggtcatgccgaacttgtcggacatgcccagctgcgtgaccatggcgcgggcgatcttggtggccttctcgatgtcgttggctgcaccggaggtcatctggccaaagatcagctcctcggccgcgcgcccgccgcagaggaccgcgatgcgctgctcgtactcctcgcgcgtggtgaggtagtgctcgtcctcctccgcctgcatggtgaagcccagggcgccggaggtgcggggcacgatcgtgatcttggagacgggcgccttgccgtcctggaccgctgcgacgatggcgtggccggtctcgtggtaggcgacgacctctttctcgtgctcggagagaaccgtggacttcttcttctcgcccgcgatgacggtgtcgaccgactcctcgatgtcctcctgcgtgacgcgcttgcgcccaaacctgacggcgcgcagggcggcctcgttgatcatgttggcgaggtctgcgcccgaggcgccgggggtctggcgcgcgacggcgccaaagtcgacgccgggctccatcttcacgtcgccggcgtgcagcttgaggatggcctcgcgaccggcgaggtcgggaagctccacggggatgcggcggtcaaagcgcccggggcgcgtgagggcggggtcgagcgagtcgggcctgtttgtggccgccaggaccacgatgcccttgtggttgtcgaagccgtccatctcggcaaggagctggttcagcgtctgctcgcgctcgtcgttggagttgatgctcgtgtcgcgcttcttgccgacggtgtcgatctcgtcgatgaagatgatgcagggggccttctccttggcctgcttgaacaggtcgcgcaccttggcggcgccgcggcccacgaacatctccacgaactcggatccgctgatggagaagaacgggacgttggcctcgccggcgaccgccttggcgagcagggtcttgcccgtgccaggggggccaacgagcagggcgcccctggggcagcgcgcgccgatctcgttgtacttctccgggtcctcgaggaagctcacgatctcgcgcagcgagtccttggcctcgtcctgcccggcgacgtccttgaaggtcacgccggtgtcctcgcccttgacctccttggcgccggatttcccgagtccgcctcctccgaggccgaagccgccgccaaagttcatcgacgggccgtcgtcacccatcgacttcttgagctggcggttgaagagccatccgcctccaaagatgatcagcagcgggatcccgtacgacaggagcaggtacagccacatgttgctggagtcgtccgggatctcggcggacgcgtccacgtcgtgctcctccaggcggctcaccagcgagtcgtcgttggggaagagcgtggtctcgtagtactggatgctcccgtcctggtccttgagcttgaagcggatctggctgttggaggtgtcgaggttgacctccttcaccttgtcctcgtcgaccatggacaggaagtcggtgtagctgacctccttgacctggctcgagacgatgctggggtacagcgtcgacctcagtgctatcgcgacgatgatggcgatgatcacgtagatgatcatcgactgccgtcgcttcctgttatccatgtccatcgtgggtttctccttctgtgccgcgggcatggcacggcttggtgcctgtttgcctattacccaagattgcacaagtctgtccgccaagacggcgagacccgcaattgtcggcgtcgcggcggactcgcgacgggcacctacgacctgccgcgagagcagagctcccagaacgcgaccgcgctgctcgccgccacgttgagcgagtcgacgcccctctgcatggggatgatcgccgtggagtcgacgcccccgagcacctggtccgagaggccccagccctcgctgccaaagaagagggccaggcggtcgtggcccgcgagcgaggggtcgtctatggggacggcccggtcgtcgagcgccagggccacggtgtggaagcccctctcgcccagctcgccgagaagcgactgcggccagggctccggcgccaccgcccacggcagaacgaacacggtccccatgctcacgcgcacggagcgtcggttgagggggtcggcgcagcgcggtgcgaggacgatcccgtcgaccccgagcgcagcggcggagcggaagagcgcgcccacgttggtgatgtcgacgagcccctcgagcacggcgatgcggctggccccgtcgagcacctcccccagccccctgggacgcggcctcctcgcggcggcgaagtagccccggtgcacgttgatccccgtgacgccctggagctgctcgcgcgtggcggtgtagacggggacgtccatggacgccagggcggggacggtctggagcaggttgtccaggtgcctctcgtccaccaggaccgactgcagctccaggccgcgctcgacggcgaccttgatgacgaggagggactcgcacacgaccatggcctgcgacgggtcggcgaggctcctcagctgccggtccgagagccgcgtgtacacgtcgagcctagggtcagattcgtctgctatccgtgtaattgtcatctgtgcaccaaccattcaccccttcgctttcccgaggggtagaataccccgacaggaaacaaggcgcgcccgtgccacgatgccggcgcgcgatgagggagcacacgtgcaagacgacaaggacaacaggcaggaggacgccccccagggcgatcccgccaagaccgtgctggcacccaagcccatcgtgcccacgcacctctcgcatgacgctgcgacgagggcgcaccacggcgaggggtctggcggcaggcgcaggtcgggcaggggagacaagcctcgcagccgcaaggggggcattcccaagggcgccaaggtggcgctggtgtgcgcgggggtcgttggcggcgtctacctgggaggggtcgtcgcctggtcgagggtcctcatgcccaacacgaccgtgaacggccaggacgcctcgctcaggaccgcccaggcggtcgcggaggagaaggccagcaccgtcaccagctactcgctggcggtgtcgggcgaggggatgtccctcaccgttggcgcatcggacatcgactacgcgagcgggaccgacacgatcgcgcaggcgatccagtccgcctccaacgcgtggctgtggcccgtcaacgtggtgcgcggcaacagcatcaccgtgagcctctccccctcctacgacaaggacaagctcaccgcgctggtcaaggccgcggtcgacagcgtcaacgcgaacgcgaccgcgccaaccaacgccacgatcacctacgactcgtcgagcaagacctacgtggtcacgcccgagcagcagggtacctccctggacgagtccgccgtcgagaaggcggtggaggcggccatcgactcgggccagaccacgctcgaactgggctcggacagcctgcagcagcctaccgtcaccaaggacgacgagaacctgaagactgcggcgagcaccgcgaactcgtacctcgccgccacgcagaccctcaccgtcaacggtgcgacggccaccacggtggatgccgacaccatctccaagtgggtcagtgtgggggacgacctctctgtctccctggacaccaacgccatcaccacgtgggcgacgggcgacctgtccaagcagtacgacaccgtcgggacctcccgaacctacaccacgccgtacggcaagcaggtgacggtgtcgggcggcacgtacgggtgggtgctcgacggatcgtccctggcgcagaccatggcggcaaacatccaggcaggcaaggcggcctcggtcgagattccctggaagacctcggccgcgacctacaatcccggtggcgccgactggggcagccgctacatcgactgcgacctcaacgagcagcacgtgaggatgtacgacgacagcggcaacctcgtctgggagagcgactgcgttaccggcaacacctccgaggggcacggtacgcccgagggcgtgtacaccatcgactcgtacatgggcaccaaccagacgctcatcggcgaggacgagaacggcgacggcgagcccgactacaagagccaggtcagctactggatgcccttcgtgggcaacatggtcgccttccacgacgccagctggcgcagctcctttggcgggaccatctaccagactgacggcagccacgggtgcgtgaacctgccgtccgatgcggcaaagacgctgtactccctcgtgaaggtcggtgacgtcgtggtggtccacagctaggcggagccgcgttgcaggggttagttccttctccaggatgtgggtggccttccgttcccagcgttttgggacgggaggcctcttcatggggagagggacgcgggcggcgtgcccccgaaccctcccaccggccgcccgggggactgggcccgcaccaagggcggaccagcgggaggcatctgaccagatgcccatgggaacatgcaggtctgctcctggcaaagccgaagacgcaaagggcaacgcaaccagccagcccgtgcgaacccgcattcacccagaggatggaagggcggccaatggcaatgtcccgctctcctcaagcccactcgttctccgcggcatatgcttagcttccctagacctggcgcggttttggcggcctgttgcttagccgcactagccctcgcagccacgtgagcactcacgaggagcgccctgccacagtgccggcccccttggcatgctgccgacctcaagcttcgagcaacgccgaccacgacggggaatcggggggctaagaatggatcgggctgaccgccttccgtgcaagccggccactccatacgtgacaggttaccagggcacattctcggagcccttctccgcaggtaagattcacgccgcggatcgggcgcctcccacgacggacccgccggcggcaaactcccgatgtgagcgcttccgcgtggttccagccgccatgccagagcgtcggcatagcgttgccccagttgcttttgcataagcctttcaactttggcagcaaactcccgatgtgagcgctcatatcaggaagcagctgccagtcggaggtagaaaaagagccaatttgcagaatactcctgattcgtgtacacacatccggcgcccgctgccagggagagcccagcgaatcgcatccccgcagttggggtgcaccggtcgggtcaccattgatagaaaactcccgacctgggtgctcatatcgggccacagctgccatctgcatagggaaggggaatggttagcaggaactcgctctcgtgtacacgtacgtgactttccgtcaggattggacccttgaccgagcgccagctggggatatgccttgcagaaaagccctcggtcaagaatcgcgtcgtgtgagcgcgcgagcgacgcgacttctgccagccgcccgcgaagggccagactctcccccgcgaaagggaccacgccacctcgcgcggcagcgctcccggagggccggatggggagtgccgtgcgcgcggctgccctcaccggctgggaaggcttgtccgtgacccacgctcacgcgtgccgggagtccctccccttccccgacttccgggcgcgcggagccgccttccgacgggaggggtgcggagccttggcggaagccggcctcgtaagatttgacgcgtttagggtcacgtaaacgcacgaagtcttacgaggtttcgagtttcgtaagaattgacgcggttagccgccgcctaaacgcatggaatcttacggtgcgccccggcgggcaggttgcgacgggggagcacccgcggccaacgcgcatggcctcagccacggaagacgcccctctcccctcctttgagccattcaaaccggtgcggacttggcgcaaggcccgagggatggcggcaaacgaacggggcacaccgaaccaattcgttggcccgatgtgccccgctatcttgcccctctcgcccagcgatgcctcgcgcgggaggaccctagaacttcttgcccccaagcttggcgatctggtccatgtccatgttgcccaggccgttcatgccgccgatgcccatgttcttcatcatgccgcgcatctggcgcatctgcttgcgcgaggtggagcccttcttctttcccttgggcgagacctgcgtcatctggcgcatcttgcccatcatcttgttcatctggtcccactgcttcaggacctggttcacgtcctggaccgtgtgaccggagccagccgcaatgcgcttcctgcgctgcccgttgatcttcttgggcttcttgcgctcctccttggtcatcgatcggatgatcgactcgaccttggtgagctggctctcgtccgcctggttgcccgcctgctggagcatgcgctcgccgccggggagcatcccgatcatcttctggaggccgcccatcttgcggatttgttgcagctggcccaggtagtcgtccatggtgaagccctcgagcagcatgcgctcggcgtcctccacctgcttctcgtcggcgaccttctgggcctgctcgatgatcccgtagacgtcgcccatgcccaggatgcgctttgccatcctgtcggggtggaagacctcgagggagtcgggcttctcgcccatggagacgaacttgatgggcttgcccgtgacctcacgcaccgagagggcgccgccgccacgcgcgtcgccgtcgagcttggacatgatgacgccgtcaaagtccacgcgctccgcgaactcgcggacgacgttgacgatgtcctgtccggtcatggcgtccacgaccatgaggatctggtcgggcttgacggcggacttgatgtccaccgcctcctgcatcatctcctcgtcgacctgcaggcggccggcggtgtcgacgatgacgatgtcgttgaggtggtcgaccgcctcctggatggagccgctcgcaacggcgaccgcgtccctgccgtcgccgcggaacaccgggactccgatctcgttgcccagcgtctgcagctggtcggcggcggcggggcggtgcgtgtcgcatgccgcgagcagcgggctgtggccctgccccttcagcaggtaggccagcttggccgccgcggtggtcttgccggagccctgcaggcccaccagcatgatcacgttgggcgtgcggttctgggccaggacgagctttgactcggtggagcccagcagcttggtgagctggtccaggacgatcatcaccacgttctgcgccggcgtgagggagtccaggacctcggaggtcatgcacttctccttgcaggccgagacgaacgtcttcaccacgcggtagttgacgtcggcctccagcagcgccatgcgaatctcgcgcatggcggagttgatgtcgtcctcggtgagacggcccttgccacggagcttgtcgaaggtcccctggaggcggtcggacaggctgttgaacatgatgagctactccccctctccgtcgcccacgagcgcgcgcgagaactccgccgcgtcgaaggactggaggtcgtcgatgccctcgcccacgccgatgcggtagatcggcaggccgagggtgtgtgagattgccacggcgatgccgcccttggcggtgccgtcgagcttggtgacgatgagcccgtcgaggtcgagagcctcgttgaactccgtcgcctgggcgaggccgttctggccggtggtcgcgtcgatcaccaggaccacgctcactggcatggtggcgcgcttgcgggtgaccctgaccaccttctggagctcgcgcatgagctcgggcgaggtgtggagcctccccgcggtgtcgataagcacgaggtcggccgagtccctctccgcgcgctcgaggacgtcgtagcacacgctggcggggtccgccccgcgctcgcgcgtcacgacctcgaccccggagcgctggccccacacctcgagctgctcgattgccgcagcacggaaggtgtcggccccgccgatgaggcaggacctcccctctcccctggcgacgcccgcgagcttgcccaccgtggtggtcttgcccgcgccgttgatgcccacgaagagcacgcacgagggaaggtcctcgaaggggtcgcgctccgcggtcgcgaactcgtgcgagatgcgctccgccaacgcggccctgagctgcctcgccgtgcgaagcccctccctcgccgcctgctcgcgcaggtcgtccgtgacgcgcatggccacctcggcgcccatgtcgtccataacgaggtggtcctcgaggtcctcccagaagtcctcgtcgacctcgccgcccatgtagaagatctcggagagcgtctcgcgcgagcgagagaggcccttcctgagccggtccctaagtcccatctacgcctgcaccacctttcccgtggagcggtcgagccgctggctcacgacgtgactcacgccgtcggcctgcatcgacacgccatagagtacgtccgcctgctccatcgtcctgcgctggtggctgatgacgatgagctgggtgtcctccttcagcagctcgatggcgtcgagcagcttggagaggttcgcgtcgtccagcgccgcctccacctcgtcgaagacgtagaaggggacggtcctggtcttatataccgcaaagagcagggcgagcgccgtgagggacttctcgccgccgctcatgagggtcatcttctggatccgcttgccgcggggctgggcgacgatctcgatgcccgtctcgtccaggtggtcggggtcggtcatctcgatgtgcgcgtggccgccggggaagagcatcgcgaagatgtccgtgaagttggcgttgacgcggtcgaacaccaccaggaactggcgccgcatcttgcgctcgatcgcctgcgtgatcttctgcagcgacttcctggcccgctcgaggtcctcgacctgcgcgctgatgtagtccgcgcgtgccttgagccgggtgtactcgtccatcgcgacctcgttgacgggaccgatgccggagagctgcttgcgcaggcgctccacctcgcgctccatcgcctcgcggtcctcgggctcggggagcgcgagcgcgtcctccagcacgtagccgtcggcggtgatggcctgtatggcgttctccacctggacctcaagcctgcccatctccaccttgacgtcgttggcggtggtcttggcgccctcaagctccgtggacgcagcgtcgaccgcctggcgcgcgtcgccgatggtgcgcttgagcgagtcggagtcggcctcggcgagggacgcgcggtccttgagccgtgcagcccacgcgagcgcgcgctcgtggatggcgtcgtaacgctcgtggaggggttcgaccctcagcctcagaacgtcgagcgcggctgccccctgctccgtctgctcgcgcctcttgtcgatgtccgcaacctggcgcgcgagctgctcctcgcgaaccgcgaggtggttcctgcgctcggacaccgtggcgagcttgagcttggcctccgagagtctcccctccaggtcgctctccttgcgtgacgcctgctggcgcttgcccgagacctcgtcgagctcgtcggagagacgcgcggcacgctccttggcggcctccgcggcggccttgtgcctctcgacctcctggcgtgccttgcccgtgcgcgccgccgcggcctcgcgccctttggtcacctgggcgcgctcggactccgccttgcggatctgcgcctccaggcggcctatctccgccgtcacggacgacaactcgccagacaggcgcgcgacctctccctttgcctgggcgctcccctcgcgggcggaggagaggcgcgtctcggcggcggagatcgccccggtggcatcggcaagggcggactccagctggcccatcccgtcgcggagggagcggatgcgacgcttgcgctcgagggccccctgctcggcgttggacgcgagccccacgtaggtgcgcccgtcgggcagtacggtgaccccctcgggcgtcacgaacgtgagccccggtgcgctggcatgggcctcgagggcggcgcgggcgtcggggaccacacggaccccgcccagcaccgacaagaccagcccgtcggcgtcgtcgcgcacgcgcagcctcgcgagcagggactcgccgggcaggccgtcgtcgtccacatcccccctgcccgcctcgtccatgctcacgatggcggcgcggcccttggccctggaacccagggcgtcctgggcgagtctggctgcgtcgtcgccggacgagacgaccagcgcccccaggtcgtcacccaacaggcgctccaccacgccctcgagctcgtcgggcgcctccacgaggtcggcgaggcggcacctcaccaggctgccgtccggccccttcgtgagcgatgccaccagctgggacgagttctgagcctgctcgtccacggactccagggcgccgaggttggcgcgggccttcgagagcctcgcgcggctctcctgctcagcaccgcgggccgccttgacctcatccttgcacgacctgatggcgtcgtccgcctcgcgctcgcgggaccgcgcggcctcgagcgacgcgcggcacgtctcctcctgctccctgcgctgcgagagcgcctcggtcgcggtggccaggtcatcggcgatttgatcaaggcggctctggaacatgccgtcctcgacctcggagttcgagatctggtcgcgcagctttgcgtactccagcgtctcctggtccgcctcgcgctgggcggcgcgctggtctgccgtgagctgcgactggcgggacccgagccttcgcctctcgtccgccgcgtcctttgcctgcggcccaagctcgctcacgcggccccgcagctcccgcgtgcgcgcggttgcctcctccagctcctccgcgaccttggagtgctcgccctccgcctgcgcgcgctgccgctccatggcggagaggctcatgcgcatctcggagaggcgcgagaccatgttcttgcccttctcctcgagcaggcgcatgtcggagtccatgcgcccgaggaggtcctgcatcctgcggcgctgctcgcccaggtcgcccacgaagatgcccttctgctccaggagcgactggtacttctccaggtcgtggttcttctcgtccaggcggtactgggcaagctcgatggccgcgtcggcctccttgccgcgttcggagaggcgctggtagcgcgtctggagctgcctgaggtcgtccaccgcgagcgtggtgttgagctcggcgagccgcccctgcaggtcgtgcgcgcgctttgccttgtccacctgtcgctcgagcggcttgagctggcggttgatctcgcgctcgatgtccttggcgcgcgtgaggttctcctgcatgccctggagctttcgctgcgagcgctccttgcggcggcggtgcttgctgatgcccgccgcctcctcgatgagctcgcgccgctcctcgggcctgctcgagaggacgctgtcgagcttgccctggctgatgatggagtgggtgtccttgcccagtccggagtcgtgcaggatgtcggtgatgtcgcgcaggcgggcgggcgcgccgttgatcaggtactccgactcgcccgagcggtacatcctcctcgttatggcgacctcgccaaactcgatggggagcgtgtggtccgagttgtccaggaccagcgtgacctccgccagccccaccgcctgccttccggaggagccggagaagataacgtcctccatggcctggccgcgcagcatcttggcgctctgctcgcccaggacccacaggatagagtccgagatgttcgacttgccgctgccgtttggccccacgaccacgttgaggccagggtcgaagaccatggccgtgcggtccgcgaaggacttgaaacccttgagggtgagcgacttcagatacacgtgccagacaccttcccgagagggggactactccccctctccccccgccgcgtcgtcttggccgtcggagtccatgtaccccatgcgccgcagcgcgtcgagcgccgcctccgactccgactccttcttcgaggagcccgagccacgcccgacgcgcgcgccgtccacgaagacgacgctcgtgaaggtgggcttgtgcgccgggccctcctcgcccacgagcttgtactcgggggcacagcggaggtcgcgctgggtcacctcctgaaggcgggacttgggcgagaggggcctcttcgcgatctggggcgacatgtgcggggcgagcgtcctcgagacgaactcgtgcgtgacctcgaacccggcgtccaggtagagcgcccccacgatcgactcgtacacgttctcgagggccgagtgcatcccccgtgccccggtgcccctctcggactcgccgaacacgatcacgctgccgatccccaggtctcccgcgacctcgctgagcgtcttccccgagacgagcgagatcttgagccgcgtgagctcgccctcgtccatgctgggaaacgcctcgaagaggtcggtcgcgaccatggcacccaggatggagtcccccaggaactcgagcctctcgtacgaggccgacacgggctggttctccaccgccgacgggtgcgtgatggccgaggtgatcagccgccggtcctcgaaatgatggccgacgatctcctcgacgcgcgcgatgctcttctcaatccccacccagctcacctactgggcgctctcgatggtcttgacggcgtcgccgatcgtgacgatggactgcagctcgtcgtcggggagctccttgccaaactcgtcctcaaacgaggtgacgagctcaagaaggtcgaaggagtccgcgccgaggctcttgaactcggtgtcctcgccaagggtggaggggtcgacctccagctcgtcggcggtgaggccgatgaccttctccaggatctgatcgtggctcatggttgcctccccatcgtgcagccggccgcggcaccgagccacgaccggcagattaacgaatcctgacgattgtaccctgttggggtaccccaagccctacgagacctgctgcgccaccttgtccacaagcccttcgcggaccgccctggcgcaggcgagagtgccgttcttcacagcctcgcgcgaggtcgccccatggccgatgaggacgggcgccttgacgcccaggagcatggccccgccatagtcgtctccggagagctccgacgccaccgccttgagcgagggcttgaggagagcggcgccgagctttgccctcgtgctctgctccactgcccccttcacgcggcccaggatgaacttggccgtgccctcgatggtcttgagcgcgacgttgcccgtgaagccatccgtgacgaccacgtcgtagcgccccgccaggatgtcgccaccctcgcagttgcccttgaaccagcccgcgtccccgcacgcctccgccagcgcggcgtgcgccgccagggcggcctcggagcccttggtgtcctcggagccgttggagagaagcgcgaccgacgcgtcctcgacccccagcaggatgtgcgagaaggcacgtcccatctgggcaaactgcacgatcatctcgggccttgcgtccgcgttggcgcccatgtcgcagaagatcgtgtctctcccggagaggccggggagcgcgctcgcgatggcggggcgcttgatcccgcggatcctccccacgtgaagggtggcggcggcgaagatggcgcccgtggagccggcggagaagaacccgtccgcctcccccgagcgcaccgcctggcagccgcgcacgatgctcgagtcgcgcttgaccctcacggcgtcggccgggtgctcgcccatgccgatgacctcgctcgccacgagggcgcggaccctctccctcgaagccgcgaacggcgtgaccacgtcctgcggccccgcgacgaggaccgagagttcggggtctgcggagagtgcggcgtcgatgccgtccaggacgacctcgggaccctcgtccccgcccatcgcgtcaacgcagatggtagtcatggctcctccagaccggggcattgccccaatgtgaaaagggaggccaaccccggcaggggccgacctcccaggctcgttgagcttggctctgcgctactcggtgacgacgacctcgcggtccttgtagtagccgcagttggggcacacgtggtgcggaagcttaggggcgccgcactgcgggcagacggaacgtgccggagcggcgagcttgctgttggccgaacgacgagtgtgcgtggcgccgcggccctttttctgcttgggaactgccatcttgacctctcttacatagctgcacgccaggcacccgcccgacgatcttgcctgtgaacacgcgagaactgactataccacgtacgcacgaacctcgcacgccgacagaaatactacattcgcgggcggactattcctcgacgggtcgaccctcgccatcgcccaggtcgaggtcgcgcagcgccgcgaacgggctcgcgtcgagccgctccttctcgcgttgggcctcgatctgagcagcgtgcccgcaatcctccttgttgaggtttgccccgcacaccgggcacagacccttgcagtcgggctggcacagcaccacgaagggcgtctccatcaccagcgtgtcgcggatcgcctcgcccaggtcgaccgtgtggtcgtctcccaccagggcaaagtcaacgtcgtcctcgtcgtcgtccgcctgctggtcttcactgggcgcgtggaagagatagtactcgtccacctcaccgtccacgtcaaactcggcggggtcaaggcaccggtcgcacgtccccaccacgtgggcctttatcatgccggtggccaggatcccctcgcccgcgttggtgagcaccaggtcgtagtcgatcccatggggaaggtcaaagtggtgcccgcccagctcgtagcccgcctggggaacgttccccttgacggagagcgtgtcaccggggttctcgagcctctcgtccagaatctgccttacctcgagcatggcacctaccagttgacgtcgttggtctgattgcgcgggccggagttctcgtcgagcgtctggcgcacgcgggtgacggacgtggtgagcgacttgaggttgtcctccaggtgcgcaagcacggtgtcggcgtactcctcggcgttgtagcgggtgtcgcgctcgtactgggtggcgcggtcacggatgtcgtcggcctgctgctgggcgagacggacgacctcctggtcccccgcgaggatcatggcttgctgctgtgcgtctgcgatgatggagtctgcctgctgctgcgcgcgctccagggtctcggcctcctccttgacgatgcggcgtgcgtccgcgaactcctgggggaacacgcgccggatctcgtcgatgatctcgtagacgtcgttggcgtccacgatcttcttgcccgctccgcccgcaaagggcgtcttgccctcgctcacgatctgctcgagctcacctaccaggctctcgatttcctcacccggctgcatgcggggctcctttcgttcctgcttgcgacctactgccgcccataaactacgattcaggccgcatcgaacccatggtagcagattgtatattccccccatgcccaatgctgcccaccagcgggcgagcgcatgaagtctcccgttggggcgtgggaccaagggggttatgcaaacctctggatgggagaggagagccctactcgccttgccccgtcccgtagtggcgcgcgagcgcctcctccacgaccggggggaccaggaagctcacgtccgagccgaacgaggcgagctccctcacgatggatgacgagacgtagccgtactcggggctggacatgacgaacaccgactcgaggtccggcgccaggtggctgttgaggtccgcctgctgcagctcgtactcgaagtcggtcatggcgcgcaggcccttgaccacggcgctcgcgccgacctgcgcgcagaagtccaccagcagccccgtgaagggctgcacgtccacgtcgcgaagcccctcagcggcgagggcggagcggagcatctgcacgcgctcctcgagcgtgaaggcggtccccacgccgcgcttgccgaccgacgccgccacggccacggtcacgcgggggaagagcctgcgcgtgcgctgtatcacgtccaggtggccaaaggtgaccgggtcgaaggtccccgggaccaccacgtgcgtctgaacgccctcactcatgcgaaccacccagcctccagagggacacggccgtgatgccccgtcccctctcgctcaccaactcggcaccgtcgacgtccaggtcgggggcgtcggcggaccgctcgtacaggatcacggcgccgtcgcgcaggagccctgcggcaccaaggtcccggaccagccccgagaccgactcggccgcgaccgcgtagggcgggtccaggactacgagcgagaagggcccgccggggaccctccccctgcgcgcgagggcgagggcgtctccccttgccacggtcacgcgaggcggctttgcccccagggcctcggcgttggagcgcacgcagcgcagcgccgcggcatcgcggtcgacgaaggtgcacgccagcgccccacgggacaggagctcgaagccgatcgccccggaccccgcgaaggcgtcgagcaccctcacgcccgagaggtcgaggccaaatgccgagaggaccatcgacgccatggactcgcgggtcctgtccatggtgggacgggtcactcccctgccctccgggacctggatggacctccccctccaggcaccccccacgatcttcacgcgcgccaaccgcccacgtcccttcatgtgccccgacgctggcacgggtccgccccgtgccaaacccggtagatgctaccgttccaaacccgccatttccaccccgcgcgaccgggcgcccgggacgggacctaggccctctcgacctcctcgaagtagccgccaaagcggtcctgcgcctcgatgcccagggcgaggtcgccgggcgccgacagctccgggtcggcgtcggcgatgcggcgggcgtcctcgtgcgccgcctgggcgaggtcgccgtccaccgcgaggtcgctcacacgcagcgacacgccgccgtgctgccggtacccgagcacctccccctcgtgcctgagcttgaggtccagctccgcgagctcgagcccgtcggaggtggactccagggcggagaggcgcttccgcgccgcgctgccgcgctttgccgcgcactccaggaagaccgtgccggcgcagtctccgcgtcccacgcgccccctcagctggtgcagcgtcgcgaggccaaaccggtccgagtccagcacgagcatcaccgtggcgttgggcacgtccacgccgacttcaatcacggtggtcgacaccaggacgtcgatggcgcccgacctgaagtcgtccatcacccggtccttgtccgcggccgagagccgtcccgtcacgaggccgaccgagagccccttgagcggcccgcgggcaagacgcgcctgcgtggtcgttgccgagtggacggtcttggtggacgagcgcaccccctcggggacgtcatccagctccgagccgtcgtccgcgtcgtccaccagggggcacaccacgtaggcctggtgtccctgcccatgcgcctcgaggatggcgccgtaggcgaggtccaggcgctccggcgggatgaccttggtgctcacgcccgcgccggcgttgggcctctggctgatgcgggagcagctgacgtcgccgtagagcgtcagcgccagcgagcgcgggatgggcgtcgccgtcatcgcgagcaggtcggcgcccggccccttcctcctgagcgcggcccgctggtccacgccaaagcggtgctgctcgtctatcacgacgaggccgagacgggcgaacgcgacgtcgtcggagaggagggccgtggtgccgaaggtgaccgagacctcgcccgaggcgacgcccgcgacggtccggctccgctcctccgccggggtcgcgccggtgaggaggcgccagctcacgcccgccgcgtcgaggagcggtccgagcttctgcgcatactgcgtcgccaggaccgacgtcggcgccatcatggccgactgcgctcccccgtccgccgccgcggcgatcgcggcccccgcgacgaccgtcttgcccgtgcccacgtcccccagaagaagccggttcatcacgtgcggggacgccatgtcgcgcaggatgtcgcccagggcggcctcctgctcccccgtgagggagaagggaagcgccgccgtgaacccagcgagcctggggccgtccaccacgtgggagaagggcgtgatgcccctcagctccaggtgctgccgcgccaggagcgtgatctgcaggcacagcagctcgtcgtaggcgaggcggcggcgggcctcctccgcggtgtcgaggctcgacgggaagtggacctcgcgcagcgcacgggagagcgacatcaggctgtgccgtgccacgagttccggcgggaggaagtcgcacacgtcgcccgcatccgccagggcgcacgagacgatgcggcgcatccacgaggcggagatgccctcccccaccgggtgcacgggcaggatcctggcgcggggggaccgcccctccccctccccggaggcgtcgccaccgtccccggaaccctccaggacctccaggaacggggacttcatctgcttgaagccgtaggcgaactccacgcgccccgagagcgcgacgctcgtgcccaccttgaggcggtcggcaatccagggctgccgaaagaacgttgcctggatgacgcccgtctggtccaggacgtaggcctccacgatctgcaggttggggcggggccgcttggacttgaccctgtcgaccgtccccacgaccgtgacctcctgcccaacgtcggcatgcgagatgggcacgacgcacgagaagtcgaggtagcggtgtggcacatggaggagaaggtcgcggaccctcttgatccccaacctctcgagcgcctcgcgacgctgccccgaaacgtacctgaggtgcgaaacgtcgtcggcgagcgcgctggtcctccccaggcgctcgccgacctctgcgattgttgggacgcgtccgcccagagccaaggtctactcgatcgagaagaccacgggatacaggggctgctcgccgcggtgggagtcgacctcgaggtcgggctgggccgcctcgatggcgtcgatcaggtgcttgaacgcgtcgtcgtccaggtcgctgccggcgaggatggtgagggtgtctccctcctcctcgtcctgcatgcggttgatgaccttgagggtcacgtcctccacgtcggaccccacgacctcgatggagccatcctggatgcccatcacgtcgcccgcgtggatgggggtgccgtctgccgcggcggagtcgcggaccgccgtggtgacctcgccgtcgcgcacctgcgagatggcgtcggtcatctcgtccacgttggactggaggtcgccctccccgtccgccacgaacatggcggcgaacgcctggggaacagtcttggtggggaccacggcgaccttgctcgcggtgcacgcaccggcagcagcctcagcggccatacggatgttgccgttgtcggggagaacgatgacctggtcggcgttgcactcctcgatggcggcgaggatgtctgcggtcgaggggttcatggtctgccccccggacaccacgacgtccacgccgagcgacttgaggatgtccgcctcgccggagcccgccgcgacggccacgaagccgagcgccttgcgcggcgcccttgcggcggcggcagcctccgccttgtcctggcggatgccctcggtgcgctcgtgggcctccaggtccatgttgtgcacgaacacgttgaagatctgcccgcggtgcagcatgtggcgcagcacgcggtcggggcggttggtgtgcacgtggatcttgtagtcggggttggagcccaccagcagctcgcagtcgcccatggaggcgaggtagcggaggttggcctcctcgtcgaagtcggggctgtcggcacggaacaggaactccgtgcagtagcggtactgggagccctcccagtcgtcgttgatctcgatgtccaccacgttggcgacgtccgccttggcgtcggacgagtcgacggtggtcttgaagtcggacacctcgccggccttgccctcgtaggcgttgacgaagccctcgatgaacgtggcgagaccgaaggcgccggagtcgacgacgccgttctccttgaggacggggagcaggtcgggggtgcgggcaacggactcgtaggcctcgaccacgatggcatcgagcgtctcgaccgggctggcctttgccttctccatctggtcggcctttgccgagacgtccttgaggacggtgaggatggtcccctcgaccggcttgcggaccgccttgaaggcgaccttgaccccgttgcgcagggctgccgcgatgtccgacgtggtcgcctcgggcccgcgcgcgcccgcaagcccctccgcgacgccgcgcaggatctggctggtgatgacgcccgagttgccgcgggcgcccatgagggagccgtgggtgatcgccttggcgatgtcctccatcgaggcgtccttggggagggcctcgacctccttcacgacggtccccagcgtgagcgacatgttggtgccggtgtcgccgtcgggaaccgggaacacgttgagcttgttgatctcgtcagccttgtcggccaccaccttggcggcaacggggaaacaggttctaacggtctctgcaatcatggcttggtaaacctcggttcttctctatgacgggagcgaagcgcctagcgggtgcgcattccctcgatatgtacacgcacctcgacgccatcaagctctgcgatctgcttgagaatgaacttgaccgagctctgcaggttgcccgagacggatgccatgttgacgccctgctccacgatcacgtggaggtcgaccacgaccttgccctcctcggtccccacgtcgatgcccttgcgaagccggttggcgggaagcaggcgggcgacgccctcctgctggtcgatgtcggccatgccgacgacgccgtagcactcgagggcggcatagcccgcaaggtcggcgatgcagtcgttggataccttgagggtccccggaacgacctttgccatagtgtctcctctcgcctggccaaaccgcggccgcagcatgtttctcccgcaagtataacgcagcgtaggacagcgacggcttcccgcatctgcggctatgtggtgcctctcgcccacagacgcgtgattctgttccaatttggacggatccgcaatggagaactggtgtctgcccacacggggtttccacgcgtgtccaaaaaacctcctccctctgctagaatccgtccccggtgacacgaggtggactccctcgaatgctctgccaccagaagcccttaccagctgtgcacacaaccgacacattcgttgtgcccgtcgcgtttgcagcgtgggaaggctgtgctatatttggacagcttttggtcgtacgtgacgcagcagcgtcaccctatggaggtcgtgaacatgtcgaaggtctgtgatttctgcggtaagcacgctgttgctggtcgctccattagccactcccaccgcaccgtcgcccgcacgtttaagcccaacatccagcgcgtcaccgtctatgtcgacggccgcgcggtgaagaagaacgtctgcacccgttgcctcaagaagggcaacatcgcgcgttcgccctaccaggcgtagcgacagccgccggcacacgtcggctcacgattgcgattatgcggggaggccttcgggcctcccctttttcgtgcgcggtaaggacgggccgtcgcccgcccccaagccccgtcacaggatcaggtacgccaccaccgcgccggagtcgcaggtcaccgtggcgtccgcgtcctccaccacgttggagacgggctcgtcccccagcagcgggacctccttgcggtcgagctcccacttgagcccgcgctcggacagcgtggtgccgggcgccaccgcgatggccgagaaggtcttgcccacgcccctctcgcccagttcccaggaggcctgtccgtcgggcgagaggacccggcactcaaaggcgtcctccacgatgcgggggcaggcgtccgcggcacgcacgaggacccccagcgccgcgagcgcgtggtcgggccgcccgcccgtggcgcacgtgacggtgaggcggagtgccgctccccttcgcgcggcctcgtggcgggcgcacgccacggcgatggacaggtcggtgcagtacttctccgagggatactcgatctcgcgcctggtgccggagcgcgcccaggcgagcgcctcggggtccaccgagtcgccgtcgccgcacaggaggtcgggcctcactccggcgtcgagcagggcacgcgcgccacggtcaaccgccacgacgaagtccgcctcgtcgctcagcccctgcaccagggaggccgagctgggctcgggggacccgtccaccagcagcgcgcgcatgatgcccctcgtcctggttggagccggctcgtagtcgcggatgatggggagggagacgtccacgtagccatggctgaagatgtccgcctgctggcggcagaaggcctcgtccctcccgtcgtggtcgttgtagatgcacacggtcctcaggcccacgcgacgggcggtgcgtaggccgaagggggcatcctcgaagagccaggtggtctggacgtcggtccccagcctcctcagggcctcgaggtagacgtcggggtagtccttgctgcgtcccacgtcgcccgcgcagatgacgtcgtcaaagcagtcctcgatgccatgcgcggcgagggccacccgcacctcgggaaccgtggtggacgaggcgacgatcatcctgaccccggcatcgcgcaggctgcgcaggaactccccgcagccggggatgaggggcaccgtggtccggtacgcctcgcgaacgcgcctcttgacctcggcgaggatctgctcgcccggcaggggcacgccgtactgcgagtggaaggcctcgcacatctcgcccagggagaggggctcggtgacctcgtagacgtgctccacgttgggcacgccgtagtcgcgcagcagctgcacgacgacgttgtgccacatgggcatggagtcaacgagcgtcccgtcgcagtcaaagatcgccccggtgattcccatgcttcctccccctggccacgacggccctggataccaatattcagcgtgcaaaattcatggtagcagcatgcggaacgaaaacctcgccatgtgtcgcacccctcttgggtacagtaaacagcgtggccgcgaggccacttgttatgtgcgaccttatcttggaggatccaatggctcgttatgactacaagtgcacctcatgcggtactcagttcgaggtcgagcaccccatgagcgcccatcccagggtcacctgccccaagtgcggtagcgaggcacagcgtgtcttcgagacctcggggatcgtgttccagggctctggcttctataacacggaccagaagggcaagaagtagccccttttgagcggtgggtgcgagagagaccgcggcgtcaggtggcgtcgcggtctatttttgtggggagaggagcggaggctctcgcactcgacccatccacccgtgccatggcttgacttgcgagtccccctccaaggcatacctgccggatagacggaagagccctcgtcaatcccaatcagagggcccttgggccagagaagggagaggggcgcctcacccagcgggatgggcaaccgtcgggacggggctcttctcccccgccgaagtcattggcgccacgtgctgggcacacgacggcaggacccgtgtcgggaatctcgcggcgtgtgtgcacacgtcatacaacttccgacgcgaatccatctctcccagcacgttttcccagttggtggcacgcaataaatcccactcccgtcagaaacctcgtcccgcgtgtacacgcgggccgggatattagacatgaaggacgcttgcggccccgccaaggtcagaaattccgccccacgtgtacacacgggacgaggttcccgacatggactcgtcaaggtggagcgtttcccctgttggccggaagtatcggtctctccccagtcggaaattccatcccgtgtgtacacgcgagacgggatttcaggcacgtacaccgatggacaactggcagcgaaagcgtatgcccaaggtcgcggacccccagcgcgctcgtatggccacctgccggcaaaagaggattggagccccagccgtcggcaacaggccccaacaccgcgcggcgacactacccccatagttcgtccgcccgtcttccccgagcgcttctctctacacgcccgccagccgggacggaacttcaacgttaggatgggccgcggaaccctcgatgatctgggagagtagaaggggcctccgccccgccctgcctaccgcaccctgcgaaacgcagcgaggaagtgcccgtccagggggagggcctcggagtccgcacgggcggtcctgatggtcgcgtcatccgtcgccatggagtccacgagttcgcgagccttggcggggaggctctcgtacccacccaatgtcctgggatcgacgggcgagaagcccgcgccttcggacgagaggaacgcatcaaccacggcctcgtcctcctcccgaaggagcgagcaggttgcgtagcagagcgtccctcccacgcgcacgcgcgcggcggcagcggagaggatcgcgagctgcgtcgcgggcagcgcgtcacgaaccgacgccggctcgagcgcccaggcggtctcggggtgacgccgcatagtccccgtccccgagcatgggacgtcgacgaacacgcggtcgaactcgcccgagagcgctgacggcaggctgccgccgtcgagctcgcgcgcatcccagcagacgcaccgggtctgacccgagatggtggcacgctccatgcgcgagcgggcgaggcggaccttcgcctggtcgacctcgaccgccgagacccgtgccatcccgccacgctgcgccgcggcggactgcaggaggacggtcttggtgccccgcccctgtcccacctcgagcagggacgaccccgggtcgggcgagcagagccaggcaaccgtctgcgaggcgaggtcgcaggggatggcgtcgcacgtctccaccagcccggatgaggcgagccccgccggggacgacaggatccacgaacccggcagcggcgtcttccggggagagagtcgcgcccccctcagcagctcctcggtctgggaggggtcattgcgcagggcgtcgcccgccacgtaggggccggccggctcgagcgcccggagggcgagggcgcacgcggcgcccatgccgcacgacgccacgacctcgtcggcaagccactgcggccacccggccgccagtgcgatgtcacctgaagcgggcgtcccaccggcgagccgcgaccgcgcgtcctccacccgagggacgtcctcccgcgcaacgcgcctgaggacggcgttggccagccccgccgcgcgagggttggcggcgcgcacgagctcgaccccctggctcacggcgacggcggagggggtcctgaggtacagcagctccaggcacgagacccgcagggcgtcgcgcacgcggggctccaggtgcgagccgtgcgagaggtgcgacccaatggcctcgtcgagcctcccgctgcacgcgacgacccccagcaccagcctggtggcgagggcgcggtcgcgctcgtcgaggccatccatgcggccactggtcctgagcaggtcacgcgcgcgggcatccctcctccgctgctctgcgagcagctgtgaggcgacacgccgtgccggggcgagacggcccatctatgcgacgccccacgtcagcgccttggcgtggaggccggcggcccaggccgaggcgtccatctcgcgcttgccgtccggcttaacgcgcagcagctcgagcgcgccgtcggagcagccgaggaagacgcggcccttgcgcaccagcacctctcccccggcgacggagacgtcacccggcgcgacggacgcgcgcatggccctgaggccgcgaccggagacctcgaggcgcgacggggcggcatcgcttgaggtctgcacgcgacggcggttgtcgagcgcggtggcggaggggtcgagcaggagctccgccttcaagatcttcttggcgtacgtcaccttggactcgtcctgctccacccaggtggcggtaccgtcggccatctggtcgagcgcggcgagcagctcgctcgcacccagctgggcgagctcggacatcagctcgtcgcagcccttctcccccacctcggtcgatgcctggcggcagtacgcgcccgcatccaagtcgtgggccacccgcatgatggagacgcccgcgcgctcgtcgcccgcgaggatggcccgctggatgggggcggcgccgcgccagcgggggagcagcgagccgtgcacgttgacgcagccgagcggggctatgcccagcacctcgtcggggaggatgcacccgtaggcggccacgcagatggcatccggccgctccgcgcgaagccggtccaggacctcgggcgtcacgcgcttggtctcgacgacggggatacccagctcgccggcggcgaccttgaccggggacggctcgagcctgcgcccgcgccccctcacggcgtccggcctggtgagggccagcgtgacctcgtggcgcgacgcgagcgccctgagcgaggggacggcaaagtcgggcgtccccatgaagatgatgcgcatggctgccccccgctagtcttccgccacgtccccgggcttggcgcccgcctcgagcgcctcctggtagtcgcgcatggcagccacgcgctgcccggcggacaggtggtcgatcatcgtgatgccatggaggtggtcgatctcgtgctgcaggcagatggccagcaggttgtcggcagcctcgtactgcatcaggtcgccatcgaggttcctggcctgcacgaccacgtggctggggcggcgcacggggacggtgatgccggggaacgagaggcagccctcgccgccctcgcgctcctcgccgtcggccacgacaatcttggggttgatgaggacgtaggggttcttccccttagaggtgtagtcgacgtcgatgaccacgagctggatcagctcgcccacctgcggggcggcgaggccgcagccgtcggcggcgtacatgtccctgagcatgcggcgggcgaggcgcgccaccttgccgtcgatgtcctggatgggctcgcactccgtcttgagccggtcgtcgggggcgacgacgatatcgtctagggcgctcattggtatcccttctgggtgtgcgcgcacggtgcgcgcatgatctttgtcaacgccatgttactacccaccacggggcgccaccttgcgctcggggcgcgcggcccaccaaacgccaaaatgtcaccccgctgccatcacatcaggtcgtaggcgtcgacgtcgatggccacgctcacgccgcgcgggacgtcggccgccgccacgcaggccgagaggacctcgcccggctctgaccccacgggcgccttcaccaggacgtgcctgcgcgtgcggtccttcacgcgcgccttgaggcagtctgccggccccaggacctcccagccccgctcgccgccgagcctctccctcagccgcgccgcgaccgcgtcgcacgagcgccgcaccgccgagccgtccctcccccacagcaccacgttgcacagccgcgagaacggggggtagtcgccctcgcgccggtccgcgagctcgggggagaggaacacctccctcctgtgggaggcgaccgcctggatggcggggtggctcgcccagtaggtctggacgatcaccctgcccgcccgctcgcccctcccggcgcgcccgctcacctgctcgagcaggtcgtaggtcctctccgccgcgcggaagtcggggagcttgagggtcgtgtcggcattgatcacgcccacgagggtaacctccgggaagtccagccccttggcgatcatctgggtgcccaccaggaccgcccgctccgcgccgtcaaaccgctccaggagccgctggtggtcgcccttgcccctggtggtgtccgcatccatgcggatcacctccacgccttcggggaggagcgccctcagctcgtcctccacgcgctgcgtgcccacgccgtaggcgcccaggtacctgctcccgcagttggggcaccgcgtggaggggtccggccacgcccgcaccggccagctcctgccgcagctgtggcacaccagcgagtgggtgcgctcgtggtaggtgagcgaggtggagcagtgggggcactcgggcacggcgccgcactcgcggcacatgaggaagttggcgaagccgcgccggttgagcatgagcacggccttctcccccctccccgtgacctccaggagggcgtcctcgagcggcttggagaagaccgacctcctgcccgagccaaactgctgcgtcatgtccaccacctgcacgctggggaggaccgcgccgccggggcgctcgggcatgctgaccctggtccaggaggcaccgccccatgagccctcgtggcagcgctccaggctctcgagcgagggcgtggccgaccccagcaccagcgcgcacccgcgctcccgggcaagccgcgccgcgacctcgcgcgcgtggtagcgcggggcgctcccctgcttgtaggaggcctcgtgctcctcgtcgataattaccacgcccacgtttgagaggggcgcgaacagggcggagcgggcgcccacgaccacgtgcgccctcccctgcctcaccatgtcccactggtcaaagcgctcccccgccgaaagccgggagtgcaggatagccacgtcgtcgccaaagcgcgacctgaagcggccgaccgtctgcgccgtgagcgagatctcgggcaccaggaccagggcgcctctcccccttgcgagctcgcgttcgatggcggagaggtacacctcggtcttgccggagcccgtcacgccgtcgaccaggaccacgtcccccctgccgacgtcacaggcgcgcgctatggcggcgagcgcctcctcctgcccgtgggtgagccggctcggccgctgcgccacggcggacgagagggtcgtcccctccacgcccctgacgcggcggcgctcctccacccgcaccaccccgcgctcgcggagcgccgacaccgcggagccgcacccgggcagcgtcgccgcgagctccgccatcctcgcgggccccgcctggagcgcctccagcacctgacgctgcctcgaggcgttggcgcgcgggacaaagccggccgcaccctccgccaggctcacccatcgctcgtccacggggccggacttctcgcacaccagcgtccatgcgccgtcgggaccgtcgcgacgcacccggacggtctgccccggcgccaggaaggggtgcagggcctcgctcagggggcaggcgtactcccgcgcgatccatcgcgccaggcgggcggcggcctcgtcgaaggcggacccggcgaggacgcgctccacgggcaggatgcgatggggctccagcccctcctgggggcgctcccccacgccgaccacgtaccccaccgccttcctgtgcgagaagggcacgagcacggtcgtacccaccacgcactcgccctcgagctcgggcggaatcgcgtagtcaaacgtcccgtcgagcgagcgggacgggatgtctgggacgacttctgcgaacggcacggctgcgggcctcctggcaacggggatggtccccccatcatacgtcgcctgccgtgggctgccgagacgcgccccccgccccggggagaggagaggaggcgccatatgttggcacaggctgccccgccgggggcggccccgccaaaatagaatggactcacggtcggcttgagacacctgcatgcgcacttcccgacggcgcccagggactcgccgacccttcccacgggggcggcggccgtctcttcccacaccttcggccgccgccccacttgtgccccccgcgccagcgcaccgcccgggggcgctcccgatgccggcgacgaggccacgcccaccagcataggcccactcgaggcgatggaggtctcgagggcgcggggccgcgtctggcggattccgcgtcgtggcgttcccgcacgggtatctcatgcaaaagggggccgatgagcagcgtgcatgccattctgctggcataactgcccattgattttgtaagcatggctgatatcgttccctttcgaacctgccaggaactgacggggggacgacgccgttcgtcggacctgggaggggatgcatgaggcacgctcgtcttggcaatgcgggttccctgcccggagccgcccggcgctcccgcctcgcgctcctcgccctgctcgccctcctcgtcgcgggggtgctcctcacgcggccctgggccatggcgggaacggtcacgggacgggaggtgaggagcgtggcggaatggcgcgtctccgcatgggactccgccggcaggagcctgggaagcgccgacggcgtccccccaacggcgtcgacccccaccaccatccgcggcctcgcggagggcgacgtcgtggagctgacggcaaccgtggggtgctcgcggcgagacgtgctgtacctctcgaccttctacgcacccttcaccgcatgggccgacgaggtgctggtcttgtcatatggggaggagggcacctatcccggcttcctcgcgtgtcccccgcccgcgagcaggtgcgtccaggttggcgggaggtcgggcgcggtcaccctgagggttcgctacacgatcccgcgcggtcgcacgtccctccgcctggcggatgcctacgtgggctcccccgacgccatgaggcgctggctcttcggcaccatggggacccagacgttctttgccatcaccatgggcttcatcgggctcgccctgctcgtggcgagcagggctatggcgacgttccggctgcagagccaggtctttgcgtggcttgggctcctcaacatcttcgtcggcctgtagagctttggcgagagcgacctcacctgccttctcatcccccggccctcgctcctgcacttcctggcctaccttggcctctacgccatgcccatccccctcgcgcacctcatgtccctcatcgaggacgaccccaccggcggaaggctcttccgcctctcccgcggggccacggagctgttcgcccccgtggcgatcgccctgcagctgctcggcgcggtccagttcaaccagagcatcctcgccttcttcgtcctgttcgcgctcacgcacctggtcccctccctgtggatcgccacgcaggcgctccgaaggcgggaggcgaggaggctccagctgtggtacctggcggtgatgttcctgtacgacctcttcctcctcctcgagctcctcgactactacgtgtggctggtcgtgccggagatgacgttcacgctcgtggggtcggtcctcttcgtggcgctcaccatgtggatgtcgctcatcacggtgcgtgacaccacgcagagcgcccggggcaacgaggagctgcaccagcaggtcaagctcatgcgcgtgcgggacgaggcgcgcgaccgccagctcgagcagatgtcgcggacgagcagcgagatgcggaggcagtggcacgacatgcgacacatgctcgccgccatccgcagctacaacgaccaaggcgaccgggagggtctcgacgggcttgtgcgctcgctcgacacgcgcatccccacgccgtgcgagcaaacatactgtgacaacctcgccgtcaactcggtggtggggtactacgcggacctcgcccgcgagcgcgggctcaccgaggtcgacatcgcgctggacgtccccgccggcctcccgcgcgacgtcgaggacgacctctgctccatcgtggggaacctcctcgagaatgcggtcgccgccctcggcgaggtcatgggggcgggcggggacccctggatcaggatgaggggcctccagaggtcggggaagctcgtgatcaccttggacaacagctaccagtgcgtccgcggggacggctttgggggcttctccaccaccaagcgcgaggggagcgggatagggctccgctcggtcgagacgtgcgcacgccgcaacgggggcagcgcgcggttcgaggcgagcgacggggtcttcgcctcgtccgtctacctggcgctttccaccacaccaccagagaaaggtcacccatgaacgccttgaccgttgcaatttgcgaggacgacgtcgacgacgagcggaggctcgtcgacctcgtggagaggagcccggtcccggcgagggcggcgctgtactccgaggccaacgccttcgtggaggacttcacccccggcatctacgacctcatcctcatggacatcttcctgggggaggatgccgagggcggctccggcgagcccgagggcctgagggcgatccgccgcatccgcgctgtggaccccagcgtccccgtggccttcgtgaccaccagcaaggacttcgccctcgaggccttccgcctggacgtggcgcgctatatcgagaagcctgtcacgcaggcgcaggtggacgacgtcctctcgtttgccatgggcatgcgcgaccacctgccgggcctcaggctccgcagcgagggccacgacgtcaacgtgcccatcgcccagatcgtctacatggagcagtcgggccactacgtgctcatccacctctccagcgggagggtggtgaaggtcaggggcacgcttgacgaggtctcgaccaacctggacgagccgcagttcgtgcgctgccacaagagcttcgtcgccaacctcaacttcgtggaggacatcaacgattccctgatgtcgctccagatgttagggggcgactgggtccacgtgaggaaggcgagcatgcgagacgtgcgcaggcgctacgaggactggctcttccagatggcgcgcctcaaggggtagctcgccgccaccgtccgcacgcgacgacccgtcgcggcgccccctctcccctacaatggactcaccacgtcagaggggagccgcatgccatgcacaagcctgggtaggacccttgccatcgccaaccccgcctcgcacagcggacggggtgcgggggcggcggacgagctggagggcctcttcgcgtccgacccgtcgctcgcgggctcgttcgagctcaggcggacctcgggccccggggatgcggcgtccatcgcctcctcggcgggaggcttcgacacgctgctcgtgatgggtggcgacggcgtgatcaacgaggccgtcaacgggctcatgcgcctgccgagggagcgcaggcccaccctcgccgtgattcccatggggtcgggaaacgacttcgcgcgcaccctgggactctccctcaaccacccgcgagaggccctctcccagcttgcctcgggggagagaagagccatcggcctgggcctcgtgacctccgacgccggcgagtcgcgccactttgcccaaacgctctcgtttggcctcgacgccgccatcgcgctcgacaccaccgaccgccgtgccgcgcagacctcccaggagggcgcggcgctgttcgcgacgtcggggctcaaggtgttctcgaccgggggcaggggcttccccgcccgcgccagcttcgacggcggcgagcccatgcaccttcgcgtcatggtgttcgccgtgcagaacggccccacctacgggggcggcttcaggatctgccccaccgcctgcccggcggaccccacgctctgcgtctgccacaacgtcctccagccacgcctcccccataccctcgcgctcttcgccctcgcccggtttggactgcacacgcgctccaaggtcctgcgcacggtccatgtctcgcgcctcgacgtccggtttgaggagggcgagcccccgtgccaggcggacggcgagagggtccgcggaacgagcttccacgtggagtcggtgccggacgccctggacgtgatcgtccccaagggctgtcgctggtagagaaggaccgccctcccgctggaggggtcccccgttggcatccagcccctcgggctaccgagccaacccgatcgtgacgggacgtcaatggtctgagaatggagcggccgcgcatctgtctggccgtcggcccttccgcaagcggagagccgccctttcccatcgccgcccggatttgccccccttcctcggggcgcccatccgcccccagccggtgcacggcttcgtcaggagtctccccatggggcttccccgcagccggctcctcgggtcgcgagcagcgccactcatggcggggatcctatggcctaggaatggaggagggtcaacccctcgagtcgtgagccatgccgcacgtgggggagaatcgatggctaagattgggtagggtcaatctctctcagtcgaccccttctcgcacggtcggtgaccctcatccccttccttgagtacttttctgtccggcgattgcgtgagacgctggcccgccccctctcccgcaggccggccggcaggagactcctgatgtgagtgcacattccgggctcgcgccgccagggcagtcggtcgcccggaggacatcccagctgattatcaatcaaaccttgaaccgtggcggcaagctcccaatgtgagcactcatatcgggaatctcttgccatttaggccgaatgtgaggtcgggatggtagaggtctcccgaagtgagtgctcacatcgggctcccgttgccactggaggggtcagccatggacggacgactttcctacctgggcaaacggacggctgtcctagaagtacgccgactgacgaccactcgagaccactcacatcgggacttggctgccatggggggcatctggcggacgacgaacggcggccagcgcttcaagcaactacccatggcaacaattcgctcgcgtaagtgctcgcgcgagccgcctgccaccaaggggcacgccatggaggggcacccagccccggtgcccgggagaaaggcacgtgcgaccagctccgaagcccggtcagcctgaccccccaccccctcttagccattccatcgggttcgtcccaactcgcccgtgcgtcgcaaccacaacccaagggccgtggatgccagggttcctatggaccgcggcaagagatctcccgcacgcgtgctcccacggggaggttccctcccagcccgagatcagcctacgtccccttctctgaatccttatgagcggagccgggcagattgcctgcgggcgggagacgggcgcatctctctcctagcgaacccgcacgcaaccccgaaacacaaagggggcgccccgatgggacgccccctctcgcttgcctatgaagcaaccctacttcacggcagcctgaagcattgccttgacctcggtcgcggtcttgagggccatgaccttctcggtgagggcgtctgcctcctccttggtccactgcgagatgatgcggcgcgtgcgcaggatcgacggggcggagacggagaactcctccaggccaaaggacagcaggacgggaatgagcagcgggtcagccgcggcctcgccgcacatgccgaccatgatgccggccttgttgccctcggagatgacgcgcttgagcgacctcaggacggccggctggtacacctggtacaggtaggcgacgcggtcgttgccacggtcggcgcacatggtgtagccaatgaggtcgttggtgccgatggagaagaagtcgcactcggcggcgaggtcgtcggcgatgagcgaggcggcgggcgtctcgatcatggtgcccacctggatgtccttgttgtactcgacgccacgtgcgtcgaggtctgccttgcactcctcgatcaactgcttggcctggcgcacctcgtcgaggttggtcacgagcggcagcatgatcttgatgtcaccaaaggcggaggcgcgcaggagcgcggtcagctgcaccttgtactgctcggggttgttgaggcagtagcggatggcgcggaaccccatgaaggggttgtcctccttctggaggttgaggtacgggatctccttgtcgccgcccacgtcgagggtgcggatgatgaccggctggtccttcatgcgcagcgcgaccttctggtacgcggcaaactgctcgtcctcggacgggagctccttggcgtccatgaacaggaactcggagcggaagaggccgatgccctcggcgtcgtgctccgcggcgttgttggcgtcgtcggggttgccgatgttggcaacgaggagcttcttctcgccgtcgcccgtcacggtctccttgccgcggtacgcctcgagcgcctgcttctcctcggcgtacaccttggccttggcgcggtagtgctccaggtcgtggtcgtcggggttggcgatgaccttgccgttggtgccgtccaccacgaccatgtcgccggtcttgatgttcttggtggcgtcggcgacggagaggaccgcggggatctcgagcgcgcgggcgatgatcgcggagtgcgaggtcctaccgcccgtctcggtgacgatgcccgcgacgttctccttgtcgatgtcggcggtcatcgagggcgtgagctcgtggaccacgacgatggagttctcgggcagcgtggagaggtccacgacctccttgcccagcaggtcggcgaggaggccggtcttgacgtcggcgacgtcggcggcgcgctcgcggaagagctcgtcctccatctgggagaacatcgtgtagtaggtgtcgtacgcctcgctcacggcctgctcggcgcacatgcccgagtcgatggagccgttgaccatgtccttgatgccctcgtcctcggcgaactcgatgtgggcacccatgatctcggccgcattctcacccacggtcttcttcatgcgctcgatctgcgcgttggtctgcgccacgaacttgtcgagggcggcggcgtagcgcgccttctcctcctcggcgttctcggggaccctgggggtgaacgagaggtctggggccaccgcgacctgggcgacgccgatgccgtagccatcagacgcattgatacccttgaacatagattcctcctcttttacaagcactgcgcttgggtgaagccgaacgtaaggacggggtggggtgacgccccgggggagagcctacttggaccgctcctcgatgatcttgttgaggcgcgcgtacaccttgtcgatggtcgcgcgcttggcgatgcccttgctcgccgcagtcgccgtaccgcaggcggacgcgaagcggagggcggtctcgtagtcggcaccctcctggcacttggcaacgaagcccgcgaccatggagtcgcccgcgccggtggcgttgacgagcttgatcttggcggtggggacggtatgaacctggcagtcgttgtcgtacaggagcgcgccgtggctgccgcacgagacgatgacgttctgggcgccacgctcgtggagcttctccgcgaaggggatgcactcctccggggtctcgggacgggcatcgaagatcctgccgacctcgtggttgttgggcttgatgaggaacggcttggcgggcagggcctccatgaggagctggccgggggcgtcgaccacaaagcggatgccgcggccggcgaggcgcttcatgatgatgtcgtacatgttctcgggcagcgacttggggatcgagcccgtgaggacgagggtgtcgcccggctggatgcagtcgatgcgctcgaggagctcgtccaccttcttctcggggatcttgggacccatgccgttgaccatggtcatgacgatgccgttgagcttgacgttgatgcgggtgaacccgtggtccagcatcacgaagttggacgagatacccgacttctggagcgtgttaatcaggtactcccccgtgaagcccgcggcgatgccgaaggcgacgttgagcaccttgagctcgttgaggagggtggagacgttgatgccgttcccaccgcagtagatctcctcgctcgacgaacggttggtgaagcccatgtcaagcgtcaggggatgcatgacgtagtcgatggcagggttcagcgtgacggtgtatatcaactcgagctcctctcgcccaaatatgcactcacatgataacgaaaaatacgcgcatcggtcctcaaacggccccgtgaatcaccgatgggtatatttcgcggacaggtcaccagtttcattcattttcccccgcatgcccccgcacgttcatcgggcccgacgcacgtgccgaggagccctcgcaacggtggccggctcgtgataccatctctctcgcaagcgcccttagctcagctggatagagcatcggtcttctaaaccgccggtcaggcgttcgaatcgcctagggcgcaccagcatacgacgggggtcgggccacgcggtccgaccccctttgcatgcctagtcctcgcggggcacgtgcgacaccaccagggtcatggccccctccaggggaagcgtgtccctggccgcaggcaccacgaagtggcttccctttgccacgggcaccccggcggcggtgccctcgccctcgatcacgctcacgcaggcgaagtcgtacggcgtggggaggtcgcgcgagccctcgacgcgcacgcggtcaaccacatagcgggggcaggactccaggcgagtgatgccgtcgacctcgggggcggtcaccgctccggacgagaggggctcagcggcgtagtcgatgacgtccaggctctgggccatgtgcagctcgcgcttggtgccgtccgactggacgcggtcgtagtcgtacacgcggtaggtcacgtccgagctctgctgggtctccagcaccgtggtgccgcccctgatggcgtgcagggtcccggggtcgatctggaagaagtcgcccgtgtggacggggatcacgttgaggagcctgtcccactctcccctctcgaccatctgggcaaactcctcgcggtcgtgcgcgtgctggcccaccacgatggtcgcgccgggctccgcgtgcagcacgtaccagcactcgcacttgcccagcgagccgttctcgtgcacgcgggcgtactcgtcgtccgggtggacctggatggacaggtcgccctcggcatccaggatcttgacgagcagcgggaagcggtcgccctctgccttgccaaagagctcgtggtggtgcttccagaggaacgagagggtcaggccatggtactggccggacgtcacggtgcagtcgccgttggggtgcgcgcttatcgcccagcactcgccgatggggccgtcggggatgtcgtagccaaagtcggtctggagcctcctgccaccccagatcttctcgtgaaagatgggctcggtgaagatgaggtcgtcgtcgtggaacttggggtccctgatgaaccctccgcccatgtcgatcatgcgcgttcctttcgtcgatggactttcagcccgatgatagtccagcggagaccctcggcccccgtcgtttgggggggggccgcggtggcatgcggccctcgtcacgccaggccgcggatgagggcagcctgtgccgcgatgatggtcttggagtcgcagatcaggccctcgcatatggcctcggccacgtcccccacgggtatccagtgcacgtccacgagctcgccttcgtcagggtgcgccgcgtggggagagaggccatgggccagatagacgcacgtcgtctcgctggtgaagcccggcgaccccgccgcacgcgccacgagctcgagccgctgggccacgagcccggtctcctcccccagctcgcgcgccgcgcactcctcggggctctccccctcctcgcgcctccccgcgggtatctcgagcgtgaccgcccccatggcgaggcgatactgcctcaccaggcacatgcggccgtcgacgacggcgcagacgccgcagcctccgtggtgccaggcgatctcgcgctccccctccgtcccgtcggggagcctcacggtcacggtctgggcctcgaagaccctccccgcccagtgcgactccgtccgcgtgggcacctcgcggagggcatcgtcgtcacgtaggagctcccggatcgcccggatgccatcggattcgccaactgccgccatgccgtcccctctcccctgccccgcaacggggactggcacgcgcctcccaggaggcgggcgggtcgcttgcgaagtccgccacatcgcgcctgcaggttttggcgacctatgcacaacccccgtgcgggaaatcttcttgggctgccggagcacgcccgttcctcccccaccatggtatcagtgccggttccagacgagcgggggtggtggtcgcatgcacatgcagaggggacgtccgaccaacggggtggtcgcatgaggtggcctagggctcggcgtcccacgtggctcacgcggaggcgggcgtgcgtcctcgcgctcacggcggtcgccgtgctgggcgttgggtggggcatggcggcgctgctcggcgggtgggaggacccgctggcgacggagggctcgtacgaggggctcgtgcgcccggaggtcacgagggaggcggacggcaaggtggactcctcgtccatggagatcagctgcgcggccgccatgagggtccaggagggcgagaccacggtcgaggcgcgcctggagaaccccgcgtcaaaccacgttgaccagcgggtgcgcatctacacccgggagaagcccgacgacatcctgtaccagagcggggcgctggcgccgggccagacgatcgagaccatcgagctcgcccacccgctcgagccaggcaggcacgacgcgatcgtggagttccagggctacgagcggcatcgctcgctcgtctcaaaccagggcgagctgttaggccacgacgcctttggggcatcctgcgcagccgaggttcccatcagctgcgtggccaagtagcgacccggcatcggtgccgggcgacgatgcgaagggagaggcaatgttcgtgcacagaccagattccatggcggcaagggtggtcgcggcgggactcggcgtggcgctggccgcgagccccgtggcggcgatggcggagacgtcgaaggaggccgagggaaggccgggcgagtcgtacggccagacgcagctgacggtacgcgccgacggcaccgacctcaccacgccggagggcgagaacgagacgctcgaccaggtgcgcgtcaccatccccgtgaggattgacttcgtggccaagtccgacggagagctgaaggggcccgaggatgacgaggtcaagttctccaacaactccacgatgccggtgcacgtggcgagcgcaaaggtcacaagctccgagggcacgcgcatcgcgacggcggaggaggagcgtgctgccgaggccaagggcgaggccgacgtcatccacctgggcctcaccaactccaagggtgacgcgatcgacctcggcaggtacgcgggcgacggtgccgccctcaaggagggggcgtgggacatcgcccgctcccccaagcaggatggcaaggcccgcgagggggactcggtgaacaagctctacctcaacaagctgggtggaaggatctcggggtttggcaagctggaccccgcgagggagacgcaggtcggccagatccactggacggtcaggccgggcctcgcgaaggcggcaaacgggggaggcgacgcctgacatgaacccgaggagaaggaggaggtgctggtggggccgcgcgaggctcgccgagcccgcccgggtggcggcggcgtgcgccgtgtcggcgaccatagctgcggggtgcgcccccgccgccgcggcctgcgccggcgtcggggcggcgcaggaggagggcgcgaggcaggtgcgccttctgttcgtggacgcccagggccagacgatcgcgacgcaggactcgcgggaggggacgtccgccccgctcgcggggacctcggtcgcgggcgagaggggcctggctccccggggatgggccgccagggaggccggcggcacggtcatccccgcggacgcgaagctggaggggacgcttgcccgctgggaccgggatgccaacgggaccgtctcggagggcgaggggctggagcttctcggcctctcccccgacgggacggtgaccctcgaggcgctgggcatccccgagggaagcaccggcgcaggggagacggtggaggagcccgaggcaccgccagcggtccaggatgccgaggcagggccgaggacgggcgacgaagccgagaggaccgcggagccaacggatggggccgtcgaggaggaggccgagcgcacctctcccccggcggagcagccaaagccaaaggagaaggcggaggaggctcggggggaggccgagacgaagggggacgaagctacggcgcagcaggagcttccaaaggagagggagcaggccgatgagagggggcgtgacaaggccgagcccgcgaggccgaaggacgcgcgggacgaggacccgcgagaggagtccaacggcgacgaaggcatcgtcgcgtccgcgatgcgggcggtgggcgacacggtcagccgcgccgccgaggagtttcgccatcccacgatctcctacgacctgttctactccgacgccaagggacactgcggctggacgggatacaagaaccccgtcacgaacaacaaccagggtggccccgagttctccgcgctcacggaggacgtaaagaagaaggtcggggacgtgttcgactgcgcgaacgccggcctcaacgcgatcaggatcaagctgacgggagggtcggagtccgacgggaaggtcgagtacaagctccagtaccgcgacgggtccacgagcgagtggaggagcaacggcgagatctcggggagcaaggaagacaggcgggggtgggcgaccggcgtcatcctcaggctcaccggccccatcacggaccactaccggctcctctacaacgtccacgggctcaaccagagggacaaggacggaaacgacacccagggcaaggccgtgaacagcggaccggcaacccacaacggggccgcagtggacggcctgcgcctgcgcctcttcgtcaacgagcacgacgtgaccttcaagagcggcctcacggggaagctaatcgagaggcagaaggtccagtaccactcggacgccaagccgcccgagccgcccaaggagaagggccacacgttcgagggatgggtgggggactaccagcccgtcctgagggacaccgaggtggtcgcccgctaccgggagcactcgtacacgatcaggttcgagggcaacggcgccgactcgggcagcatggcgccgatgaccctcaagtacaccgagtcgcggaagctcccggcaaacgagttcagaaagagggactacaagttcctcggctggcaaaagaggggaagcggcgtccgcctctcggaccagaggcaggtccaggggctctgcgagggggacggggaggtgatcacgttgcaggcgatctgggccgtcggcttccacacgctgaccgtcgaccctaacggcgggagctggatgggatcgaccgagcccagcgccatcaaactcggtgacgccgagacgtacaggctcgacagccccgtgtgggccggccacaccttcaagaagtggaagtgcgaccagagggaggcgaaattcgacggaaccaccatcacgatggaaaccaaggacgtccgtctcacggcgaattgggacccaaacacgtaccaggtcaagttcgaccccaacgcaagcgacgtaaagggcaagatcgacgacctcaaggcaacgtacggcgaaggcctgctgctgccgaaggacggcttcacgcgccagacgcacgtgctcgcggggtggaacaccaaggccgacggctcgggaacgcgctacggccttggggacacggccaagaacctgacggagaaggacggcgagacggtgacgctctacgcccagtgggagccacgccagatcgacgtggtggtgcccgtctccattggctatgttgcctcgtccgacgggacgctgagcggaccggcaaacgacatggttgccatcgagaaccacagcgagatgccgatccacgtgagcaggatcgagaccgtcgccgaggaggggctgagtctcacgacgggggagcccgacctgggacagatcgagctgagcatgacgccggggacgggagagcccgtgagcctggcaacctactcggagggcggcggcagccccgagaggccggccgactggacgcttggggcaagttccgacctgttcctcaacgacctgcgaggcaagatgggcgacctctccgcgcacgtgagggaggcaccagtcggtgcggtcaagtggacctttgcggtgggttccggcacagaggggagctcgtgagatgagagggagcgattccgtttgcgtcgtggcactggcgtcggcgatggcgctggcactctcccccgccgtgacggcacatgcggagggagagtcgtacggcgacacggcgctgagcatcaccggcggcgaccagggggagagggtcgaggcagaagaggacgagaggcccgcacgcggcggagggtccagcgccaggaggatgccccagacgggcgttggcccggacgccatcatcctcgtgggctgcggggcggcgacgatggcgctgggcatgctcgcggcgagggaggtctgagcgcagccccgttcaggcgaatggcgcccgcgcgcgttggccgtgcatgaaaaaaggccggcgaggagactcgccggccttggcttcacgtggtgggtcgtgagggggtcgaaccctcgaccttgggattaagagtcccctgctctaccaactgagctaacgacccaaaaagaaaccgacgaggtaatcgccggtcctgagtgcacgtggtgggtcgtgagggggtcgaaccctcgaccttgggattaagagtcccctgctctaccaactgagctaacgacccatatacggttgtaaatggggtgggtagaggggctcgaaccctcgacctacggagccacggtccgtcgctctgccaactgagctacacccaccatttggcccacccgcaacgcgcttgtctataatgcccaaaacccctgggtcttgcaagcgagaattcaaaattttctgcgattcggccgcaacttatgggacaggcggtcaaaatgtgcccgcttacctgcgcagtcgctggtcagcatcccatgtggaggacgtttcatgaagctgaatcatgaagggccccgccgcgtcaggaggcggcaaggccgaccgagcggacctcgcccaacccatgcgctgacgccgaggaaggcgctcggtggcaccctggtgtgtgtcggcctctgcatgcttgcggcgggcaccacgctcgtcgtgccacagatctgcgaggccccggtcggcttggctcgggcgaggagggtccgcgggccaggcgcgcacgtccccggtgccaagacggaggtagcctggcagcgggtgagcgagacgtgcccggacgcactcgcctggctcgagatcccgggagcggggattgacctgcccgtcatgcggccaacgcccgaggacccaagctactacctcacgcactccgcggagggcctgccctcccctgccggcgcccccttcatgccctgtgagacgggtccggacgacacccacgtggtggtgttcgggcacaacctcgccgggacgggggcgatgttctctcccctcaggacctgccacgaacaggggaagttcgaggatgtgctcgcagggggcgcacggtggacgacttcggtcgggtcaacgtcgttccgcccgctctgcgcatccgtcgtgggaagcgatgacgcggaggtgcagcgcgtgtcctttgccgacgagggggagctgcgggaatggctcctgtcgagaatcgcctcgtccacagccgtcgcggaagacgcccgggaccgattgacgactgcccagagagcgctcacgctcgtgacctgcagctccacgacacccggacagccaacccgaaccgtcgtgacgttcgtggcgtgaggtgcctggcagcgtctccccgtcaccgtggataatcgcggagtaaccgatccgttcgtcggggtcaaccgtcctcccccgccggaagccctaaaccccagtggaacacaagcaccagccagatcaagtccaggaacagagatgggcgcccccgctcaggtttggcagaaagctcctgggatggagtgctcacgcgggggtcttctgccaatctgggcgataggcggatttgtttggagccactccactcatgtcagggaattgatgccaaagaacggaggggctgttcccctctctctcagccggtaacccctcacgcgttcggtagccctcgtccccctccttgggcactcgtctgccgggggatggcgcgaggctccggccgagcccctttcaggcaagccagttggcaagagactcccgaagtgagcacgcatatcgggctcccgctggcagggggccggacgcctgggcgtaacctcagtcggaacccaatcaaaccttgaaccatggcagcaaactcccgaagtgagtgctcgtatcgggagtctcctgccattaggccccccaatcgcctccgaatggcggcagcctcccggtgtgagtgctcacatcgggaggttgccgccacgggtcgggaggccatcgcctcgcttgagtcctcccacctgggagaatgccaggtgagcccgacccatgcgggctcccctcccgcgagggagcgctcacatcgggacttggctgccacccgaccccgagggcggcggcttttcgctgcgcgcgaccggttctggggggcccggtacgaagggtgctgaggaaagtggagcgttggcaatccgaggttcgcaaccactgaggaaaagcgagtattggcagtggatgacccctttcgtctgtcaaaccttgaggttcccaagcttccaacgagcccggattgccaatgctcgacattcctcagcggccctcggctccaggggcacccaatcgcccgcagaccaggtttccgaggcgggaaccccggtttggcggcgtgcctggcggcaggtgacccaggtgagtgctcgcgcgagtcgtctactgccaggggcgaggagccgccactgtcgatgaacccccctccgccgatggcttgccgtcccgcagcggaccgtgccactctccccttctctgacttctgaatacccctcggctacgacggccccgagggcgccatggttaaacccttgcgtcgattcggacaatcaccctcccccaaccttgaacgcacccaatgcgcgggatacacttactccatcgcgctaaagtgccttcgattcctactccgtaggggaagtggagattccaacatgactcgcactggcctcacgatggatcgccgcgggttcctcaaggcgtccgcaatcctgttctcgtccgcagcgatcggcctctccaccggttgcggcagcacctctggctcctcgtccagcgcggactcgtccgcgagcgacagcggcgcctccggtctcgccgcgtttgacggcaacttcatcatcggctttgaccaagacttcccgccctacggctacgtgggggacgacggcaactacaccggctttgaccttgacctggccaaggcggtctgcgacctggaagggtggacctacacccccagccccatctcgtgggacgccaaggacggccttctcaacagcggccagatcacctgcatctggaacggcttcaccatcgagggccgcgaggacgactacgccttcaccgacgcgtacatggagaaccgccaggtcgtggttgttcgcagcgactcggggatctcgtccctcgccgacctcaagggcaagaacgtgatcacccagaccgactccgcggcctacaacctgctgagctccggcgggtcccaggaggagctaggcaaaacgtttgcccagctccagaccatcggggactacaacacggccttcatgatgctccagaacgggtccgtcgacgccatcgccgtggactaccccgtggcgacctacaacatcgggagcgacacctccaagtacacgattctggacgaggcgctcaactcggagcactttggcgtgggcttcgccaagaccgacgagggccgcgccctggcaaagcaggtcgaggcggacctccagaagctcgacgagcagggcaaggtcaaggagctgtgcgagaagtacgccgaccagggcgtctcgtacgacctctggtgcctgccgaaggcgaagtaggctgctcgggcaaggcaggcaggcccctcggggccgcaatctgacaaggggcggtgggacgtggagatctccacgatgcttggcatgctcatgcgggggtacggcgtatccctgcagatattcttcgtgacgctgctgggggcactccccctgggcgtcatcctggcgctggggcggctctcacgcttcaagccgctctcggggctcgtggccctgtacatctcggtcatgcgcggcaccccgctcatgctccagatgttcgcggtcttcttcgcacccttctacatctttggcatcagggcgggctccggctacatgtacacggcggtcatgatctcgttcgtgctcaactacgccgcctactttgccgagatttaccgctccggcatccagagcatgccgcgcgggcagtacgaggcggcggaggtcctgggctacagcgcgccccagaccttcttccacgtgatcctcccccaggtggtgaagcgcatcctccccgccatgggcaacgaggtcgtcacgctcgtgaaggacacgtcactggcattctccatcggcctggcggagatgttcacgcagagcagggcgctcgtggcgtcgcagaggagcatggtccccttcgcccttgccgccctcatctactggattacctgcctggtcatagagttcctgctcaggcgtgccgagaggaggctctcctactaccatgactaaccgttcgaggatctcgataccgcgtcccgaccagagctttgcctcgttcgccgggctccccgccgtgtacgtgcacggcgccaccaagtcgtttggcgaccgccaggtgctcaagggcatcgacctgatcatcaacaagggcgaggtcgtctcgatcatcgggccctctggcgcgggcaagtccaccctcctgcgctgcctcacgctgctggaccgcttcgacggcggcacgctcgcctacggcgacgtcgtggtcgccaagcccgccggcgacgggtcgggcgtcgagtacgaccgcgagtccatcccccaggcgcgcatgcgctttggcatcgtgttccaggactacaacctcttcccgcaccggacggtgctccagaacgtcaccgatgcccccatcatcgtgcagcaccgcgagcgcgcgaaggttgaggtcgagggccgcgagctgctggggaggctgggcctggcggagcacgccgacaaggtcccctgccagctctcgggcgggcagcagcagcgcgtcgccatcgcccgcgccctggctatgcaccccaaggtcatctacttcgacgaggccacgagcgcgctggacccgcgcctgaccgcgcagatgcacgacctcgtgcgagagctggcgagaggaggcatggccgttggcatcgtaacccacgagatgggctttgcgcgagacgcgagcgaccgcgtcgccttcctctttgacggcgagatcgcggaggagggcaccccggaggaggtcctgggcaacccgtccgactcgcgcacccgcgccttcctcgcaagggcggaggactgagccgctgactgccggcgggaggggcgacaacagacgaagggggtccggctccagccgggcccccttcgcgttagcctcgtgcttctcgcctagaccaggtactcggcgatctgaacggcgttggtggcggcacccttgcggatctggtcgccgcagcaccagaacgtgagggagctcacgccctccggcgccgagaggtcgcggcggatgcggcccacgtagaccaggtcctggtcgctggtgtcgagcggcatggggtaggacagcgtcgccgggtcgtccacgaccttgaccccgggagcggcagccaggacctcgcgcgcctggtcgggcgtgaggggacgctcgaactcgcaggtgatggactcggagtgcgagcgcatgacggggacgcgcacgcaggtgcagttaacgcggacctcgggaaggtgcatgatcttgcggccctcgttctgcatcttccactcctcggaggtgtagccctcgtccttgaaggagccgatctgcgggatgaggttggctgccagctggtaggcgaagggcgaggtgtcgcccatctctcccccgtttgccaggaccgaggtctcgcgctgcagctcgcgcaggccgggcatgccggcgccggaggcggcctggtaggtggagacgatcatcctccggagcccggcgaccttgtgcagcgggtaagtgggcacaagtccgatgatcgtggcgcagttggggttggcgatgatgttgcgggggtggttggcgatgtcgcccgcgttaatctcgggcaccaccagcggcacgtcggggtcgagcctgaaggcgtggctgttgtccacgcacacggcgccgcgcgcggcggcctgggggagaagcgccttggcgatgtcgtcaccggcagcgccgaggacgatgtcgaccccctcgaacgcctcggggcgggcctcctggatggcgacctcctcgcccctgaacgtcagggtcttgcccgcggagcgggcgctcgccagcgggacgaggcgcgagacggggaagtccctctcctccaggcactggagcatctgcgtgccaacgaccccggtggctccgaggattgcgacgaccttctcactcatgggatacctcctgtgacgcgtgcctacgcgagggccttggtcgggatctggaccatctcgccggcaacgaagttgtcgtagatgacgttgatggcgcggtcgaagtcggcgttgttgacgccgacgatgatgctgatctcctgggagctctgggtgatcatgcggatattgatgcccgcctcgcccaggcagccgaagatgcggcccgaggtgccggcgcgacggctcatgttgcggccgaccacgctgatcagcgccaggctgtcgaccacgttgatgctgtcgggcttgagctcctgctgcaggtcgttgacgatggagtagatgctgtccttgacgtcggacccgttgaccacgacgccaaacgagtcaacgcccgtggggatgtgctcgatgctcacgccgtagcgctcgaagaccgagagggcgcggcgcaggaagccgacctggttggacatgtgggccttctgcacgtgcacggccatgaagtcgcgcttgcccgcgatgccggtgatgaggtgctcctgctcgtgctcctcggccgtctcgcggatgatggttccctttgcctcgggctcgttggtgttcttgatctggatggggatgttggcctcgcggacggggaagatggcctcctcctgcaggacggaggcgcccatgtacgagagctcgcgcatctcgtcgaaggtgatgcggtggatggagcgggggttcttgaccacgcgggggtcggcggcgaggaagcccgagacgtccgtccagttctcgtacacgctggcgtcgatgcagcgcgcgaggatggcgcccgtgatgtcgccgccgccgcgctggaacagcttgatggtgccgtccacggtggcgccgtagaagccggggagcacgaacgaccccaggcgggcgaccgcgtcgcgcacgcgggtctgggtgcgctccatgtccacggtgccgtcgtggtggaacacgatggcgtcggcggcgtcgaggaacggcaggcccaggtactcggccatgagctggcccgtgaaccactcgccgcgcgagacgatgtactcggggctcaggctctggatgaccgaggagaactcctcgaacttctccgcaatggggtacttgaggcccagctcctgcgcgatctggacgtagcgctgctcgatggactcgagcagggagctgcagtcgacgtggtactggatgtgcgcgttcaccagcaggagcaggtcggtgatcttgttgtcacccgagaaccgctttcccgaggcggagacgaccacgaaccgacggtcggggtccgccttgacgatggagcgcaccttcttgaactgggcggcgtcggcgacgctggacccaccaaactttgcgaccttgatcatgctgccctagtcctcccgcgcgatcgcagccatgaagctgctggggtcctggtcgaggacgttcacgaacgcctcgtgcgccttctcggccgtgagcccgcggagcaggaacgccctgtcgccgccaacgaactcgaagtcctcggcgtagggctcgctgtcctccacgtacgagctggtgcggatgacgtagtcgctcgtgaggagcgtggggtcgtactgcttgggggtgtctatgtcgtagtgtgggaccctgccctcggagaagtccaggatgtcctgcacgatggcgttgcccgtggggagcgagccggcaccctggccgtagaacttgagctcgcccacggtggttcccaccagggtgcagaggttgaagttggagggcacgttggcctcgagcgacctcagggggaccgccacgggctcgacggcggcggcgtagcgcccgtcgccctgcacggcacggccgagcagcttgacggagagcccgcgcgacgcgaagaggtccaggtcagccttgttgagcgtgcggatgccggtcacggggatggagccggtgcacgtggtgtcaaacgccacgctcgaggcgatgatggtcttgttgcgcacgtcgatgccgtcgatgtcggcggacgggtcgcgctcggcgtagcccaggcgctgggcctcggccaggacgacgtcgaagtcggcgccctcgcgcaccatggcgtccacgatgtagttggtggtcccgttcatgatgcccgagatggacgagatgtcgtcgatcctgcgcgccttgaggatgctcgcgatccaggggatgccgccgccgcacgtggcctcgatgtacaggccggcgtgcgagaagttggcctggctcacgaactcgccaaagtgctccgcgacgacggccttgttggaggtgaccacgctcttgcccgcagagagggcgtccatgatgaaggtgtgcgcgggctcgaggccgcccatgcactcgacgaccagcgagatctccgggtcgtcgacgatgtcctggaagttggacgtcatgcgggggtcggtgaggcggtcgggcagctccaggatgcgcgacacctccacgccctccacgcggtcggtcacgatacggtcgacgccgcggcccaccacgccgtggcccaagatcgcaatcttcatgctctccctatctttccactgtgtgacgggctggggacccgccacgaccaaaggctatgatacgaaccaaagtgcaggaccatactcgtcgggcgcgactgccccgaggcaaggagcaccactttgatgaacatgttgtatcacagcacgcgcaatggctcgaatcccgtaacaagcaagcaagcaatattgcagggcatcgccccggacggcggcctctacgtgtcagacgggctgggccaggcgagggtggacctcccctccgtctgccaggagggctaccaggcgacggcgcgcagggtcctctcgaccctcctgaccgactacaccgaggacgagatcgcgtcctgcgttgcgggggcctacggggacaacttcgactccccgctcgtcacgcccctctcgcccgtgggcaaggactggcttctcgagctctaccatggccccacctgcgccttcaaggacgtcgcgctgcagatgctcccccgcctgatgtcggtcgcgcgcgggtctgacggacgccacgtgatgatcgtgaccgccacctcgggcgacaccggcaaggcagccctcgccggcttcgcgggcgtcgacggctgcggcgtcacggtcttctaccccgagggcaaggtgtccgacatccagcacctgcagatggtgacgcaggagggcggcaacgtcgccgtgtgcgccatccgcggaacctttgacgacgcccagacccaggtcaagcgcatcttcgccgaccgcgagctcgccggccgcctggcacagggcggcgtggtcctctccagcgccaactccatcaacgtgggccgcctggccccgcaggtcacctactacttcagcgcctacgcgcagctggtgggcaccggcgccatcgtggagggcgacgaggtagacttcgtggtccccaccggcaacttcggcgacatcctggcgggctactacgccaagcgcatggggctccccgttggcaggctggtcgtggcgtccaacgccaacaacgtcctcaccgacttcataacgaccggcacctacgaccgcaggcgcgagttcctcaagaccatctcgccctccatggacatcctggtttcgtccaacctggagcgcatgctctactacctcaccgacggggactgcgagcgcgttgcttccctcatggcggacctgagggagaagggctcctactccatcggagacgagctgctgggcaagctccgcgagacctttgactgcggcttcgcggacgatgacgagacgcgacagacgatccgttccacgtgggagggcgaccaccgcctgatcgacccccacaccgccgttgccaagacggtgctggacaggatcccccgcgaggggcgccagcgcgtgtgcctctcgaccgccaacccgtacaagttctccgccgacgtcctcggcgccctcggcggcgacgtggaggggcgtgacggcttcgcgtgcatggacgcgctccaggagctcacgggcatcgccgcgcccgcccagctctcagagctgagggacaaggccgtgctgcatctcgacgtgtgcaaccgagaccggatggccgcgttcgtcgagggcgcctgccagcgggtgttcgcatgagcggagcgcgcaaagccgtcgtgagcgtgcccgcgacctccgcaaacgtgggcgtggggtacgactgcctgggcatagcgctggacctcagggctaccttcacctttgaggagtccgacgagctcgttatcgacggctgcctggagaagttccgcggcgaggacaaccttgcctggaccagctacctcgaggcgtgccgtcgcatgtaccgcgagccaaggcccatgcacctcaccatcgactcgcccatcccgctctcgggggggctgggatcgagctccacctgcgtggtcgcgggcgtcgtggcagctcagctgctcaacggcgacggctttgacccccaggcggccctcaacgtggcgaccttcctggagggtcaccccgacaacgtcgcccccgccatcatgggcggcctggtgagctccttctcggacggcagggacacgcgctccctgcgctttgacgtcgcggacggcatctcgttcgtcgccatcgccccaccctacgaggtgaggacggcggacgcccgcaaggtcatgcccgagagcgtgtcgaccgagacctgcgtgtggcaggtcggccatgccgtggccacggttcaggccctccagtcgggcgactgcgacctcctctcggcggcctgccaggaccgtctgcacgagcccttccgcgcacgcctgatccccgactacgagccgctcaggcgcaccgccctcgccgcgggcgccgccgcgttcctcatcagcggctccggctccacgatgctcgcggtctgcgacggcgacgagggggcgaggcgcgtcgccaacgccgtcaacaacatggtcgagaaccacatcgacgggctgtgggtccgggtcctggggtgcagccccgaaggcgtgacgttcgaggcctagcctcctacatgacccacacattgcagcggcccccgaaccatacgggggccgctttcccttccgttgggggagagaggtcacgccaccacgtcgcagcaccaccgcacgggcgtggcagagagctgcagccgataggtgccgtgggcgagctcgctctggaacctctcctctcccccgttcaacgtgaacggaacgcacgtctcgcataaaaacgggccccgctctggcgaacgggacccgcacctaaacctgaaccatcccaacgttacccgcccaggtaggccttcctcacgtcatcgtcgtgcagcagctcctggccggtgcccgtcttggtgatggtaccggtctcgaggacatagccgcggtccgcgatggagagcgccatggacgcgttctgctccaccagcaggatggtcgtcccctgctcgttgagctccttgacgatgtcgaagatctcctgcaccaggatgggcgccagacccatggacggctcgtccagcatcagcagctggggacggctcatgagggcgcgccccatggcgagcatctgctgctcgccgccggacatggtgcccgcggactgccccatgcgctccttcaggcgcgggaagcgctcgtacacgcgctccatggtctcctggttctcggcgtcgctcctggtgtagccgcccatctccaggttctcctcaacgctcatctgcgtgaagacgcgcctgccctcggggcacagcgcaatgcccatcgagacgatcttgtggggcttgatgcctatgaggctctcgcccttgaactggacctcgcccgactcgggcttgagcaggccggcgatggtgttgagggtcgtggacttgcccgcgccgttggcgccgatgagggtgacgatctcgccctcggagatgtcgaaggagatgcccttgacggccttgatggcgccatacgagacgtgcaggtccttgacggagagaatcgtccccatctacttcacctcctgcttgccgaggtatgcctcgattaccctcgggtcgttctggatctcctccggcgtacccttggcgatgatcttgccgtagtccagcacggcgacgacctcgcacacgcccatgacgagcctcatgtcatgctcgatcaggagcaccgcaaggtggaactcgtcgcggatcctgaggatgttctccatcaggtcctcggtctcgttggggttcatgccagcagcgggctcgtcgagcagcagcaccttggggtgcgtaccgagcgctcgcaggatctcgaggcggcgctgctcgccgtacgggaggttgccggctttggtgttggcgaacctctccatgccaaagaagctcaggagctccatggcctggtcgtggaactcccgctcctgcttccagtgcttgggggtgcggaagatgtcgtcaaccaggcgcgtggacatggagttgccgagacccaccaggacgttctgctccacggtcatctggctgaagaggcggatgttctggaaggtgcgggcgatgcccatcttgttgacctgcaccatgctcttgccggcggtgtcgatgccgtcgagcaggatcgtgccgcgcgtgggcttgtacacgttggtgagcaggttgaagatcgtggtcttgcccgcgccgttggggccgatgatgccgctgatctcgctgcggcccatcgcgatgttgaagtcgtcgacggcggtgaggccgccgaagtctatgcccaggtgctccgcctggaggacggggatcgtccccaggtccctctcggggatgaggttgggggactccatctgcaccacgacgccatggcggttgttaggcattggcctccacctcctcgctcttctgcttggacttcccgcggaacagctcgccgttgatgagcctctccaggaagtcgcccatggagaagtcgtaggtgccgagcaggccctgtgggcggaagatcatgaccaggatcaggaccacggcgtagacgaccatgcggtagtccgcgaaggcgcgcagcgcctcgggcaggatggtgaggaccgtggcggagaggaccgagcccagcatggagcccatgccgcccaggacgaccatgaccaggatctcgatggacttcatgaagccgaacttggcgggggccatgacgccgatgcacccggcgtagagcgctccgccgacgccggcgaagaaggcggacgccacgaatgcgagcgtcttgtagtaggtggtgttgacgcccgtggcctcggcggcgatctcgttgtcgcggatggcgaggatggccctgccgtggcgcgacttcatcatggtgtggatcaggaagaggacgatgcccaccacgatgaacgtgttgaggaagttggtgtagctggggatgccagtgaggcccttggcgccgcccgtgagctcgaagcccaccacgccgtcgatgttgagcatcaccacgcggatgatctcggcgaagccgagcgtgatgattgccaggtagtcacccttcaggcgaagcgccgggatgccgatgatgaggccgctcaggcctgccatcaggccgccgaacagcacgcccacgatgaagagcaccaccgccatgggctcgcccgtgacgaacgaacgcatgttgaggtcgaagaccggcatcatgcggatgatgaagatggcgcaggagtagccgcccaccgacatgaagccggcgtggcccaggggcagctgtcccaggtagcccgtcgccacgttgagcgagacggccatgatgatgtagatgccgatctgctcgatgaccgtggtctggtagcggctgatgaagccgttgtcgatgagcccctcgcctatggcgagcatcgccacgaagaggagcgcgttgatgatgtagcgcttcttggtggagagggtcttgcgcccgccgccgttcctcgacgccttggcggtgacgtacggccgctcctgtcccccgttgagttcttggtccatcgtgcctcccctagaccttctcgttcatggtgcgcccgaggatgcccgtgggcttcacgatcagaacgatgatgagcagaaggaacaccacggcgtcgcgccagacggagaagcccatggcggacacgaagacctcggcaaagccgaccagcaggccgccgataacggcgccggggatggatccaatgccgcccaggaccgcggcgacgaacgccttggtgcccagcatgatgcccatggtgggcgtggcctgggtgtaggccatgctgtagagcacggctccgatgcccgcgagagctgagcccaccgcaaaggtgaacgagatggtgttgttgacgttgatacccatcagacgggccgcgcccatgtcctccgagaccgctcgcatggccttgccgaacttggtcttctgcaccaggagcgtgaggatgatggtggagatggccgtaaccacgacggtgagtatggcgaccccgttgaaggttgccccgccaatctgcgggttgggcaggttgaagtaggtcggcacgaccttggcgtcggcgccaaacaccagctgcgccccgttctcgaggaagtacgagacgccgatggccgtgatcagcaccgagaggcgcggcgcattcctcagcggcgcataggcgaccttgtcgatgaggacgcccaggaccgtgcatcccacgacggagagaatgatcgcgagcacgggcgacatgcccagctgtgccatcactatccaggatatgtacgcgccgaccatgatgatgtcgccgtgtgcgaagttgagcagcaggatgatgccgtacaccatcgtgtagcccagtgcgacgagcgcgtagatgctgcccagctgcaagccgttgagcacctgcgtcaagaacgtcatggcacacacttcctttcttcgtcttgcgaggacgcttgcgagacgcccccctatgcgcaagggcgccggggagactttcgcgcccccggcgccctagggcattcctactgcgagagtgccgccactagctggcctcgatggtgtcgaacacgctctccttgccatccttgaaggtgatgaccagggtcggcttcacggggtcgccggtgccgtcgtacttgatggtgccggtgacgccgtcaacggagccggacgagatggcgtcgatgatggcctgcttgtagtcgtcgtcggagggcttgtacttgccgtccttctcgacctgctcgatggcggtcatgacgaccatggcggcgtcgtagcccagtgcgcagaagttggaggggtcggcgttgtactcggccttgtagtccttgatgaactgctggaccttctcgtcgtcgttgttgacggtgaacgagcagtcgtagaagcagccctcgaggtctgcggcgctggcgtagtcctggtcgccgcccacgatgttggaccagccgtcggcgcccaggaagacgcccttgtagcccaactgacgtgcctgggtcacgatcttgccgtcgtcctggtagtagttggggcagaagatgcagtcggggttgccggagatgatcgtggtcaactgcgccttgaagtcggtgtcgccggcggagtagccctgcgggtcggcgacggacgagaggcccttggacttggcctccttgacgaaggcgtccttgacgccgacctcgtagtctccgccggagttgaagatggcgccgtaggtcttgtagccctgcttggccgcaaagtcggccatgagcttgccctggtacgggtcggtgatgcaggcgcggaaggcgttcttgccgtacttgatgaagtcggctgcagtcgcggacgccgagaccagcggcatgttgtcgttcacggacgcctgcgccacggcgatggacggggtggaggtcacgtcgccgatgatggcgacgacgccgtcctcgaccatcttgtcgtagacgttcttggcctcggtggcgtcacccttctcgtcctgggtgtcgaggtcgatcttcttcttgttgatgccgcccttgtcattgagctgcttcacgtagagctgggcgccgttgcggaccgcgaggccgtactgggccacgtcgccggagtagggacccatcaggccgaccttgatgctggagtcgtcgctagaggaggacccaccaccgcaggcggttagaatggatgcaccacccagacccgaagcagcgatgccactcagcttgacgaagttacgcctgctcatagcgtttgccattgttcaccctccctgggctagacttcccgggtcgccccgtggcgacctctcaacgggtactctagacgcaagccgaagggcgcgcccgcagaacgggcatcgttttcaagctcgtaacacactcgacaactttttatgatgttggcctatctggcgttttgacgtgccatttcttccacaatcgatgccagaccgcaagtttccggactataaatgatttcatcgccttgcaatcttggaaatggcgagcgacaagaccgcgccaaacgccacgccactgaggtccaacaggacgtcggtgacccgtccgctcctgccgggcacgaacagctggatcgcctcgtccaccacggggacaaggcacacgagcagggcgatgagccgggtggcagcgcgcgacttggtcctcatggcattggagaggcgccatccaaggatacccaggacggtgtactcgatgaagtgcgccatcttgcgcaccaggaaggtgcgatcgccccagctggtgacgcccatggcgcccagcaggtccatgatcggcttgaggcgggcgaagaagtcgctctcgcccgaggaggcggtcccgtccctcagggagtgaccccatatgaaggccatccacaaacacaggaccagggctcggagcgggacggacggccttccgcccttcttgccgccgcgcctctcgaggggcatgggctaggcctccctgacggagccggccatgtgcttggggctgccctcgcgaccctcgcgcctgcgacgcgcgagcctcgcgagcttgttggtcccctcggtcgactggctgcccccctcgatcacacggaggtagtcgcgcgacgacttgcgcgccgcctgcgagcggttgtgcgagaactcgtcgtcgatcaggtagtccacgtacgtctcggtgtccacgacctctgggtgtccggcgggggtacggaaggggatgaagctcgtggggccctccaggccctcggggtcgtcgatggtctcgatgcctccgatcgcgtcgccggcgaagggggtcgctggcgtcatctgctcgagcctctcccccatcgcggagagcgcctgctcccacatgtcgtcgtggtcgagctcgctcgccgaccgcttggcggggaacattccctggtcgacctcggcgacgctctgggcgatgacggcggcacgcgccttcgccgcggcgttggggcgcggggagggaacgacgccgcggtgcgtgggcttgggagagacgtcccccatccagcgcgggacgtgcaggctctgggtgtcgtcgagctcgtcgctcgtggcctggacggcgggcttgccgcccacgtacaccacggagtcgcccaggcgggcgttccaccagccggtccccacgtcccccacggtgccgtcggcacgctcgatcacggggaggtcctcaaacgggtcgcggtcaaggcgctccgcgagcacctcgcggaccccgcgagcacgctgcgccatgcgctccaggaagttctcgcgcctcacgtagctctgcgccacgtcctcgtagtcgctcgaggcgtgcgagggatggtcggcatcgacgacctgcggaaggcgctgcagccgcaggcgcgccgtcgatgcgacggagtcgtcgtcagcggggttctcctcgctcgcctcccccgcaggaacagcctggggctcaggcacttggggttcctggattacgtccagcggctcgagcaccccggtgacctgggactccaacgtctcgtccggctcctgccagtcgtctgacgccaaggagacgcgcgcctctcccccatcggcctcagccagctcgctgccggcagcctcaggaccgtcggagaggtctgaggcgtcggcgtcgatgaccgacccccaggggatggagggggcgggctcgccgggcttgcggaagtgccttccctgatactcgggctcggcgcttacgatgggctccagggggttggtcacgtcgagggaatcgtcgtccagctcgccgatcgccacggattcctcgttcgaggccacggcctcatcgggtatggagtcctcccccgcactcgccttcttgcgagcggaggcagcctgataggcgcgggtgaccgcgatgccggcgacgacgccgacaccgaacgggacgatcacggagaggggcgaaccgccgtcagcgccatcggtcgtggcggcaagggcggtcgccgggcatgcgaaggcagcggcaccgagaagcccagccaggattgccggattgctcttctcaactgccatgaaactctcctccgcttagacgccgagcgcaagacgaccactcttggagaggagaagacagcaccgggacccaggggctcccggctggcgacaacggcttgcttcgtctctgcttcgtgtaccgtcgtgatatgcgcttgggagcaacctcccagtcgctacctatgataccgagccttcacgtggattcaagccagacgtggggttttggtcccgttgcggatgacgtttgcatggcaggttcactgcgacggcattggatactggtctgggccgtttcgggatgtttgcagagaggcaagaacactctcgtgcgggcggtacagacagatgccgggcaggagtacgtgacccctgcccggcagcagctcggaagaccctcaagcactgaaaggcgcagaccctagccctggtaccacgtgggcgtcttgatgcctgcggcgcagccctcgaacattccagagacctcggtgccggaagagcttaagttccaaaagttcagcggggtcgcatccgaaagcaacgtgcagcggtagaacattcccctcatgtctgtaacgttggaaacgttccacgcggataggggcgccagatcggtaagcgaggagcaaccttcaaactcgttagccataacagtcacgtttgagacatcccacccagacagaggagtcaaatcagaaagtgagctgcatccatagaacataccgcccatgttcttgaagtttccggtatcccatttgtcaagcccgatgattcctgtgagggaagagcaatcctcgaacatcgcggttgcgtcctcaacatctgagacatcgaggttcgaaacgtcaatgctcttgagtgaggagaagtacgcgacgttgatatagccgtcgtcgcttgagaacagcctgttggagtccaccggggccttaacgcccttatcaatcacgattgaagtgaccttcgaaagatcaatcaaagtctgggacgaatcctcgagtgaaaacacgaaagtctcccacaggtttgccatcgtccccgtcttgccatcggtgggagagatttccagcttgccgtcgccgtagagcgtccaggtgcagccctccccaaactggccctgggcggtcacggtctcccccgccgccttgctcgtgtcgaccccgtaccaggcgatgccctcgtacctccagccgacctggaccaggtggtcgctctcccccttgctcgtggtgtagttgtgggcgcccgccttggcgttggggttgtactggcggtacaggaggacggccttggtgtcggagctgtaccagccgatgccctcgtacctccagcccacgctcacgaggtggttcttctcggcgaggctcgtggtgtagtggtggtcgccggcgttggggttgtacagacggtagaccggggtgtcggacttcgtcggcgccgtccagccggtgccttccgagcgccagccaaggcggacgagcatgtcgcgctctgcgccgttcttggtgtagaagtgctcgccgctgttggggttgtagaggcggtacatgggctgcgtggcgcccgagtccgtggccagggccggtgtcgcggggaggcacagcgcccccgctccgaggcctgccgcgaccgccactgccgcaagcccgttcctgaggttgcgcatatgttctccttcccacggagggccacccgacttggccctggttcaggggaaggatagggagacttcaggcgagggggggggtgagttttccacagatggtcaatttttgtcggcgtatggggtttaggacatgaaactacgccattcagaaacctcagaccagctgtttgacctcattgcggcgcgagatgataaaagggcgcccatggagaaagtcccccgggcgccccttatgagcgtgtattgagacgggcctacgacacgtactcggacatctgcgccttcttggcggaacggatgaggaactccgcgttgtcgttggtcgcacgcagccccttgaccagggcggtcgcggcgcgctcggtgttgttcatgttggcgagcacgcgacggatgccccagatgaagggctgcagctccgggtcgagaagcagctcctcgttgcgcgttccggaggcaatcgggtcgatggcggggtagatcctgcggtcagcgaggtcgcgatcaagcttgagctccatgttgcccgtgcccttgaactcctcgaagatgacctcgtccatcttggaccccgtgtcaacgagagcggacgccaggatggtgagcgagccgccgccttcgatgttcctcgccgcgcccaggaacttcttgggcgggtacagcgccgcggagtcgacgccgccggagaggatcctgccgctggcgggcatagcgaggttgtacgccctcgccaggcgcgtgatggagtccaggaccacgaccacgtcctcgcccatctcgaccaggcgcttggcgtgctcgatcaccagctcggagaccgcggtgtggttgcttgccggcatgtcgaacgtggaggccaccacggtcccgcggatggagcgctccatgtcggtgacctcctcggggcgctcgtccacgagcaggcagaacaggtgcacctcggggttgttggcggtgatggactggcagatcttcttgagcacggtcgtcttgcccgccttggggggcgagacgatcaggccacgctggcccttgccgatgggcgcgaccaggtcgatggcacggccggtgatggagtccctgccgtgctccataatcaggcgctcgttggggaagatgggcgtgaggtcgcggaagcgcggcctgccgcgcatctcctcggggggacggccgttgatgctgtcgatgtggtgcagcggcgggtacttgctgttgttgcgcgcgggcgagacggagcccttcacctcgtcacccgggcgaaggccgtactgcctgatcagctgctggtgcacgaaggcgtcgccgtcgcccgccatgtagttgcccgtgcggaggaagccatagccctcgttctgcatctcgaggatgccctgcaccggcctgaagccctcggcgagcgccgcggcctcgtacaccgcctcggccaggtccttcttgcgcacgcccacgtaggggatgcccagggactgggccttctcgcgcagctcggcgaccttcatgagcgagacctcgtcgcgcgtcaggctgggctccacctgctgctcctggcggcggtccctgcggttgcgacggcggttggagttgcggttgccgccgttgccgtaggtgccgttgccgccgttgtgcgaggcctgctgcccctcatggttgccctggcggtcgttgccctgctgacgacccctgcggcggcgctgctggtgctcctcgccgtgccgctgctgctggtgctggtcgccctcctgctcgcccgcgtcgcttgtggcggcatctgcctcggtgagcgttgccgcgggagcgcccagcacgcgctgcccggcctcgtcctgcgccttcgcggcatccgtgggacggccaccctcctcggtggcctgcggggcgtcggcagccacctcctcggcgggcttcaccttgcggggacggccacggcggcgcttgggcttctcggccgcgggcgtctcctcaacggaagtcgaaccgccctcgttcgctacctgtgcagccttgggagtctcctccgaaacttggagctgaggtgcctcgccctgctcgggggcatcctccgccacattcaccttgcgggggcgaccacggcggcgcttgggtttctcctccacgggggcctcggatgccgtcgcaggctgaagctgcagctcgacctgctccggggtgccctcctcgcccttcttggctgccgtcttgcgcgtggtgcgcctgcgacgcggcttgggggcctcctcagactgcgtgggctccgagccctcttcctggttgtcttctgccatcaaggctacctttcttgcgccaggcagcttctatccgccgccaggtccaaagctgttctcatatggggagaggtgcgacttcccgtgccacaaaacggcatttacaagggagtgatgtcacgctggaatggcaatgccagactcacatgcgtcgcagcctcgcgcaacgagccgaatatagcataaccacgtcgcaatgccagcatgcgacatgaaaaatcgcccgatcccgcggccaaaggctggatttcgggcgatttgcattcattctctcgtgttgggagggcctactcggcaccgtcctccttctggcgcctcctcgtgcgaggcccacgcctgacgacgacgtccgagatccttgccctcaggtcctcgacctgcgcccacccgctctcggtgagcctgatgttcacaaagcgggagccggggacctcggcgctcttggtgacgacgccctcgtccaccagggtcgagacggacatggacaccgtgggctgcagcagtcccagggcgttgaccaggtctgagatggtcatgccctcctccccgcccatcgagaggcccaggagcgtgagctcgccggccatgcaggggatggcgcccatggcgtcgatgtagcggcagatgcggtccgccgtcgtgcggctgagcgactggccggggagaatctgcgcacgtgtgcgctcgcagaggtcgcgcacgcaggcacgcccctcgtcggtgacggtgcagacaacgttgcggcggtcgacgctccccttgacgctgctgatcagccccaggttggaaaggtgcttcgtcctgtgcgtcatggtcggcctcagggcgccctggtactcggcgatctccgaggtcttgaggccgcgacccgagatcgtcagcctgcataggatggcgaactcgctgaaggtcaggcgcctctttgcctctatgtcctgcctcacgaggttgtatgccctgcgtatggacatgtactcacgaagctccatgcggcatccccatctcccgtgacctaaagggagacgcctcgtcacgatggtggcgaggcgtcccgcactcggttccaacgtttatctgaccatacccctagttgcagggggtccatccttgcaggatggcatagttcacttcgctgaaacctaaatgtttaacgagcgcagaattacatcacatccggtgcggtgacgccgatgagcctgagggcgacctcgaggttcacgcgcacggcgtcgatcgcggcgaggcgggcacgggagaggccctcgtccaccggacgcccctcgctggggagcacctggcatgcagcatagaagccgtggaagtcaccggcgagctcctcgcagaagtgcgtgaggcggaacggggcgcggtcgcgcgcggcaccggcgatgagctcggggaactcggagagcttgcgcgccagggctgcctcggtgggatcggtcaggagcgagaggtcgtagtcggggccgatggccttctgggccactgcctccatgcccatctcctgcgcctgctcctcggtgacgcccgcagccctgcggaggatggagcagatgcgcgcgtgcgcgtactgcacgtagtacaccgggttggagttgttcctctgcttcacggcctcgatgtcgaagtcgatggtctggttggaggacttggagatgagcgtgtagcgcgtggcgtcgacgccaacctcgtcgatcagctcctggaaggtgaccatggtgcccttgcgcttggacatgcggacgggctcgccgttgcggagaaggttgacgaactggccaaggtcgacctcgaacttgccggggtagcccagcgcgtcgcacacgttggtgacgcgggcgatgtaaccgtggtggtcggcgccccacaggtcgatggagtagtcgtcgcgctggaacttgttccagtggtaggcgacgtcggaggcgaagtaggtgtactcgccgttggacttgatgaggacgcggtccttgtcgtcgccaaacgcggtcgacttgaaccacagcgcaccgtcgtcggtcttgtagaggtagcccatctcgtccagccgcttgaaggcgcggtcgacctgagaggtgcccgactcgtccttgacatagagggagcgctcggagaaccacaggtcaaagtggcagcggacctcgtcgcacgtggccttgatgcgggcgagcatcttcttgtaggcacgctcgcggaactcggcgtcacgggtctcctggtcggcctcgacccacttctcgccgtcctcctggtagaactcgcgggcgatctcgacgatgtagtcgccgccataggagttgccgcccagggcctcgttgaactcgtccatgtacgggtggttctcggggtgctcgtcggcctcgtcgtccacgtacgcctcgcggtccttgaggagcttgtcgtatgcctggtcaacggtgacggcggcgtcgtgcatgatctgcacgagctggaggtagcgcttggcgaccgagcgcccgaagacgtccatctgcgagccgtggtcgttgatgtagtactcgcggtcgacgtggaagttggcgtgctccagcacgttgcacatggagtcgcccagagcggcccagcggccgtgcccaacgtggagcgggccggtggggttggcagagatgaactcgtagttgaccttgaggccatgaccctcgtcgcacttgccccagtcgccgccggcctcgcgcacggtgcggaagacctcgttgttggaggcggcgctcaggtagaagttgatgaagccggggcccgcgacctcgaccttggaaacctgcgggtcctcgggcatgtggctcacgatcgcagcggcgatcttcgcgggggccatgtgcgccaggcgggcggagcgcagggcgacggtcgtggaccagtcaccgttggagctgtccgccggtcgctcgacgccgaggtcctccacctcgaactccggcaggtcgcccgctgcctgcgcagcggaaatggcttgcttcacaagcccctcgatcgtctctggcatgaaatctccttaggtcgtgccaaaaatgcagaagaacgcatacttagtgtttgagtttatatcaggcgcaatggatggtgggttcccatttgcaaatgagtcagattcgacctggcagaacccgccgccctagctgcgacccgaggcccagcgctcccggcgtgcgagctcggagcgcgtgcgcgcgaggccgagctcgagtcccaccgggtaggtctgcgggttgaggaagcgcttgacggcggggtcgagcctcatgagcgcctcgcgacagcgcgccttggcggcctcgatcccctccggggcaccgcagggctctccggcatccaccagctgggtcaggagctcgcgcggctcggcgtcgcccatgtcgtagctcacatactcgtccaggacgtccaccatcgccgtggggtcgtcccccgcaaccgcgtcgtccacgatcatgtcgcccaccgggcagcccgacgcgtcgtaaaacctcctcacgtgctggacgcccgggatggtccgcttgtacgcggtctccgagagcttgatcacgggctcccacgggctgtcatgcgagacgcgcgtggcgctcagcttgtagacgccgccgagcgagggttgcgggtcgcaggtggcgagcttggtgcccacgccaaacgagtcgatgggcgcaccctgggcgaacagcgactggatggtgtactcgtccaggtcgttggacgccgagatcttgacgtaggggagacctgcggcgtcaaactcgcggcgcgcctccttggtgagcttggcgaggtctcccgagtcgatgcggatggcggcgaggcgctctcccctctcctccatctccttggccacggtgatggcgttcttgatgccctggtggacgtcgtaggtgtcaagcagcaggacgcagttcttgggcatcgactcggcgaaggccctgaacgcgtcgagctcgctcgggaacgccatgacccacgagtgggcgtgcgtgccaaagacggggatgccgtagatcttgcccgccaacacgttggaggtggagcttgcaccggcgatgtaggaggcgcgggcgaccgcgaggccgccgtccgggccctgtgcgcgcctcaggccaaagtcggagaccggatggccctccgccgcatggaccacgcgggccgtcttggttgccacgagcgtctggaagttcaccaggttgagaagggcggtctcgagcagctggcagtcgatgatggggccctcgaccctcaccatgggctcgcgggggaacaccaggtcgccctcgggcaccgcccagaccgagacccgcatgtggaagtcgcgcaggtagtcgaggaagcccgccttgaacatggggccaccgcccggagcctggatggaggccaggtagtcgatcacgtcgtcctcgaagacgaagttgctcacgaggtccgcgatctgccccatgccgcacgccacggcgtagccaccgccaaacgggttgtcgcggaagaagacgttgaagcacgcctcggcgtcgaccatccccgactcccagaagccctgggccatggtgagctcgtagaggtcggtgttgagcgatacgtcatgtgggttcgttcggtctgtcagtgccatggtgccttcccttcgagaggcgccccgccacgcacgcagcgcgacggggcgcacctgggctaccttcccaagttcatgaccaggatgatcgcgacggcgaccgcgatgataccgacgaggacgatcttctgccccaggggcatcttgaggtcgtcgtcgggctccatgatcttcgcgttgcgctcgcggacctcccggatgcgcctgtcctcctcggcgtcatgccgtgccctctcgcgctcacgcttgagccgctcgagctcggcgcgctcctgcgcggcacggctcgcctcctcgcgctgggccttctcgcggcgcagcgcctccagctcctcgcgctcctcgtcgctcagcggcttggtgtcgtctgccatcgcacgcatcccttcccggcccgcgtccgtgcgggcctcataagcaagcctaaggttagcccttgtcgcccagttcggggccgcgcaccccggtcgcgtcgaaggcgggcacgaagctctcggacaccgtgcccccctgctgccaccacatgcgctcgaaccccaggtcgtccgcgtggtccaggacctcctcgtactcgtcgtccgtgacggtgcgcgcgagcgcgccacccgcctcgcggcactggcggttgggggtgtactggttcatcaccgagaggtcgacctcgttgccgcagagcccccacacgcggtcgagcaccgccttggagtcgtccgcgtggccggggagcaccaggtgcctcaccacgatccccctgagcatgcggccgtcctcccccagcagcctgccgcccttcgtgcggagcgaggcaagcatgcgggcgagggccctgtgcgccacctcggggtagtcgggggccttcgagagcctgccggcgagctcgcccgaggcgtacttgtagtcggtgagccacacgtcgatcacgtcgcccatctcgtccacgacttcggcggtctcgtagcccgaggtgttgcacacgatggggagcgtgagcccggcatcgcgggcgagacggaccgcctccctcacgtgcggggcgtagtgcaggggcgtcaccaggttgatgttgagcgcgccctgtccttggagctcgagcatcctccgggcgaggcgggaggtcgagacggcgagcccaaagccctcctgcgagatctcgtggttctggcagaacacgcagcgcaggggacaccccgtgaagaagatggcgccggagcccgcctcgcccgagatggggggctcctcccagtagtggagcgcgctgcgggcaaccctcagcgtcgccgtcgcgccgcagaaccccgccacgccctcgagcctccgcgccccgcacgcgcgtgggcagaggttgcagcgcctgtacgaatcggccgagaccatcacgtttcctccctcgcggcgggcgccggggcatgacgcccccgggagccccgcaggccaaccgcctccggctgaggaggccgcgcggcacgcgtcgctcggaccagaccctcggacgcggttcgtcgccctaaggaaagggcaccctggcgaagccaaggtgccctgcgatcacatggtggagatgaagggattcgaaccctcggcctctgccttgcgaaggcagcgctctcccagctgagctacatccccaggcgcattttcgcgcaagaggtagtatcccgatttccacggcgggtgtcaaccacttttcgcgaccaaatgaaatgtcgccccctgcggtcgcgtaatgaacccacctctcaaaaaggtgggtgccctcgtcgtctcttccagcttccccaacaacgggggatgcctgtactaagagcgatatatgggctccctcgaaacgcttgtcggttcaccctttattgctccgcagggggacgacgtcttcaatatacgagaacctcgccacaatgccagtcttgacttggggagcggcatcgcaaagacttgtgagttgcgggcgttcgcgcggcttcagccagccaggacctttgtggacgcctcgtctcccccatcttcggcgcgacctgcgcgcatcccatcgcacgtgtgcttttccacgccggcgcggcactttgtcccccctggatgaacatcctgtatcatgaacgggtctatgcggcgtcgatgcgggcgggggtgagaggggcatgatccagtcttgggtctcgtacctatgcgtgttcgccgcggcgcttctcacctcgctcgccctcacgccccttgcgggaaagatcgcctggaggcttggggcggtcgactaccccagcgcccggaggatcaacaagagccccatcccccgcatgggcggcatcgccgtgttccttggcatcatcgccgcgttcgtggtccagtaccttggctccgtctacctgggatggccacccgtcctcatcccgagcccccacctcgagagcctgcgatacgaaggtatcgcggtcggcttcgcgatcatattcgccacggggatgctggacgacgtgttccagctcaagcccctccagaagctcctgggtcagtttctcgcggcgtccgtcgccgccttctccggctgcgtcatcggcgtgatcgtgaaccccttgaccggcggccccctcgagctcggttggctcgcctaccccatcacgatcgtctacctcgtcgcgtacgtgaacatcttcaacctcatcgatggcctggacggcctggcatccggcatagccgccatcgcgagcctgacgatgttcatcctgtcgtatcttgcccgccgcggcgatgccgcgagtctctcgattgcaatcctgggctcgacgctcgggttcctgcgctacaacttccacccagccagcatctttctcggtgactccggatcgctcctcataggttatgccctcggtgcggcgtccctgctctccgtcacccgcgtcgcgggcctcaccacgatcatcgtccccctggtcatcgccgccgttcccatcatcgacacgttctccgccatcgtcaggcgctggagggcgcacgtgagcattggccaggccgaccgcggccacatccaccaccgcctcatctccgagggctttgaccagagggaggcggtgctgttcatgtatgcctggactggcgtgctctgcctgggcagcatcgtaatgacccaggtctcactctggccccgcatgctcatcttcgctctgctcctggtggtctccgcaatcatcgcgcgccacctccacctgttccggcccgtcctcctgcaccacaccaaccccaagactggagacgacgagctcatctccccccaggatccggacttcaaggccgaggaggagcgcctggaggagcgggagcacttccatcaccaccaccaggacgaggactagcccctgggtggtgcgcgctcgtctcccccccccccccccccccccccccccccccccccccccactcgtccccgcggcctcctcccctggcagagactcgctcgcgcgagcgtctccgcacggccggcgtcgtctgtcgcgtgacgcctcccagttggcagggcatcagctctagaaccatggcaaacaaagcacgatgtgagcgttttcaccccgagctccagtaggcggaatcagacagcacttgcatttccgcgggcacgggaggtacgtccggagcctaggcgaagcaggtggcaacaggagcccgatgtgtgcactcacatcgggagttttctgccaatgaagccgttcccacacccagaatggcagcagattccctatgtgagcactcatatcgggagccatctgccatagtcgtaggtttaatctctgacaactgggcatacgttaggttcagccccccaacgagccgcaggcgcctgatgggcgtactcacatcgggagtttcctgccaatgttttaggattgatggtgaccgcacgtacggaagccgcacccgaaaaggtgagacattttcctgggcaaacgaaattatcgggacgccgtcagtatgaccgccccatgcgcacacacgctgggggtgcggaggttccgtcagcctgcttcccccgttgaaagcacattggcagcccggcgtcaccagaaagtgcgccccacgcgtacgcgcggcatgcaccctctaacgaccgcgcagccatccaagaaaacgtgggcttctctgagtccggccaacccgtgtttgtgcccctccccctgaaaatggggagggccccttgggacatcgttgcgaggtaagggattggccgccccctccccttctttgacccctgtcaacccatcgcctctggcggtgcacgagccctcgcctcccttacggaagctattctttggggggcaggacacaccgcagcattttacccgcaggacgtgaggggggcagcccgatcccctcttgacccttgcggcttgtcgcccatggccgggattcccgacaagacgaaatccccggatcacaggcgaggtccctctccccagtccatacgcatgcgaaaggggccctctcccatgggagagggcccctccaattggcttgaagccttgtgctactcggcctcggcgagagccttcttggccacgttggccaggtcggcaaaggtcgcctcgtcctcgtaggcgatctgggagaggaccttgcggtccagctcgacgccggcgagcttgaggccgtgcatgaacttgctgtaagagaggtcgttcatgcgggccgcggcgttgatgcgctgaatccagagggcgcggatgtcgcgcttcttgttgcggcggtcacggtactggtactggccggagtgctgggcctgctccttcatgcctcggaaggtacgcgagctggtgccgtagtagcccttggtgagcttcttgagggtctggcgcttcttgcgaccggcgactgcgcgcttgacacgtgccatatctaatcaactcctagaaaacgaaattatgctgacgcgtgtgcgcctgttacttgcccatgcgctgcgacacggtcttggcgtcgctggggcagagcgcggtctccttgcggaagccacggatgcgcttctgggacttcttggtgaggatgtggctcttgaaggccttggcgcgcatgatcttgccagtgccggtgcggcggaagcgctttgccgaacccttgtgcgtcttcatcttgggcatgctagttctccttctcggtctccacgtcgtccttgtcggccttcttctcgtcgaaggcacccttgatcggggcgacgaccatgtgcatgttgcggccctccatcttgggggcggactccacggtggcgtagggcttgaggtcctccgccaggcggtcgagcaccatcctcccctgctccgggtgggccatctcacgaccacggaacatgatcgtgatcttgacgcgcgcgcccttcttcaggaagcgcatgacgtggttcttcttggtggtgtagtcgcccacgtcgatcttggggcgaaacttcatctccttgacctcgaccttgacctgcttcttgcgggcggccttggccttgcggtcctgctcatacttgaacttgcgatagtccatgaccttgcagaccggaggctccgcgttgggagctatctccacgaggtcgaggttctgctcgtctgcgatgcgctgggcgtcgcgaatgccgaacagaccaagctgggaaccatcgacgccgatcaggcggcaggtacgcgcgttgatctcgtcgttgatgcgaggaccctcgttcttggctatcttttacaccttccttcgcttgtgccccacggcaataaaaatctcccgcagccatgtcagcccaggagacggaccccacccatggtgggaaactcttctcttgaccagacagctgccttgggcgccgtgtaggtgggggcctctcgaccccgcttctcataacacactcgaacaatattagggacagaccgttgcccttgcaagtgaaaatccagccccaccatatctgcacgggcgggagagacgtaccgccactaggcagccacgtgtgaccaggggacccacggcaacggacttcagacgagtggagtaccgcgcatctcgcgcgaagagacctcatgcctcgcaacaaatggtgccccgggtgggactcgaacccacactccgttgccggaagcggattttgagtccgccgcgtctgccaattccgccaccagggcctgtcgattccgtcgacgccttcgcatgataccagaacgcgccgcgcccatggccagcgtccgcgacctacgccaggaagggattctccctcagctcacgcgccatggtcgtggactccccgtgccccaccaagagcgtggtgtccgggtcgatttcgcgcgccatgcggtgcagcgacgagaggatagtggcctcgtcgccaccctcgaggtctgttctgccgtgggaccccggaaagagggtgtcccccacaaagcagacgccccgggcggacccgccacccaccaggcataccccgccaggcgtgtggccgggcgtctccatcaccctgaacgtggcggtccccaccctgaggacatcgccctcgcctaggtagcggtcggcgaggggggcatcctcgtcgtaacgcaggcccatctcgttgacctcgccggcatgggtcgccagctcctcgtccgctcggctgatggcatagggggcgcccgtcgcacgcccgagcgcggcgacgccgcccacgtggtccccgtggccgtgcgttgcggcgatgagaaccaccttgacgtcacccaggcgcgaggcgatctggtcgccccagtcacccgggtcgacgaccatggcctcgccgccgctcacgtacgcgtagcagttggtctggatggggccaaccacaaactggcgtatctggtccgccgaaccgtccctctcgctcacttgacgcgcctcttcatctggttggagccctcgcccggcatgatgcggcgggcatcgtacacgctggggacgcgacccacggtcgcgagcatgggcgcgaggcggctggcgtcgctgatggcgacgaggaacctcaggcgcgccacgccggagctcgaggtctgcgtcgccgccgagaggatgttgccgcccgagtcgccgatggcgatggtcacatccttgaggagccccatgcggtcggtggcctccaccacgatctcgacctgaaactccgtggcccccgtagtgtcccactcgacctcgatcatgcgctcggggtgcgccatcaggcccttgacgttggggcagctggcacgatggaccgacacgccgcggccgcgggtgatgaagcccacgatgctgtcaccggcaacggggttgcagcagtgcgccaggtgtaccagcaggtcgggatcgcccttgaccaccacgccgcagttgcgctggcgtctcttgtccgaggcggcccggacctccgggctcgcgagcggcatgtcctcggcgagcgcctgctccttggcggtgcgcttggcggcgacgcgctccgcctcggcgaccttctccggcgagttctcctccagcacgccgatgaccttgttggccacctgcttcacgctgagcttgcccgcgcccaccgcggcgaacaggtcgtcggccttcacgaagtcgagctgctccacgaccttgtcgatcgccttggtcgtgcgttgggccgagatgccatagccatgcttgcgcagctcgtggcccaaatcgcttctcccctgctccgcatcgtccaccttgctgagcgaggtgaagtacttgcggatcttggccttggcggagggggtcgccacgatgttgagccagtcgtgcccgggcttggagttcttgttggtcaggatctcgaccctgtcgccgttctgcaggcggtaggtcaggggtaccaccgagccgttgaccttggcacccacgcagtggttgcccacctcggtgtggaccgcgtacgcgaagtcgaggggggtggagtccctcctcaggctcatgacctcgcccttgggcgtgaacacgaagatctcgtcctcaaagaggtccacgcgcaggttgttgaggaactcgtggggatcgcccatctcgtcgtccacggtccagtcgaggctgcgacggatccagttgatctggctgtcgatgtcgcggtcatcctggctcatcttgccccgcgagtttcccgagcgcttgtacagccagtgggcggcgatgccgtactcggcctgctcgtgcatctcgtaggtcctgatctggatctcgatgggccgggcgtccgaggcgatcaccgtggtgtgcagcgagcggtacccgttgggcttgggcatggcgatgtagtccttgaagcgcccggggagcgggtgccagagcgtgtggactgcgccgagcgtgctgtagcagtcgcccaccgtcttggtgaggacgcgcagggcgatgaggtcgtagatgtcgtcgaactccttgcgcttgcgcgtcatcttctggtagatggaccacaggtgcttgggacgccccttgatctggtagcccttgaggccaacgcgcgacagctcatcgtcgagcgtcttgatcgcctcggcggtcttctgctcgcgctgggcgcgggactcctgcaccatgcgggcgattctctcgtactcctcgggctgcaggtagaagaaggccaggtcctcgagctcccacttgatggacgagatgcccaggcggtcggcaagcggcgcgtacacgtccatggtctcgcgcgccttgaacgtcctgcggtcgggcgggagcgccgccagcgtgcgcatgttgtgcaggcggtcggcgagcttgatgatcaccacgcggatgtccttgctcatggccaggaacatcttgcgcaggttgagcgcctgcttctcgtccatggaggcgacctcgatggaggtgagcttggtcacgccgtccaccagctccgctaccgtgtcgccaaagcgctcgcgcaggtcgtcgagggtggcgggagtgtcctccacggtgtcgtgcagcagcgcggcgcagatggtgtcctcgtccatgtggagatccttggccaggatcagcgccacctccacggggtggttgatgtagggctcgcccgagcgacgcttctggctgcgatggaagtcggccgcaaactcgtacgccgacgtgaccttggccagctcctcgggcgagaggtacgcggcgcacgtgtccgagaggacgcgccagttgtccgcctggggtgcgttgcttcgtcgtgcgacgctcggcgcgccgccagtggtctccacgctcatgattcctccaaagggcccaccctggtgccaaatcccggcgtgatgggactgttgatgcgggcgagcaactcgtcgggactgctagagagtacccaatccctgaaactgagaaacgcgtcgcgggacctcaatccctcgaggtagcgaatggagcggtcaagctcgacccgctccggcgactcgctcatggcgatgctcctgccagagccgtagccgctcgtctcgaggaacccgagctcccggaagatcccgatgccgcacgacacggaccgctcgtccagccgcgtggcggggttggactccaccgccgcctgcgcgatgtccgcgttggtcatgcggatgggctcgggtccggcggacccgtcgcccctcgagaggcccctcagcacgcgatagagcgtgacgaggtcgccccgctcgggggccgcggaggccaggatgcgctcgttgatgcgggcgtcgcgggcgccgaacatgaggtgcacgcgcgcgtctgccccgtctcgtccggcacgcccgctcatctggttgaactcgatggcgccgaagggcatgtggtacagcatcacgttacggatgtccgggaggttgaccccctcgccaaaggcgctggtcgagacgatgcagcacagcgtgccgctgcggaaggcgtcctccacgcgtgtccggtccgacctcgtgagccccgcgttgtagaacgcgatccgctgccccaggtcggggatgcacttgcgcagcatgcgcgcgagcgccaccgactgctcccgggagttcacgtacaccacggtcttctcgcccgtggcaacgaccgagaccagggccgcctcgcggtcgcgcagctcgcggctgtcgaccaggtggaggttctccctcacgctggggtccaccaccacgtccgcctggtcgatggagaggagccggcagatctcgcgcgccacctcgtcctgggcggtggcggtcaccgcaagggccgtggggtcgccgagctggcccagcacctgcgggagcgacgagtacgcgctgcgattgcccccgcgcgaggtccccgcgtggtgggcttcgtccaccaccacgaagccgatgcgccccgaggcggcaaagcgcgcggcgtggatggccaggaactccggggtggtgagcaggacgtccgccttgccctctgccagcgcggcgaaggtgtcgtcccgctcgcccatgcccgtctcgcccgtgaggacgcgcacgcgcagccccagcggcgccagcgccgactcaaggtggaaggcctggtcggacacgagcgccctcagcgggtacacgaacacgctggcacgcccgcgggcgatggcctcccttgcggcgtggatgtggaagatgagcgacttgccccggcccgttgccatgacgcagagggtggagcgccccctggccaggcggtccagcgcgctgtcctgggcgggaagcaggtcgtgcgcaccgatcatgcggcgacggagctcgtcggtgagctcgtcgtagcccagcgaggcgagtctctgccgctcccccgccggcgccagggggtcactgtcgcgggagggccgcacgtcgtggcgcacgacctggatgctcacgcccagtgtgggcttctccgccgtcccgccggtgatccccagcacctcggcggaataggccgcccctgcgtccatggcgggggcgagggcggccgcgatctgccgccggaggaacccgagcgaggaaccctcggccgtctcgaccgcgatggcgttggggtcctcggggttgtcaggctgccgcacgaccgagagcgcctggccctcccggagcgtcctggcgcagtcctgcctgccgtcaaagctcacgcccacgaccttggtcacgaacgacgacgcctcgacgatgcccgagtactcgtcacgcgagaggatctgggaggcgcgggagaacagctcgtccgtgatggactccgactcctccgaggggacgctgcggcggtcgaggtcgcgatagaggatgtcgcgcaccatgagcttaggcttggtgcggccctgccaggtctcggcaacgggctcgaacaccaggtccacagcctgctcgcagtccaccgcgcggtcgatctggggcgcgcggaacatgattgctgcgacgctgctggccccgtccgtcgcggagaagcgcaggtggtttccgccggcgcccaccttggcgcggtttcgcatggtgacgccccgcacgccaaagagcggcttcttgtttccctggccaaacggctggagcatctcgagcgcacggatgttgggcacgctcatctcctccagccccaccagagcggtgacctcgcccctgtcctcgaactgctcgatggggagggccgccatgacctcgcccagccggtcgcggaaggcgtccaggttggccgcatcgcaggtgacgcccacggcccccgcgtgcccgccaaagcgcaccaacacgtccgagcactgctcgacggcgtggaacaggtcaacgctgccgacggagcgacccgagccgcgtgcgatgccgtccgagatcgagaagaggatcgtgggcacgtggtagcgattggctatcctgcttgccacgatgcccttcacgccctcgtgccagccctcgccgcccacgacgatcacgcggccgccgtcgtaggtggcctcgaccatggcctgggcctcctcggtcagctgcgcctcgatctcgcggcgctcgctgttgacctgctccaggcgcgccgcgagcgtggcggcctcggcggggtcgtcggtcacgagcagctggaaggcgacgtccgtggtccccatgcgcccggcagcattgagccggggtatgagcgagaacggcagctggtccgccgtgaccgtggtgatgtccaggtgggcggtcgcagcgagcgcgacgatgccgggacgccgggtgtccctcatgtgctcgatgccgtcggcgacgagggccctgttctcctcgtcgagcagcatcatgtccgagatggtgcccagggtagcgacctccgtgtagtcgcgccacaggtccggctgtcccatgcgcctgcccagcgcgcacaccagcttgagggcgaccccggctccggcgagctcccggctggggccgtccgccctgagcttggggtcggtcacgggaaccccctccggcacgctctcggagggctcgtggtggtcggtcaccaccacgtcgatgccctgcgagaccagccagcccacctcgtccctggacgagatgccgttgtccaccgtcaccacgaggtcggggtggcagccgtcgatgaccctttccagcgcctcgcgcgacagcccgtacccctcgccaaagcggtgggggatgaacgggctcacggtgccccccagcctccgcagggccagggtcaggaggcaggtggcgctcatgccatccacgtcgaagtcgccaaagacggcgatcgactctcccccgcgcagagcccgctcgaccctgtccgccgcctgggccatccccggaatgcccagggggtcggcccaggaggcctcgagggagggcgagaggaacgcccgcgcccggtcgggcgaggtcaccccacgggcggcgagcgtcctggccacgatgccgggaagccccagcgactcgcggaggagccgctcggcgtccgggcgtgcgggcaggacgtcccagcgcctgctgtcggggaggcccgacacgctactccgcttcccctgcggccggcttgaccttggtggagccgtcgccgtacttggcctcgagcttggcccacttgggctcgcgcgtcttccagatggcgaggagcggcgacgccacggcgaagctggagtaggtgcccagcacctcgcccacgagcatggcgaaggcgaagtccttgagggtagccccgcccagcgcgagcatgcacgcgacggggaccagcgaggtgatagaggtgttgatggtgcgcacgatgacctcgttgatcgagaagttggcgatctggtagtaggtgcggtgcacgccgtcgtggagccccttggcgttctcgttcacgcggttgaactcgaccacggtgtcatagagcgagtagcccatgatcgtgaggagcgccgccaccacgttgggggtgatggccgtctgggtccacgcgtacacgcccagcgtgatgaccaggtcgtgcaggagcgcgacgacggccgtgatggacatcttgaactcgtagcgaatgctcacgaacgcgatgatgagcaggatcgccacgccaaacgcgagcgcggacgagcgggtgacgttggcgccccagtcgggtccgatcgtggtgacggtgtagctgtccgaggcgagcgagagggccttggccgccgcggaggcgtgctggttggcggtgttggggtcggtggtgtcagagcggacgaggaagcccgccttgccgtcggtgacgctcgtctggacggtggggtccttctcgcccgcgtccaccagggcacccctcatctgctcgatggtgaccgagccggtgtcgcggaagtcgatctcggtgccgccctggaactcgatgccaaagaccaggccgcgcgcgacgaggccgatcacggcgagcaccaccaggaccgcggagacgctcaggagctgccggcggtgcggcatgaacgggatctcccttgagaagtggctacgcattggccacaccccccttcccgagcttctcttccttccggcgcgcggcctcggccaggtcctggtccacgccccagaacttggggtgcctctcgatggtgcccagcgcgaggagcctcagggcaggcgccttgaagcagaacatggtcacgacgtcgcaggcgatgcccagggcgagcgtgaggccgaagcccttgaccgggcccacggcgaaggcgaagagcgcgatggcggtcacgagcgtgacggcgtcggcgtcaagggaggtcatgatgccgtgcttggcgccgctcacggaggagttcttgacgctgcggcccatgcggatctcctccctgaacctctcgaggacgaggatcgaggagtcggctgccgagccggtcgtcagcaccatgccggcaaggccggggagcgtgagcgcgaacgcgccgaagtgagagagcagcgcgagcaggcccaggtacagcaccgcgaacacgcccagggagcccagcgtgagcagacccaggccgcggtagaacacgaagaggtagaccacgacgatcgcgacgcccacgatgatggcggtgatgccctgggtgagggagtcctggccaagggtggggccgaccacgcggctctcggagtaggtgagcgtgacggggagcgacccggagtcgaggaccgtcttgagcgagttggcgtcgtcgagcgagaaattgcccgtgatggacacctcgccggtcgagatctcggactgcaccgcgggggcagacttgaccacgccgtccagcacgatggcgatcctgccgttggtgggtgcgagctccttggtgacctcggcgaagtccttggtgccctcgtcgtcgagcttgatgttgacggcgtacgtgcccgtggcggagttggacgcctgcgccacggtcacctgcgtgatgtgggagccgtccatgaacgcctcgtaggtgccgtccttcagctccacgtcctcggtgccggcgtcgagcttggcgagtgcgtcggcgtcgccgatgtcgtcaagccgcacgaactccaggtggcccgtctgcccgatggtcttgatggcctcgtccgcgttggtggcgccggggatctggatcaggatggagtcggacccctgctgctgcacggtcgtctcggacgagccgagcgagttcacgcgctgctgcacgatggaggtcgcctcctgcatctgctcggcgctgggcgtgccgccgtcggaggtcttggcggtcatgatgaccgagacgccacccctgatgtcgaggccctgcgtgatgcgctccgagagcggcgtgaacccaaacacgcacaccccaagcaccacgacgagcaccaccagggtcgatacgtagcggcgaacgtgggcgcccatcctatgcccgcgcttgcggcgggggcgagacttgctgcgcccctcccccttcccctcggacttgcgccagcggtcgatccccgtggcgccgtcctggggctccttgccatccttcatgagaagctcccgtcctcgggcgagacgtgcccacccaacctattgcaaccgtcccattctagcccgtgggcacccctcgcgcccgcgaggggcccgccccctccccgcccggacgcggctaccagtcgcgggcggcgggcagcgagtcccactcgctcacgaaggaggcgtactcccccctgacgatcgcctcgcgcgcgcggcgcatgaggtcgagcaggtagtacacgttgtgcatggagaggaggatggagcccgccatctcgcgctggcgcaccaggtggtggatgtaggcgcgcgtgtagccccccgtgcacaccgggcaggtgcagccggggtcgagcgggtcgtggtcgtgcgtgaagcgggcgttcttgaggttgagcctcccctcgctcgaaaaggcggagcccatgcgcgccgtcctggtgggcagcacgcagtcgaacatgtcgatgccgcactccacgccatggacgagcgtcgtgggattgcccacgcccatgaggtagcgaggcttctcgcgcggcatgtactcgctcgccagcggcgcgagcgtctcgaacatggtctggtggtcctcccccaccgagtacccgccgatgccatagccggggaagtcgccgcactcctccaggtggcgcaggctgcgcaggcgcaggtccatgtgcatgccaccctggacgatgccaaagagtgcctggtcacgccggtcgtgcgcgcgatagcacctctccgcccacatgctgctgagctcaacggcgcgctccacgaagccgcggctggcggggtagcccgggcactggtcgagctgcatgcagatgtccgcccccaggctctgtgcgatgcgcatattgtcctcgggcgtccagctcacgtacgtgccgtcgtagtcaacggcacggaacgtgaccccgtcgtcggtgagcttggtgaactccccgtggctgaacacctggaaccccccggagtcggtgaggatggggccgtgccactgcataaactcgtgcagtccacccatctcctcaacgagcgcctcccccggccgcatcgacaggtggtaggtgttggcaaggaggatcttggtacccagctcgcggagcgttggcggcaggagccccttcacggtcccctttgtccccaccggcatgaagatgggcgtggggacgtcaccgtgcggcgtgtgcaggacccccgcgcgggcgtgcgtgccgggatcctcggcgacgatgtcgtaggtgaaccagcgggcctcgtcgctgccctgcgctgtcgtctcctcgtcgctcatgagactctcctctcccgggcgcgcgctcccgcgcctgcccatagcaaagggcccgatgccacgaggcaccaggcccttccacgtctgaatgctggggctactcgccgaagagggcctcttcgccgtccttgatgccaaggagcgcgttgagggcgtcctgctcgtcggggccgtcggccgcgatctcgaccttggtgccggtgcccaggccagccgccaggatcatcatgatggacttggcgttgacgggagcggtgcccttgtcgacgtccttgatggtgaccgcgctctggtactgcttcgcaacctggacgaactgggaagcgggacgtgcgtggaggccggttgcgctgacgatagtcacttgcttggaaaccattgccaatctcctttgcttgaagggttgcgagccctcgtatggcttgccttccgacatagtaacaaacaaatgacaaaaccatgcataactgggggctgtttttcaggagacggcggcaaaccatgtcggagagggacatgtccgccgcggattggtgcaaaatggtctgtgggcgggtggcaggtcgccgcgcgcccgcgtcatgacgtgaggagcatcgcatggacaacgaccaacagaccgccgagggcaaccagggccaggccgcgagcggcacgcccgacaagcccgccggcgccgcacggtcgaggcggcctcggtccgggggcaggcccaagggctccaaggggccaggcgccatccggggaggccttgacgccatacggagcgtgaggagcgcctcaaaggagcacgccgacgcgcgcgagcgtgccgaggccctcaagaagcaggtggaggcggacagcgcggagctcgcgcaccgcgacaagatagagggcgactacccgcagatcgtggagcgccagcgcgcggaggtcgcggaggccagcgccctgttggagaaggccaggggcgagtcgcagcgtctctccgcagaggtcgaggggctgacccagcgcctcgacgcaatgaaggcggcaaacgaggagcagctgcgcccctatcgcgagctcatgaactcgaccaagggtcgctctgacgacgccgcgaagtccctctcggacgttcgccgtgccgtcaaggcggccgaccagcaggtgagcgacacggccaagaggcgcgagcagcgcatagacgccagcaaccgctcggtggacaacgcccaggaccggctccgcaaggtccaggcggagctcacctccctgcaggcggaccccagcgcatcgcccgccgcggtgagcaagatgcagagcgaggtcgtggcggagcaggcccacctcgacgccgcccgcgaggaggtcaagcgcgtgaccgccgagtgccagcagctcatggacaacgcgcagacgcacctgtggacccagaagcagtcgctcgagacgctggagcgccaggcgggcgaggcccgcaaggaggccgacgcccggcgcgaggagtacgaacgcctgcacaacgaggccacgcgcaaggagaaggagctctccgaccagatcgcggcgcgcaagggcgacctcgaggcggccaacaaggacgccgccacggcccagggcaggatcgacgccgcccaggaggcgctcgacgaggcgaactcgatccacgccactcccgaggcgaccgctcagctcaggggcaagatcgcccaggacaaggcgagcctccacctgcagcaggccgaggtcgaccgccttgccgcggccgagaggggcctgcgctccaagacccggggccagcgctatggcttcgtggcgatcgtcgtggtcgcctgcgtggtcgtgctcgcgctggtcgtggtcatgctcgtgctgcccaacctgcgctagccgcagcgccccgcgcgccgttctcgccgagggccatcggcatctggaggggtcccgcagccgttgtggggcccctcccgcctcaagtgcccagggaagggggcgcgaggtctcccccgccgcggccttcacggcgccacgcgatcgctcccgccccagcgtcttgcctgcgcgacgcctctctcggaagcccctctcatatgcgaacgttgagcgagcaggcccgcccatctgaaacgcacacgagctacagggaacgacgcctgatcctgctggcgctcgcagcgccgttggccccggtgcttagccccgccggggcttgtacggattccggcgcagaatgcttagtctcctcggggctcggaccgggcagaccctccgaaaaccgtgcgggcgccgggatctctaagcacgccgcgcccgcaacccgtgcaagcaccgtgttttctaagcacccgtcccaccaggtcggtacctgtggcggagccgtccacgctcgggcgaaggcgcccccatctggcacccattctctgacccatcccatcagcctcgcccaaccggcaacgcctcgaccctggagtgcctggcgtcacgaccccttcctcgccctcgcccctctccgatcagctcactcgcccgcacgtcggccagcgcgaacggccgcaacgacgtcccggcatgcggcggggcctccgggagtcaaccccgaaggccccgccgcgtccctctcacccaggggcgctacctgatgagcatggcgtcgccaaagctcaggaagcgatacctctggtctattgcctgctggtaggcggacatgatctggtcgcgggtcgcgagcgccgagaccagcatcatgagcgtggagcggggtacgtggaagttggtgatcagcgcgtcgaccacgtggtaggtggacccgggcatgaggtagaggttggtggtggcgttgcgcctctccactatgtcgcccctgccgaggaccttggcggagtcgggggcgtcctcgaagcgccgcgcgacgacggggaccctccatgctggcgcgtcggggtcgtaggcgctctcgagcgagcgcacggaggtggtgcccacggccacgacgcggtggcctgcctccttggtctggtgcacgaggtccacgacctcctggctcacgtggtagcgctccgtgtgcatgacgtgctgggtggggtcgtcctcggtcaccaggcggaaggtgtcgatgccaacctcaagctccacggtcgcccagctcacgcccttctcctcgatgcgctggatcagctcgggcgtgaagtgcaggcccgcggtgggcgcggcggcggagtgctcctcgcgcatggcgtagacggtctggtacttctcggggtcgccctcgtacttggtgatgtagggaggcaggggcacgtggcctgccctgtgcatggcctcgtcgagcgagaggccctccgccggcgtgaagcgcaccagccggccgccgcggttgtcgtccacgaagtccaggatctctcccgtgagcaccacgggggcggacatgggcgcgtgcagcccgccggggcggtactcaaccacggcgccgggcttgagccgcttgccggggttcacgaggcactcccacacgtgccccagggcgtccacgtcctccctgcggcgcagcaggagcgtctcggcgacgcctcccgtggcgcgcttgtggcccacgagcctggcgggcatcacgcgcgtcttgttggcgacgaggaggtcgccgggctccaggtagtcgatcacgtcgcggaacctgcggtgctcgaccccgccgtcctcgcggttgagcacgagcagcctgcacgagtcgcgcggctccgcgggctcctgggcaatgagctcgtcgggcagcgggtagtcaaagtcatcggttcgcatggtgtgcggaatctccttggtgggcgagaggatcgccccgtcttgcctgcggcgccgccgcggcggcgcccctccaagccctctactctatcccctggcgacgatccgcgctctgatcgatgccgccaacaccgtatccccagcccgctctgcggcgtgggccgccttcctcaggtcgcgcgcctcctgccgctcgaccgcggcctccgcggcggagaaccggcagccgcagtagttctggcgatacatgtggagcgcccgcgagtcctccacggactccgggtagtgcggcctgaagtcgcgccacacgggcgtgaggcccctggcccgcgcggtcgcccggaggacctcgtggcacgcgtcgaacagctggtacggggagacggccagggtcgtgctcacgaactcgaagccgcgttcgcgggcgacctcgcacgcctccgagagccgcagcgcgtagcacgcccggcagcgcctctcgcgatcgaacgctgcgggggcgaccgagcgctcccagccgtcgcggtcgtctcccgcgacgatgacgtccacgcccgcgacgtcgcgcgcccacgagagcagcacgcccaggcgcctgtcgtgctcctccagcggctggatgttggggttggtccagcagatcgtgggctcgaagccctcgagccgcaggtacttcacgggctccagggagcagggcccgcagcaggcgtggagcaggatgggcgtgcggccgtcgcgcggggcgggggccagggggccgctcacctctcccccgcctcgtccgactggtcaaagcccgtggccagcggggagagcatctgcgccacggaccgggtcatctctcgcgagaagcccgagttccacttgcgctcgcagaacgccttgagccgccggtccgcctcggggccgtcgggctccacgccctccttggtcgcgatggcacggcgcagctcctccgcgctcgggtcgcggtaggagtcctcgctcaccaccagcgagaggtcgaaccgcgccggcttcctcgggggcctcctgccctcgacggggtggccgagcaccagcagcacggccgggagcaccaggtcgggaaggcccaggatcctgcgctgctcgtcgtagttctcgaggaagtcgcccacgtagcacgagccgatccccaggctctgcgcggcgaccaccgcgttctgggcggcgatcatcgtgtcctccagcgcgagcgcggcgtcgcccacgccgacgggcctggggtcgcagccgccctcctcgaaggcgcgggtccacctgcgcatgtccgcgcagaaggcgagcacgagcggggcgcgcgagatcattggctggttgtcgcaggagcgggccagggcgtccttcacggcctggtcgcgcgccacgatgatcgtgtagagctgctggttgcccgcggtcggcgcctggcaggctgcctcgaggatgagcctctcgtcctcggaggagacgggctcgttcgagaaggcgcgcgtggacgtgcgctcaaacaactgtcggatggtctcgttcatcggtttcccccgtataccccaggttgtctgggtacagaattctagcagccatccacacgcggaagggagcgccatgaggatacgggtcgagctggacgagaggggcatggtccccgacaggtacgcaaagcacgcggacgcggcgcacctctaccagggcacgccgaccacgtccttcccctttgccgtggaggggatcccggacggggcgaggacggtcgccctcgcgttcgtggactttgactccatcccggtgtgcggcttcccgtggatccactggtgcgccgccaacatccccgcgagggaggcagagggaggaaccatccgatttggcgagaatgcctccaacctcggcgagcacggcatggtgcagggcagaaactcgagcgccgcaaggtgggcgggcggcagcaccgacccgctcctggcgtgccgctacaacgggccccagcctcccgaccgcacccacgtgtacacgctcgcggccttcgcgctggacacggagctgcccctgcgcgagggcttctggatgagcgagatggtcgacggcatgcgcggccacgtgatcgaccacgcggtggcggacctccccgcgagggcatagcggacccgccaccccctaccccaggagctggatgcccgagctggtgtcccgcacgtgggtgcacccccgcgtgcgggcgacctcccacgccatcgccaggtcgcccacgcagccagccaggtgggtggagaggcacgtccatgccagcagcggcagccccagcgtggcgcccagcgccacgaaggcgcaggagaggaccacagtgggagcgagaaggacgcaggcgaaccgcccgcgcgaaagcacggccccgtccgtgcccgtgtacagcatcccctcgcggtacccaaagcgaatccgcacgtcccgcccgcccaggagtcggaaggcacccgcatgcacgagctcgtggacgggaagcgcgacggccgagagggcgagataggccacgattccggcgagcgacggtgcctccgtggcgccggcgccccacgcgacgagccccacggcgagcccgcccgcgaggatgcccaggcccagccacgacagcagccgctggagccgcacgtctcccatgacgtcgatgtcctcgatgaccctcatggcggccatgctcccaccgcacctcccgcccgtcaaggcgcccgggggccgctgcccccaccgcccgcacggggacgcagcggcccccgtgttgtgggataatctcccccgttactgcacttgccgctccctgcggcgccggaactaaggacgcacatgccttcgaacgtctcctcggccgagaggccaaccttccccaagcgggcggtcatcacgggcggcatgccctatggcaacaagaacctccactttggtcacatcggcggcgtcttcgtgcccgccgacttctttgcacgcttcctgcgcgacaggatcggcagccagaacgtggtctttgtctcgggcaccgactgctacggctcccccatcatggagggctatcgcaagaaggtcgagggcgaggggtacgacgggagcatcgtggactacgtctcggccaaccacgaggcgcagcgccaggcgctcgaagcgtacgggatctcgctcgacctcttcgccggctcgggcctggagcccgccaagggctttcacgagcagctcaccgcacaggtgctgaggcgcctgtgggagcgcgggtacctgcacaagatgtcgaccaagcagttctttgatgtcgaggcgggccagttcctcaacggcaggcaggtcataggccgctgccccgtgaaggggtgcaagagcgagaaggcctacgccgacgagtgcgacctgggccaccagtttgaccccgaggagctcatcgaccccgtctcgcagctcacgggcacgcgccccgagctcaggccggtcgacaactggtactttgacctcccgggcttcaaggacaccctggagtcgctgatggacgagtgggacgttgacccgcaggtccgccccatcgtcaccaagacggtgcgggagtccctggcggcgcccatcatctacgtgcagaacaagttccgcgaggcgtttgacgccgtggagcccagcctccccgcccacacgctgcgcgaggccacgggcaaccagcagtccttctccgtcgagttcgaggactgggaggcacgcgaccgcgcacgcgaccagctcgaggcggccggcgtgcgcttccgtacgggcaagacgctgctccccttccgcatcacgggcaacatctcgtggggggtccccgcgcccgagctcgacggaacgagcgggctcacggtgtggtgctggcccgagagcctgtgggcgcccatcagctttgtccagaccgcgctcgcgctggacgagcagggcagcggcacgcgcttctcgtcccacgactggcgcgactggtggtgctcgggcgacgccaaggtgtaccagttcataggccaggacaacatctacttctactgcgtggcgcagcccgccctgtgggaggcgctcgactggggcctgttccaggacacccccatcgccaactaccacatcctcttcatgaacaagaaggcctcgagctcgggcaagatcaagccgcccatggccgccgagctgctggagcactacacgcccgagcagctgcgctgccactggctgagccttggccttgaccagaaggccgtgtccttctcgcccaagccctacgacaccagcgtgagccatcgcgacaagaagaccggcgaggaggtgctggtgagggacgacccgcgcgtggtggaccccgcgctcaaggagtccgcgttcctctccaacatcttcaaccgcctggcgcgcagctgcttctatggcgcccagaacgcctgcggaggtcaccttcccacctgcgatgccgccgacgacgtgatggaggcgtgcgagagggcgacccttgagtacgagcgctttgcccacgacttcgacgcccacggcgccctcgccgttgcggaggcgttcgcgcgcgacgccaacaagcgctggggagacgagtccaaggcggccaagggcgacgacaccgcctaccaggcggcgctggccaacgcgttcgcggcgctgaggaccaccacgctcctcatgcaccccgccgccccctttggctgcgaggccatctgcgagcacctggccttctccaaggacgacttcttcagctgggaccacgcgttccagaaccccacgcagttggcccgcgccctcggcgaggaccccgcggagcacgcgctggtggagctgccgccgcgctttgacttcttccccaagcatcccgagggaaggtagcgccaaggagcatctgacggagggggacgggcgagtgggccccgtccccctcctgcgatttgcgggcgagacgtgccgtgcctctcgcccgccatcccgaaaggagcggccatggcacccgtgcccccaagcctccactttcccagcccctacgagcggccccacgccgcgcccgccgcggcactgcacgtgcccgcgcccgatggggcgcagatcgccgccttcgtctacgcccccgacggagtgcgggacgagcccggcacgccctttgcgatcgaccgcagcgtgccacccgtggtcctgctccacggcaacggagaggagcatggcatctttggccccacgattgacgccgtggttgcgacgggccgctccgtcgtcgccatcgactcgcgcgcccagggcaggtcgacccgcgggacggcgcccctgacctacgagctcatggcgtcggatgccctcgcggttctcgcccgcctgggggtcacgctcttccacgtgctgggcttctcggacggcggcatcgaggcgctcatcctggctcgcgactgcccggagcgcgtgctgagcctcgtggccatgggggccaacctgtgccccgagggcgtggacgacggcgactgggacgtggaggggacggcacggtcgctccacgcgtgggcggactggctcgactcgcttggggatgccgggcccgtggacccgacgctcctcatgccggatgccaccgccgcgcgcacgaacgccgagctgctgcaactgatggtggacgagccgcacatagaccccgcgtccctctcgtcggtgcgctgccccgcgaccgtcgtggcgggcgagttcgactgcatcagaccctggcagacgcgccagatcgtcgaggggctgcgctcgggaggaaacgaccgcgtgcgccaggtgaccgtccccggctgcgaccacaccatccccaagcacgagccgctctggtgcaccgacgtcctgctgcagaccgtggtgcagaacgacctgcgcctccccgtcgtgggtcccgcgcgaccggcggcgggagttcgcgtggcgcgcgtcgacggaggctgggtcccggaactcgaggcactgtacgatcgggtggacgacgcggaggagcgctcggggacatcgggctgggttcgcggtgtctggcctcccgaggggcttgccgcgcgctatgcccgggagggcctgacctggtgcgcctttgacgaggaggacgtggagagggacgggacgggacgcccgggggcgaatccgctgggcgcggtgtcgctcgacctcgacgacgccctggacgggacgggggccgactggccaacacttcccgccggggcctccctcaccatgcacctcctggctgtggaccctgccgccaggggcagccacgtgggcgagacgctcatttccgccgcggtcgccgaggcgcgccgccgcggctgcacggtgattcgcatcaacaccgcgccggagaacgttcccgccaacgtcctctatcaccgctgcggctttagcctgcaccgtcccatctggaacccctaccccggactcccgctgtgcgggtggaccaacctctgggaactcgggctgtagggacgccaccggggcgagaggggccgtatcgtgtctgccgcttcgccccgagcgcaccgaatgccggcgggattgctggcggcaacgacgccagggggcgggccaccgctggcccgccccctggcgattgtccttctcccctgctctgccctactgcgtctgggcgatgttgaccatcccggagagcggacggttcttggagcccgtggtgggctcaacgagctggaagcaggtgtcccagtcgtagtgcgggtcgagacgcgcggtcccggtcacggtcatcgacgcgtcgaacgcgttggagcgcgtgggaccgtccacgtccacggcatagcccgggttcgtcagctttgcctggaggccaaagaaatcgttgctgtcgttccaagtcccgatggtcccaaagtcatccgtctggtaaccgtaggcctgtttaccgtctcccgccttcaccttcacgtggtcaaagctggcggagatggagtccccgttcctctcgacgctcccctcgacggcaaacgtgaacgggggctggaaggtcgtcttttgcgcaaatacctcctcgttgttcacgtagcagtggagcgtgttggtgtccttgtgccacgagagcctgatgaggtaggactgcccaagctgggcgttctggatgaaggtgtagctcttgccctccagccccgcctccgcggcgtggtccatcacgttctcgagcaggaaggccgtgctgttggtgccgccggggcccttgtgggcgtagcgcatgttgtgctcgtactggatgccaaaggaggcgacgccggggtgcccgttgcacgcgatgtcgaccttggcatggtagccggtgccgctgcccctgagcgtcatgcgggcctcgatgaccgcgtagccggtgtcgtggtcaaagtcgtcgacgggtgccagcgacgggtcgacgccgtaccagccgatgccctccgcacgccagcccgcgcggacgaggctgtcgttctccgccttgttccgggtgtagttgtgcgtccccgtcctcgcattggggttgtactggcggtacaggggcacggtctgcgcctcgctggagtaccagccaatgccctcgtagttccagccgaccctgaccagcatgtccctctcggccgcgttcatcgtgtagtggtggtcgccggcgttagggttgtacagccggtagacggggatgttcgacttgctgggggcaacccagcccacgccctcatagctccagccaaggttcacgaggtggtcgcgctcgttagtgttggcggtgtagaagtgctccccgctgttggggttgtacagcctctgcatgcggacggcgccggagtccttcgccaccgcgggggtcgcaagcatgagcaggcttgccgccgacgcgaggagcacctttgcgagcagccttcgcacgggtctctctccatgcatggtgggtctcttcccttgatcttgggatatcttcagcaaaaatggtagtccccacctggttggttgggtgccaactttcggcaatcaaagctcttgccgtcggcttgaaacgtggacacctgcgttctggaagaaaacctgctagtgcccgcaagcagcaagggtgatcattggtcaaagagaaagtcgagaacgcctccgcagtcgaatcgaccccgcaaaggaagcccgcccgccgttgcatggcccttctctctgcgaccaatgttggcccttactccgtgctggcacggaagccatcggcacatccggctcgaaagcatccgcagaagggctcactgaagagggagaccgcatcgagagaatcggaagggcccgcaccatcacgccccaccacaggcggtgggaaggtcagcccctatgatgccgagggctgaccactcgcgaaggttaccctggagaccatcactgccagcgcccgtacttccgcgtttggcaacccgccgagaaatgggcacgccagaaaccccgccccgtgtgtacacatggggcggggttattgacatcaatggcgtaacgaggtcccgccatcaggagaaacgctccgacggggtgtccacgcgtcagaaacctcatggcacgtgtacacgcgggatggactcttcgacaatcgaacccgcatccagagcccaactgccagaaactccatcgtatgtgtacacacggtagcgagtttgggacaacatcagatactttatcagcctccaactgggaaaacggcctgccgaatgactcgcctgtcggaaagctcatcgtatgtgtacacacggaacgagattttttcccgccaagtccccatcagcgtccgagcgcctcataccaccaagccactccgctcacgacgggagatcaaaagtctgagaatggagtgcggcaccccacctccgtcggccccccgagcacgtaaggctgccatctcccactttcgcacggctggccatttcccccggacgctccttcgcttgtgcactgttggagcatcgacgtcccttcaactgggggaacgccaccggcggggcggcctcgcgtcagaagcctcatcccgcgcgtacacgcgcggtggactttctggcaatcgacccccgcccccagctcccgggtgccggaaaactcgccccacgcgtacgcgcgggatgcgctttccgtcggcgcgggagctcccacgccccgccaacggggcggacgcgccggcgcgcgaggcccatgccggaagccacgctgcgggcgcgcacgcggggcggagcctccggcgggcgccccggggtcccgcccgcatcccgcccccgcgccgcgagccgcgccactcgcgcggggaaatcggcggcctggggacggagggggttccctcccgcccggcccggccggaccactcctcggaagtccggctggcaggagactcccgatatgagtgcacatatcgggcccccgccgccagggcggtcgggcggccgggcctcatcccagttggctctcgaccaagcctttgaccttggcaagagactcccgatgtgagtgcgcatatcgagagtctcctgccattagacccccattcccctcccaaatggcagcagactcccgatgtgtgtgcacacaccgggagcctcctgccatgggtcgggagccggcttcctcgcacgatcccctacctggggaaatgccaggtgggattggtccgcactcccttccctcccgcagggaggcactcacatcgggcgttcgctgccatcggtggcccttccccctcggacgcccgacatctgaagcatcaaacatcgtcctttgacggaaaaccgatcgcgtgagtgcacgcacgggtcgtttgcgtcagggacgaagccgaccgtttacctatgagccttttacctgcgcagataccgcgggtctcaagactccgccgacagccctcccgaaacgtgctcacgcgacccgcttgccgccaacgggcctatgtggggtagcgcaccagcgggcacgcacgcggggtcgacgagacgtccctctccccttctttgccatcgacaccccatcgggaccgacaccccatgggcctgaccccccgaggggacggaagatcgactttcgacgctggggtactccacgccagagggaggggcaggctgcccatcccctgcctgtctagccagagcgcgaggggggccgagccaggggccacctctcagcggcaagcacgttggtggcaacgttcctctcccctgccatgggggaccctgcgcacgaaatggtcggcttccaaacgccgccgaacgcccgcggcccccgcctatctgccgtcggcgaagacccacacgcgctgcagtgcgtagttgaggaagaacagcgcgaggtcgcagcagatcttggcgatgccctcgtgcacgccgaactcggtatggaggaagaacacccccaggctggagaggaacaggaccagtgccgcggtcgcgatgaacctgggcaggctcctcttggtggggatgccgccctcgctctcctcctgctcgatctcgccctcggaggcgcccgactgccggtcctggaagaccaggcgcgagttgatggcatagttcagcgcgacggagcatacgcgggcgatgaccgaagagacgaggatgcgcgcgtagtcactgttcgcgaacggcttgcgcagcacgtcgaacagcgtccaagcgataacctggtcgagcagggtgctcaccagcgaggagcaggtgaacagtatgaaccgcctgctaatcttccctttgatgcccctcgccaacgcaacctcttccccagtttctaccttccgtcaaaaatatagcctacagagggcgatgccatgggagaggcacgaaaaacgacgcagcatggggcatgccgtcggggtcacggcttgcgtcacggcagcagcccctactgcgcggggaacgtcacctcgaaggtggtcccctcccccacctgactgttgagggagatcgtcgcatggtggagaagcgccgcgtgcttcacgatagcgaggccgaggcccgtgccgccaccggcacgggaccgcgacttgtccacgcgatagaagcgctcgaacaccttggactgggcctcctcgggaatccccacgccggtgtcggagacccgcacggagggttttccatcgcgcgggtacacgaagaccaagaccttgccgttgggcttgttgtagcggatggcgttctcgcagagattgctcaccagctcgtcgaggaggcgcgggtagccgcgaacgagcgacgaaacgccatccaggcgaatctgcaggccggcctccctcgcccgcggctccatgcgcgccacgacggagcgcgcgacgtcgtagaggtcgaccatctcggccgtgccaaacagggcgtcatcggcggagcgctcggactcgtcgagcttgctcagggtgaggatgtcgctcacgaggctggagaggcgctgggcatccgagtagatcctccccgcaaagtcggggacgtcctccgggcgcgcgatgccgtcgcggatgagctccgccgcgccgctgatcgaggcgatgggcgtcttgagctcgtgcgtcacgttcgccgtgaactccgtgcgcatgtctgcggtgtcgcggatcttctccatctggtccctgagctcgccctgttgctcgcacagccgcttggtgagaggctccaactcgcgatagggcgcgcctcctgcggcatcggcgcctgacgggtcgatggcgacgatgggccgcacgatgacacgcgagaggcacgtggacacgaaccaactggcaacgatcagcaccacgatgacggcaacgagcggcacgaagtcccttgcgaggatgctcgtcacgctcgcccggtcctccgagagcctgagcacgttgccgccgtccagcagctttgcgcagtagatgctcacataccccgaggtggtgctcttgcgctcggtctctgcctcgcccttgctgcgcgcctccacgacctcctccctgcccccgtggttgggcaggctcgacacagggtactggttgtcgtacagaacggtgccgtccccgcctatgagggttgcacggaccccgttgaggtcgagggacgagagcacctcaacctcgttggacccgttggagagtcgcttggcaacggcggcgcactcggttcgtagctcctcgtgggcctcggagaggagcgactgctggaagatgaaggcagaggagagcgtagcgatgaccgccgcccccaccgccgtggcgacgagggcggcgaagacgctcctgcggagcgagcgcggctccgccttcttgttgggtttgagcctcacgcgcgccgcctagcccttgagccggtatccgacgcccctcaccgtctcgatgaggtcggcgtggtccccgagcttggagcgaatctgctgcacgtgcacgtccacggtgcgcgagccgccgtcgaagtcccatccccacacgcgctggaggagcacctctcgcgagaacacgttgccgggggagcgcatgaggaactggagcaggtcgaactcgcgcatggtcagcttgagctcgcgcccgtccagggtgacctcgcggcgcgagggccacagcttgagcggccccacgctcaggaggtcctgctcgacgtcctccgactgtcgggcagtcctcctgaggagggctcgcacgcggctcaccatctccatcatgccgaagggcttggagaggtagtcgtccgcccctgcgtcgagggcgcggacggtgtcaagctccccgtccttcgcggtaagcatcatcaccgggacccgggacaggccgggcgtgcgacggatgcggcggagaatggcgatgccatcggtgtcgggaagcatgatgtcgaggagcacggcgtcgggcaccctctccgcgcacgccgccctgaactcgacgtcgttcgcaaagccaacggcctcgatccccgcctgcgagagcgcatagaccgtgagctcccggatgttcgtgtcatcctcgacgtagtagaccaaggctactccttgtcccccatggcatggccgcgataggtgccggtagccctaaagatagcccaatccgccaggctctgcgcgtggtctcccatgcgctcgtagtacttggcgatggtgaggacctcgggcgcctcggacgcggcgtcggagtcgctcttcagcacgtccacgacctccttgcggacgcgctcgtacaggtcgtcgagcgagtcgtccatggggaagacgtcctcggccttagccacgtcgcccgtctcgaacgggtccatcgcggcctcgaccatggcggcggcgcggttggacatcaggagcaggtcgttggcgagggggtgtgccttgtggatgtccatctcgcgcgccagcagcgccgtctcgtaggccatctgctcgatgcgcgagaggtccgtgatggcgcggaacgcggcggtgaccaggcgcaggtcgcgtgcgaggggctgctgcaggagcatgaggcccatgcaggagtcctccacggagcgctccaggcgaatggcggcgtcgtggccgtcgatgacctcgctcgcagccgcctcgtcctcctcggcgagcgccctgcccgtggcccggacgtcctccacgacggcctgcgagattgccttgacgtggccgtccagctgctcgagctgcttggtgtaagagcttctggtgatcattatccaaaccttcccgtgaggtagtcctcagtgcgcttgtccttggggtcggagaagagctgcgccgtcggggcaacctccaccagctcgcccaggtagaagaacgcgcaggtggtcgagatgcgcgtagcctgctgcatgttgtgcgtgacgatgacaacggtgtgccgctcggcgatctgggtcgcgagctcctccacgagacccgtggagacggggtcaagggcgcttgtgggctcgtccatgaggagcacgtcggggtcgacggcgagggcgcgggcgatgcagaggcgctgcgcctggccgccggagagggacaggcccgagtggtcgagcttgtccttgacctcgttccaaaggccgacctcggtgagggtcctctccacgacctccccgagctcggagcgcttggagcgccccgccatcctcagggcgtaggtcacgttgtcaaagatcgagatggggaacgggttgggcttctggaacaccatccccacgtggcgcctaagcgtgtagacgtccacgtcgcggtagacgtccgtgtcccccagcaggaccttgccgtcgaccttgcagtcggcgatgcggtcgttcatgcggttgaggcagcgcagaagcgtcgacttgccgcagccggacggcccgatgaaggccgtcacctggcccgcgggcatccgaagcgagacgtccttgagcgcgtggaagctgccgtagtggaggttcaggtgctccacgctcatgggtagtgccattatccaaacctccccgtgaggtagtcgtccagacgcttgtccttggggcgggagaagagctcgggggtgggcccaaactcgaccatgtcgcccaggaggaagaaggccgtcctgtcgctcacgcgggccgcctgctccatgttgtgcgtgacgatgaccacgcagatgcccctcttggccatgtcgcgaatcgtctcctcgatggagtaggtcgcgatggggtccagtgcggagcagggctcgtccatcagcaccacgtcggggtgcatggcgagcgtcctggcgatgcagaggcgctgctgctgaccgccggagagggcgtaggcggactggtcgagcttgcccttgacctcgtcccacagggccgcggcgcgaaggctctcctccaccagggcgtcgatgttcgccttgccggagaggccgtgcctcttgggcgcgaacgcgatgttctcgcgaatcgactttctgaaggggttgggctgctgaaagaccatgccgatctgcttgcgcagctggtaggtgtccacgccgcgggtgttcacgtccttgccgtggtgcaggatcgacccgccgatgcggcatcccgggatctcgcggttcatgaggttgagggagcgcaggaacgtggacttgccacagccggaggggccgatgagcgcggtgacgcctcccttctcaaacgagagggacgttgggtggagcgcctccttgccggagtacgagacggtcacgtcctcggtggcgaggagcggagtcgtgcttgtcattctgcggtcagcctcctctcgagggcgcgtccgacgatgcgggcgaggacgttgaacagcaggatgcagatcatgaggacggcggcggtgcctgccgacacggcggtgaggtcggggacgacgccctcggagttgatcttccagatgtggacggccagggtctctgccgggcggaacatgttccaggggcagctcgggctcgccaggttgaagttggtgaagtcgagcgcgggcgcgctctggccggcggtgtaaatcagcgctgcggcctcgccgaagacgcgtccggccgagaggatcacgccggtcacgatcgcgggcattgcagccggcaccaggatgtggatggtggcctcccagcgggtgaggccgagcgcgagggcggcgtcacgctggtcgcgggggacggcctccagggcctgctggatcacgcggaccaggatggggatgttgaacatcgtgagcgcgagggcgcccgagatgatgctgaagccccagccggcacccaggacgaagacgagcatgccaaacaggccgacgacgatggagggcaggctcgagagggtctcgatggccgtcttcgcgatgttggtgacgggcccctccggcgcgtactgcgtgaggaagatggccgcgccaagcgagatgggcagcgagatgagcagcgtcagcacgagcaggtagaacgagttgaacagctccggcccaatgcctccgccggccttgaactgctcgggctttgccgacaggaagtgcgggtcaaaggccttgctcgcaccagacgcgacgatgtacccgatgattgccaccagcaccacgaggatggcggcgacgatcgcggtgagtacgcccgtcgcaacgtggtcctcggcgcggaggcgcttcgtgacgtcggagatgccgccgtcaacggtctcttcgctagccattcttcgccgcccccttccttccgatcagatggacgatgaggatgaacacgagcgacatcagcagcagcaccatggcgagcgaccaaaggacgtcgttgtacacggtccccatggcctcgttgcccatgcccatggtcaggaccgaggtgagggtcgaggcgggcgtgaacagcccggtcggcatctgtgccgcgttgccgatgaccatctggacggcgagggcctcgccaaaggcgcgcgtcatgcccatgatcaccgcggtgacgatgccgggcatggcggaggggagcaccacgtgcaggatggtctgccagcgggtgcagccaaggccgtacgagccgtcacggtagctgtcgggaacggcggcgatggcgtcggtcgcgagcgaggtaacggtgggcaggatcatcagggcgagcacgatcgaccccgagaagatgccgtagcccgtaccacccgcccagctgctggtccacttgaccacgatagacagtcccaccaggccgtagacgaccgaggggatgcccgtgaggagctccaccatagggcggaacaccttctggccaaaggtcggctggacctcgaccacaaagatcgaggcgccgagcgcgaagggcagcgagatgacgcaggagaggagcgtcaccgcaaacgagccacagatcatgggcagcgctcccatgcggggctggccgtcggcgcccttggagtgcgggttccaggtggtgccggagaggaacgaccccagcgagatcccgtcgtgcgcgaaggtggcgatgcccctcgagcagaccatgaatatgagcgtcacgacgagtacgacgaccaggccgacacagatgccggtgaagatgagacccttgcgctcgatggagcgcttcgacctcacctttggctgccgctccccgccatgggcggaggaagccgcctgggcgatttcctccctttcgtcgagttctttgttcattcggcttcccgttacgtaggtttccagttcaggcgctggcggaacgctacttgttggtgacgttgccgtcggcgtcgcgggtgaccttcatgccggtgatggggatatagcccgtctgctcgaccagggagccctggacgtcgtcggagagcatgtagtcgatgaacgcctgggtcgcgtcgtcggggctggtggaggtgtacatgtgctcgtacgcccagatggtccagtcgttggtctcgacgttggcctccttggcctcgacgccaccgaccttgagggccttggtggtgtcgtcgtagtaggagaaggcaacgtaggagatggcgcccttggtggaggcgaccatcttgacgacggtgcccgaggagtcctgctcctgcggcttgaaggagtcgggaaccttggtgtcgccgaggacggcgtcctcgaaggtcgccctggtgccggagccggaggcgcggttgatcaccgtgatgtcctcgtcgctgccgccaaggtccttccagttggtgacctcgccggtgaagatgctcttgagctggtcgatggtgaggtcgtcgaccgtgacgtcggggttgacgatggggcccatgcccaccacgcacacctggttgtccttgagcctcttggcgtcgtcggggttgtcgagcttggactcggcgaacacgtcggagtcgccgatctggacggagcccgcggcaatctgcgtgatgccctggccggagccgccgccctggacggtcacctgaacgccggggttcttctccatgaactgctcggctgcagcctcgacgaggggctggagggcggtggagccaacggcggtcacgctgccggagaggtttgcgctcgaggcggaggagtcagaggacgcgctggagtcggcggtggagctggagccgctcccgccgcaaccaacgagaccaaggccgagcgtcgaggcgagggttgcgccagccaggacgaagctacgacgagacatgctgtgaccggacattgttctccttccagagggtgaagggacgcagctctcttcattgcatagcttatgagccacaccccgtgtcagcatgcaatgtatcccgtgtccgcaggcaatcagccccccttggtcggcccttaccgtcgcgtgaccgcaccttacgctcccctgacatttcccagtcaactacataaggtttcagcctcgttgcaagggaagcgtcaactcccctggcgtttgaactgtgaatttaggaaggtaccttgacatctatttgctaggtacctaatgttttcccgcgctaacgaaacttggaagagaggaggacgacgtgtgcaacgactcgtcacgcgggcacctgctcgagcgcgaggcatcaaagaccgtcgagcagcgcatcctcagcgacttcggctactttggccacttcctccacgtgaacgcggggggaagggcgggcaagcagcacattctcgtgaggctctaccgcgccggcgggaccacgtcccagcgcttcctgcaggagactgtccccatcagctccgcgtcgctgtcggaggtgctctcgaagctggagtacgagggactggtgagcaggacgaggtccgaccaggatcgcagacagctcaacgtcaccctcacccccgagggcgagcaggcggcggtcgagtgcgcaaagaggaacgaggaatttgagagccgcatgctctcggtcctcgacgaggacgagaagcgggaccttgcccacaccctcgaccggctggtcgaccactgggtgcacatcgaacaagaggagacgggaggcaagaggtgcaggaactgacctacaggcagatattctcgaccctggggaagagcctcagggagttcaagcggagctcggtggtaacgccggtcttcgtcctaggcgaggtcgcggtggagtgctcgatcccattcatcacggcaagcctcatcgacaggataacggcaggcggggagctgcaggacatcgcccactacgcaatcctcctggtctttcttgccctgttcagcctgttctgcggaaccatggcgggaatcacctgcgccaaggcgtcgacgggtttcgcgcgcaacctccggcatgacgtgttcgagaggatccagggattctcgttctcaaacatcgatcggtttagcacgtcttccctggtgacgcgccttaccacggacgtcaacaacgtccagcaggcgttcatgatgctcatcaggctcgtcgtgagagcaccgctcctcatggtgttctcgatcgtcatggccttcctatcaggcggcccaatggccgccgtgtacctggtcgtctcgttcattcttggcttcggcgtctttaagatcgccctcacggtgatgcccatcttcaagcgcatcttcaagcgctatgaccgcatgaacgactctgtcgaggagaacgtgagcggaatccgcgtggtcaagtcatatgtgagggaggaccacgagagaaaaaagttccacgaggcgtcaggcaacgtgtaccatgacttcgtccacgtcgagaggatcctcgcctggaacatgccgctcatgaccctttcgatcgacgtcatctacgcatacgtcatctacttcgggtccaaggcgattgtgagctcccaggctcagtcgatgggcgttggccagatgtccgccctcatcacctatggcttcagcatgctcatgagcctcatgatgctctcgatggtcttcgtgatggtcaccatggcagaggagggggcacgtcgcctgtgcgaggtgctgcgggaggagagcgacatcacaagccccgagaacgccctcaccaccatcccagacggttccatcgacttcgatcacgtgagcttcgagtactcgaggagcgcggagaggatggccctcgacgacatcgacctccacatcaagagcggggaggtgatagggatccttggcggaacgggctcctccaagtccaccctggtgcagctcgtcagccgcctctacgacgcgaccaagggcaccgttcgggtaggtggtcatgacgtgagggagtacgaccttaaggcgctccgcgaccaagtcgcgatggtgcttcagagaaacgtgctcttcagcggcaccatcaaggacaacctacgctggggcgacccaaacgcgacggacgaccagatcctggaagcgtgcaagctcgctcaggcagacgagttcatccagctgatgcccaacaagtacgacacctatattgagcagggcggcaccaacgtctcgggcggacagaagcagaggctctgcatagcacgcgcactcctgaagcgccccaaggtcctcatcctggacgactccacgagtgccgtcgacaccaagaccgacaagctcatcagggcgggattccgcagctacatccccgagaccaccaagatcatcatcgcccagcgcaccagctcgattgaggattgcgacaggatcgtcgtcatgaaggacggacgcatcgacgatattggcacccacgaggagctcctacgcaggaacgatatctaccgagagacgtacacgacgcagaacaagcagtcacatgacgtgaggatgagcgaactcgcgccaaacaggaatcgcggagaggagggtgcaaatgagtaacacccaggaatccaaaagggagcagcaaggggggcaccgcggaccagcaagccccggccgcacgttcggacgcgtgctgtccatgacgtatcactattatcccgttcaggtcaccgtgcaggtgatgtgcatcattgcctccgcggtcctggcgtcggtcccgtcgatattcatgcagcaggcaatcgacgtcgttcaggcaaccttcaagaccggcgactgggcgacagcacagccacagatcgcacgcatcgtcggctcactcgtcctctgctacgcagtcgcactcgcggcaaacatcgcatacaaccagcttggcgccgtcatctgccagggaaccctcatgaaggtcaggaaccagatgttcgaccacatggaggacctccccatccgctactttgacaccaacaagcacggcgacatcatgtctcactacacgaacgacaccgacacgctgcgccaactcatcggccaggccctgccaaacttgctaacgatggcctttgcgatgggctccgtcctggtcatcatgctctggtactcggtccccctcacgctcgtcgtcctcgccatggttctggtcatggtgtatgcgacgaaggtccttgggggaaggagcgcccgcttcttcctggcccagcagcagaagctcgctcgcgttgagggctttgccgaggaggccatgagcggcgagaaggtcatcaaggtcttcacgcacgaaccacagacgatcgaggacttcgaccgtgtgaacgaggagctctatcaggcatccaggagtgccaacacctacgggaacacgctcatgcccgtgttgatgaacctcggtaacctcgcctatgtggttgtcgccgtcgccggagtcgcgttcctcaccagcgggactcccaacccctcgattagcgggatggccctctcgatctccatcgtcgtgcccttcctcaacctcaccaagcgcttcgccggctccatcgggcaggtctcccagcagatcaacttcgtggtcatgggcctcgccggcgccgagcgcatctttgaactcattgacgaggagcccgagcacgacgagggatacgtcaccctggtaaacgtgaggaggggcgccgacggcagcatcgaggagtgccccgagcgcaccgagagctgggcgtggaagcacccgcaccacgacggcaccgtcacctacaccccgctcgccggtgacgtgcgtcttgaggacgtcgacttctcctacaaccccggccacaccatcctgcacgacatctcgctgttcgcgaagcccggccagaaggtggcgttcgtcggcgcgacgggtgcgggcaagacgaccatcaccaacctcctcaaccgcttctacgacatcgaggacggcaagatccgctacgacggaatcaacatcgagaagatccgcaagcccgaccttcgccgctccctcggaatggtgctgcaggacaccaacctcttcgccggcacggtcatggataacatccgctatgggcgcctcgacgcgaccgacgaggagtgcatcggggccgcgaagctcgcgggcgcggacagcttcatcaggcgcctccccgacggctaccagacgatgctcaccgacaacgcggcgcagctctcgcagggccagaggcagctcatctccatcgcccgcgccgccgttgccgacccgcccgtcatgatcctggacgaggcgacctcgagcatcgacacgcgcaccgagcagatcgtgcagaagggcatggacgccctcatgtacggcaggaccacgttcgtgatcgcccacaggctctcgaccgtgcgcaactccaacgtgatcatcgtcctggaccacggccgcatcatcgagcgcggcacgcacgacgagctcatcgcccagaggggcacgtactaccagctctacacgggagcgttcgagctcgagtaggcgagtctagcggagagacccgcgacgacggagcccccatcccccaaccgcggggggtgtccctatagttttgtcaagcagcagatgggggcttttcgacatctgcggctgccgacggctcgacgtagggcaccctgtcccgcatgatggcatagatcaccctcagcctcttcctcgcgactgcctggacgccttgttgtgcctcatgcccctctcgacgctcacctctcgtagtaaaccttccgaccttgttcgttggtggcccacgagcgagttgtcaggctgaataagcaggttctctagtggccttgttccccgcgtgggtgctcgtcgtcgaactcagcgaggtgcccgagtcgctgtccttcggtcgtgcaccgccgattatgccgcaagctcccgtcgcccccgggaagaggctggatgtctatcgaggtcccgagggcggcggcggtcttgggccgacgcccggcaaccgtgtacaggcaccggtaggtctcgtccctcggaaagcatttccactcacactcggcggaggagactcggagctgccatccgcgtcgaggccgtggcgatcgcgtccgcgagctccctcaccaccagtgtcctcgctccccggatggcgcacgactccgccgaggcgcacgccgagctccagagcgcgtccctttgcctccctcgtggccccgcctctcgcgcacgccccccttagcctctcctcctgccgggccgccgcgatgccgtgcgggcgccctccgaaggcggccatcacgcccagcgtccatgcggcggagaggtcgggccgagcccctcgagcgggtctgactcgaggagccacggcatgcagcctggttcctgtccatgggtggcccgcctcgtggcgtatgcgagctgcggagatagcagcgacatggatgcggccggtcgtccgtgtcccgatgggacacaccgcgcgtcgtcctgaggctcatccctcccccggcctgggcgaatgaccgcgtcgacccggtcgttcttggccgtccagggaagcagtccctcgtgctcttcatcgactttcctccgggcaggtagccgacgtcgacccccttcgtcccggcacctgcgcaacgacgagggagccgatttgttcttctggtcacgcacagggcgtcgcacccgcctcctcgagcagcgcgtcgacgtcgtccgggcgtgttctccaccggcgctgatccggatctcgccctcccggtcgagtcccgacggcccagtgaagacttcccgacatccacgccgaggttacagactcgtgggggccgacccagtcttccgcctgcgcttcatgtggtaacctcctcataggcgttgctggccaccgtccctgttcgggcgacacccacattacccgccttgcggcacgtccgtgcggcacatccctatcagtcgtttcccttgcagggcaccatcccccggcggcaacaccccccgggcctctggaggtcagggcagaggccttccgggggcggtcggccagcggccccggagaggggccatctgcaaggttagggaaatcaaggaaatagcattgttgaaaaccctacggcttggaggatccctcgggggccagctctgactgtaatgggtgggggctctcccgtttgcagcgcgcctctccctcgccccctcggtcgccacccgggacgggacgacgggtcgatttgggcaggatggcggggacctgtttcgaggtcgagcgcgtgctgcttggggcgagaatgtcacccaaacgggagctccaaacaacctattggatagaaagcctccgtctattcgacagaaggcatcaaagcatcagcgagcggcccttggaccagccacgacgcataagtccacgagagcttcacgaggttagtttattctcttacggtccccgacgttaggaatgatgcatggagcagggcccagcgatcacacgacgcgccttcctggcggccatggcggccacctcgaccctggcgctcgccgcgtgcgaacccgcagtcccagacaccatcgacagcgcgagcgaggactcctccgcggactcgtcgtccggcgaggtgctctcgcaggcgctcgacaacgggttctcgtccggaacgcaccacgtcaccatcgaggtcagcggctatggctccatggacgtcgagctctacgcggactccgcccccatcacggtgagcaacttctgcgacctcgtgcagcgcggcttctacgacgggctcaccttccaccgggtcgtgagcggcttcatgattcagggcggtgaccccaacggggatggcacgggaggatccggacgcaggatcaagggcgagttcaccgcaaacgggatcgccaactccatcctccacaagcgtggcgtcatcagcatggcgcgcgcgacggactacgattccgccagctcgcagttcttcatcatgcagcagcaggacacggatctcgacggcacgtacgccgcctttggccgcgtcaccagcggcatggaggtcgtcgacgccatttgctccaaggtgaggccgcaggactcgagcggcctcgtggcaaaggcggaccagcccgtcatcacaaagattgccctcgtggactagggcggaaggcaaggagagccatgacagcgaacaagggtgcaagaaggggcatgcgagccgcgggagcaatcggagcggcgacggcgctcgccctctcgctctggtccgtcccggcgaccgcccacgcggccgacctggagagcctgcaggacgccgccatcaaggccggagaggactaccaggcggcggtcgacaagtcgaacgagctccagggcaagatcgacgagaacaaccagcgcatcagcgagctggaggcccagctccccgagcagaagcagaaggcggccgcggcgattcgcagccactacaagttccaacaggaccaggccaacctcgtctcgctgctgctcacgtccgactcgttcagcgagttcctctccaccgcacagtacttcaccaccatcacctcatccaacctggacgagatcgagcagctcgacagcatggagaaggagcttgagcagaccaagcaggacctggagtccgagaaggccgcagctgacgcccaggtgagcgtgacccagcaggccaaggaggaggcggaccagacggcgtcggccgccgaggagaaggccaaggaggaccaggcagccaagcaggcagcgtacgaggccgccgtggcgcagggcacgcaggacagcgacaccaacgccgcgctccaggcggccgcgagcaagagcgccgactcctcgtccggctcgtcgtcctccggcagctcgtcgtcctcgtcaagcagcagctcctcgtcgtcctcaagcagctcgtcctcctcgagcggcagcaaggggtcgtccggcagcagttcggcgagctcgtccaagggaagcggctcctcctcgtccagcagctcggcgagctacaagtacgtgcaggcatcgatgtacggcgagggcgacggcttcatgtacgggaccaccgcctcgggcgacaccgtgacccccacctccatgggcgtggcgatgaagaccatgcccctcggcacggtcatcgagatctcctacaacggcaagaccgtgcgcgcggtggtcaacgaccgcggcccatacgccggcaacaggcagatcgacctgcagcccgccgtcgcgcacgcactcggctttgacggcgtgggcaccgtgggctaccgcgtggtgagctagcggcacacacagaccaggcatcggcccgtcgcaaccgcggcgggccctttacgttgggagcagccatgtcacaggagaccagcacaccagtcctccagaccacgcgccttcgcctcaggccctggggagaggaggacgcggacgcgctgtaccggtttgcccgcgaccccatggtatgcgagggcgcggggttcccgccgcaccagagcccagaggacagcaggcgcgtcatccgcgacatcctcgccgtccccaacagctgggccatcacgctgcttggctcaaacccttacgccggcccggtcggcgccatcgccctcagggtgggcgacgcctcgtccctcggcatcccggatgacgaggcggacctgggctactggctgggaaggcccctctggggagaggggtacgccaccgaggcgtgccgtgcggtcctctcctatggcttcaggtcgctcgggcttgccgccgtatgggccgcctactacgagggcaacgagcggagccggagggtgcaggaccggcttggcctctccccgcatcaccgcaacgagggcgtgaccgacgccgccgggagggtgagggacgagaacgtccagcgcatcacgcggtccgagtgggagcagacgcaggcggcagacccccagagccctgaccagatcgagcgccagcagcgtcaggccggcaccctcgtggagggcatccgcctggtcgcccgcatcaggtccggtggccagacgggcgccgaccgcggcggactcgacgccgcgcgcgagctggggacgcccatctgcggatggtgccctcccaacggcctcgccgaggactacccccaggctcccggggtcatggcgcagtacccggagctgcggcccagcccctccgagggatacgtggagcggaccgcctggaacgtgcgggactcccacgcaacgctcatcgtggcaccggcaggcctggagcccaagagcggcacggagatgaccgagcgcttcgcccgcgcctacgggcggccgtgcctggtggtacgcggcgcatcggaggcgggtaaggtggcggagtggctccgcggcatcgggaccgggctcaccctcaacgtcgcaggcccgcgcgagtccaagctgccgggcatctaccgcgagacacgcaacacggtcgacgcggtgctccgtctctgcggctggggagactagcggggatccgacggcgcaagccaatcgcttggtggaatgcgggcgttgagccggggggagcttggctctccccggctttgctctgccttggcgaggggatgcaggaccctagcgcctgcggtgcctggactccctcatgatctggtgaacgatcgtgagtcccaggaccaacgcgatgaagtagcccaggaagccgatgacggggatgccaaacaggacgggctcgatgcgagcgtagtagaccaccgaagagccgatgaagagcccggcgacgatgatgcccatggtcagccggtcgctcgagcgcgccaggtcgcccatggggtcacgggtgccgggaaggtcgacgcccaccctgagctggccgcgcgtgagcatgctcatggcggtgtccgcctgcgaggccgccctgaggagcgagtgcgaggcggtatatccctcgcgtccaaacctacggatctcgctgcgcgcaaggtccttgggcgtgaggtgcgcgcggatgtgatcgcgcaggatctggacgatcgagacgccggggagaaactcgtccaccacgccctcgagcgtcaccagcgagcgggcgagcatggtcacggtccccggaagctcgatcccgttcttgcgcgccatgttgatgagggagttgaggaacgcccccacgtccaggtcgcccaggtcggcgtcgccaaagtcgtcgatgatggagtccaggtccgccagcaggctcgcgtggtccacgtcccgcacgtccgagaccgagaagcgcaggagccccgcctccaaccccgcggcgtcgtgccgggcgacggcgaccaccatgtcgcgcatcgccgcacggtcgtgcgacgacagccggcccatcaggccgaggtcgagatacacgatcctcccgccccgaatcaccaggttgcccgggtgcggatcggcatggaagaacccgtcgtccagcatctgctgggcgtagttgtccaccagtttggtgcctatctcggcgaggtcgtacccctgggagagaagctcggtggtgttgccgatggggatgccctccacgtagtccatcaccaccacatggcgagtgcaccagcgcgggtagggcttggggcagtcgacgaaggcgcacccggcgttgttgcgcctgaactcctccaggctcctggcctcgaccaggaagtccgtctcctccttgaacgactgccacagctcgtcgaccaccgactgcaggtccaggaactgctcgtcccccacaaagcgctgggcgcggcgcgcgagcgacatcatgatggagatgtcctgcgccatgatctcctgcacgtgcgggcgctgcaccttcaccgcaacggtttcgccggtgatcaggcgcgccttgtgcacctgggcgacggaggcggaccccagcgggacgtcgtcgatggcgtcgaagatgtcctcgatgggaatggggtactcggcgcgcagggtgtcgagcaccacgtcgcggctcatgggctccacgtcggccctgagcttggtcagctcctggcagaagctctcgggcaggatctctgacctcatggagaggatctgccccgccttcacgaaggtggggcccagctcctccagcagctcgcggaagttgacgggcgtgaggccgcggaacacgtcgtagtggctcgcgatcgagaggatctcgcgcatgcgcgcgatcttgctcttgcgcgagatgccgaactcccggtcgtcgcccgagtggcggccaaagatgccgatggtgtcctgccactccagggggtcgtccagccgtgcgccggcccacgagtccggggagggggcgtccccgctcccggtggatgccccctcctccctctcgtcggatgggtccctgtcgatcccgcgtcccaaggtcactgcgccccgggccgtctacgccttggcggagtcgtcgtccgcgtcctcgacctcgacctcgacggtctcggcatcgaggtcgtcggcgtactgctgcgccttcttgacccacgcggcgcgctcctcgggcgtcatgcccttgagcttctccttcagggcggcgtcggagctgtccgccgcggcctccgagaccttgcggtggagctcctcgttgatggccttgccctgctcgaccgtcatctcgcccttcttgacgaggtcgttgaccacgctctgggtcttctcggcacccattgcgacagcgcccacgcccagcaggaatgccttgcgcgcgccctcggtaagatcatcgattgcagccatggtggaacccctttcgcagaccgttggcaagcgagacttgccctttgggctactgtaccccaccccacggggctggattcgcccccgggcggcaaagcccccgaccggtcgctgccagcggcaaggcgcccgcgagccctaccccagcaggatgcggcgcagctcgtccacgctccccgcgatggcgacggcgccggcccgctcaagctccgagcggggcgcggtgtggccgtaggtcacgcccacgcacgggacgtcgttggcgctggccccgtccacgtcaaagtaccggtcgccgaccatgaccgcctgcgaggggctggcacccagcgcgtcgagcgctcgggcgatggtctgcgccttcgtctctcccccgtcactcacgcgccctatcaccaggtcgaaggcgtcctccaggccgttgtcggcgaggcagcggcgcaccatcgcctggcgcttggagctggcggtggcgacgacgcggcccgcggagcgcaggtccctcacgagctggccaatgccctcgaacgccggccacgcggcaggccccaggttgtcgtagatgtcgcggtaccttcgggtgacctcgcgggcgtccccctccgagaggccaaacaccatcgagaacgcctgcgggaagggcggccccacgagcttgggtgcgtccaccaggcgctcctcgggaagcccgtagtcgcgcaggacggaccgcgcggtcctcacgatgccgtcgagggtgtcggtaaccgtgccgtcaaggtcgaagaggacgaacctcctcgcacggatgccctcgacgacggacccagttccctctcccgacatgcgtcctcccccttgccgcgcgccatgcgcggcgctcgatacgctaccctcatacgctaccgcatggctaccataccgcaccggtttgagtcgcgaaggttacgggaggagaaacagcggatttccgagcgcctgaaaatcccgccggagcgatagcgtactagcttgaagaatcatacggattcaggaggggttcatgtcccgcgtctacaacttctcggccggccctgccgcacttcccgagaccgtgctgagggaatgcgcggcggagatgctcgactaccgcgggacgggcatgtccgtcatggagatgagccaccgctccgcccccttccagcagatcatcgacgacaccgaggcgacgctccgccgcctcatgggcatccccgacaactaccgggtgctgttcttcatgggcggggcaacgctgcagtttgccgcgatccccctcaacctcatgcgcaacgggcgcgccggctacgtggtgagcggcaactggtcgcagaaggcccagcgcgaggcggggaagtacggggagtcggtggtcatcgcatcgagcgaggacacgtcgttcgaccgcgtgcccgccttcccggcatcggtggaccagggcctcgactacgtgtacgtgtgccagaacgagaccgtctttggcaacatgatgcgcgagttcccccagacgggcgacgtccccctggtggcggacgtctcgagctgcttcctctcggcacccctcgacgtgagcaggtttggcctggtctacgccggcgtgcagaagaacgccggccccgccggcctcaccatcgtgatcgtgcgggacgacctcatcgcagacggccctgcccacgccgacatctgccccacctacctggactaccgcgttgaggcggacaagggctccatgctcaacacccccaactgctgggccatctacgtgtgcggcaaggtgttccactggatcgaggacaccggcgggctcagggccatggaggagaggaactgggccaaggtgcgccccctctacgactacctggacggcagctcgctcttccacggcacggtcgtgccggccgacaggtccatcgccaacgtcaccttccgcacgccgtcgcccgagctggacgcggagttcgtggcaggcgccgccgagcgcggcatcgtcaacgtgaaggggcaccgcctggtgggcggcatgcgcgccagctgctacaacgcggttcccgcccaggcggtggacgcgctcctctcctacatggccgacttcgaggcgtcacaccccgtggccccgcgatctaggtagccggtcgaggccggccccatcacaacctagaagctcaagccacatcacgacaccagggaggtagccatgcgctacgtcaaggttctggacaacatctgcaagaccatcacgcgagacggcatcgccgagctgggcgagggatacgagaagaccgacgacatcaacaaggcggacgccgtcctcgtgcgcgcgaccgacatccacggcctggacctggggcccaacgtccgcatcatcgcacgctcgggggcgggctacaacaacatccccatcgaggagtgcgcccgccgcggcgtggtggtgtgcaacacgcccggcggcaactccaacgccgttaaggagctcgtggtgggcatgatgctcgccaactcgcgcggcacgctgggcggcatggagtgggtccgcgccaacgccgatgacccggacatcgtgaagggggccgagaggaacaagaaggccttcgtcggccacgaggccatcggccgcaaggtcggcgtggtgggcctgggcgccgtgggctccaaggtcgcgaacgcgctcatctacctggggctggacgtctacgggtacgacccgttcctctccgtggagcacgcgtggcagctcgaccgcgcggtcaagcgcgtggacagcatggaggaactgtgcaagggcgccgactacctcacggtccacgtcccctccaaggacgacacgcgccacatggtcaacgccaaggagctcgccctcctcaacgacggcgccatgctcctcaactacgcgcgcgccgacatcgtggacgaggccgacgtcaaggccgcccttgagtcgggcaagctcggctgcttcgtcaccgacttcgccacgcccggcaccgccacgatgccccacaccctcattaccccgcacatgggcgcctgcaccaacgaggcggaggagaactgtgcgaccatggccgtgagccagatgaaggagtacctggagcgcggcaccatccgcaactcggtcaactaccccgactgcgacctgggcccctgcaagaccggcgggcgcttcgcggcgctccacgccaacgtccccaacatgatcggccagatctcgaccgcgctcgccgactccagcgccaacatccagcgcatgagcaacgaggccatgggagagaacgcctacaccctggtcgacaccgactcggcgctggacgagggcaccctcgcccgcctgcgctcgatcccgggcatctaccgcatcagggtcatcaagcccgcccgggcctaggcggcccgcatcgccctgcagccgcggggattggctaccattggggacggtcgcccaccacgggcgccgtcccctctcttcctgacgagcaaaggagagaccatgagagcagagcccatgacgtgctggcgtcccgcgcccgacagggcggaggagtttgcctcgcttccctacgacgtgttcgaccgcgagggggcgcgtgcctacgttgaggcgcacccccggagcttcctcgccatcgaccgccccgagacctcgttcccgcccaaccacgacatgtacgcgcccgacgtgtaccagcgggcggcggacctcatgcgcgagcgcgcgaccgacggcacgctcgtccacgacgagacgccctcctactacatctaccgccttgagcaggacggccacgcccagaccggcatcgcgtgcgcctgctccgtggacgagtacctggacggcaccatccgccgtcacgagaacaccaccgccgccaaggaggaggaccgcgtccgccacatccgcgcgacgggcgcccagaccggcccgatcttcctcacctaccgcgacaactacgccatcgacgtgctggtgggggccgcctcgtccgcaacgccgctgtacgacttcaccgacgccgagggcgtgcgccagaccgtgtggcgcgtctctcgccccgccgcagtcgaggccctgagggcgaccttctccacgatcccctgcgcctacatcgccgacgggcaccaccgcgctgcgtccgccgtccgcgtttgccaggagctgagggagggggacaagggcgaggcaggcgagaggccctgggacaccttcctcgcggtgctgtttcccgcgagccagctccacgtgatggcctacaaccgcgtggtgctggaccggggcgggaggtcggtcgacgaactggtgagggacgtcgaggccaccgggttcgaggtgggacccgcgcaggacgcgcccgtctcccccgccgggaggcacgagttcggcatgttcgtcgggggcgcctggcgtccggtacacctgaccgcggagctgcccgaggacggtgaccccgtatcctcgctggacgcctcgatcctgcaggagcgggtcctctctcccatcctggggatcgacgacccccggacgtcggagcgaatccgcttcgtgggagggatcgagggcctcgggaggctccaggagctggctgggacggacggggtggcgttctcgctcttccccacgtcggtggacgagctcatggcagtgagcgacgccggggagctgatgccgccaaagtccacgtggttcgagcccaagctacgcagcgggctcttcatccgcaggctgaagtaggagtttggtgattcgttcccgccggttggcccgggggctgcgacgacggcccccgggccgccttgtctgcggacgcctggtcggaatgccagccgccgctagccatgaggcttcgacgggcggtacgaagcggcatctccacaggtgacccctccaaagaactctaagaatggaggggcagcattgggtgagacgtcctttcgagcggcgtcctcccgatgggttagcctcggtaggcccagcagggcctctcatccacatcgcgttcccgagctttgcaggcgtcagtcttcaagccgtggcagcgaaagcccgatatgagtactcacttcaagctttcgctgccacgaggtggcttcgaagagcttcggtcgcaccatctacctggggtcatcccgttcgcccgtaccacgttggcacagaattcccgatatgagcactcatatcaggcgccagttgccattgagaccaaggacaggggtcagatggcaggaagctcccgacgtgagtgctcatatcgggctccgcctgccatccccttgaacccggaaggtctcccaaccgttctacctgcatatatgcaggtagaacccaatacgttggcagagaacccctgcacaaccgctcacatcgggactgcgctgccatggtttagcccttgatgtcctgcttggcgatattcgatggtcctgaggctacccccctggccatgatgtgctcctccccaaagctagaaccagatccccagcacatcccacatgcgagccgctcaaaagaactcagagagggggaggatgggagattctgtctgtggccggggttggatccggcccgtcgcggcacaccagggagcgtccgcactgccgggcggcgtcagaggggtcccaccccctcagagcttgcccttccagcagcaaggccaacatcatatattcaaccgttgccaaaaagtccgcatcgtgtgtacacacagggtggactttttggcaacacgaggccttagcttcttgccaacagggggaacgcaggtagtgcgcatagacgtggtgtaagagctggcggggagcggggcctcgtgcccccgacccgacagcttgtggccaagggcagatgagggacatcgcctacaatccgtcgttgcttcaggtaacggaaatgaaggaagaccgatgtccctcgatgagagtgtatgccgatgggcctcgaggaggccctatacttccagcgctctggaacgagtgcgacgacgcccgcgagttcgcatgcaggtcctgtcgctggtcatgaacgcggtgatggacgagcagccccagctcgcctgcgggcggccaggggcagcgcacgcaggcccgcaccaacagcaggaacggctacaggccgcgcaccctgaggaccgccacggggacgtcgagctgaggatccccaagctgagggagggctcctacttccccaggagatgctccccgctggtcgagggtggacgtttcgtggccgcgctcgtgcaggagatgtactctcgggggtctcgacaggaaggtggagagtagccgagaagctcggcatctcctccctgtcgagctctgaggtctcgaggctgtgccaggagctggacctcgaggtggagccctgaggagccgcgacctctcccggatgccctgctgctacctctggctggacgccacctacatgagctgcaggaggactccgtcgtctccctcccacgccgtggtgacggccatcgggtggcgcggacggcgcaagcacgtcctgggcgtcgaggccatggacaccgagagcgaggagggctggaacgcttcctggcgggcctcaggcgcggggactcgcgcgtcaggctcgtcatctccgacgcccatgcggggctcgtggcggccatagcgcgccagctgcagatgcgcctggcagcgctgctcacccacctgcaaggaacctcctgtccgccatggcggggaggccgaggcctccaagggtgcgtgacgaggctcgtgcacgcggccgctacgaagggaccggagtctctccaggccatctggaggaggccgagcccgggtcaggagggcctccccaaaggccgcggagatcttctcgcgcgccgaggactcggccctcgccttccaaggcgttcccaggcccactgggcgaagctcaggaccacaaacgtcctccgataatccaagaggcccctggggcgacgagccgttcgtccctggtctatggttcgttccggcgcggcgtggtgacccacaattgattgacgtccgtccgggggtgtcctcctcttgatatgtcccgcccgcgccgcgtgccccgcgctgccgtgacctgatagaagcctggcgcggcggctcttgcggagggcgccgctcacccatcggagcctgtccggcggccgcggcatgtcgaatcatacccggtgccgaagacggttggacgtgatgggcatggaggtcagatgggacggcgtccctcgggacgccgtgtgggccggagtcgacacgcacgccgacacgaactggctgagcgttgtcgaccgcctcggggccgagctcttctccggcgagttccccaccggcgcggagggatacgcgaggctatcgcgagcgcacgcgcgctctggacgctcgtggcggccggcgtcgagtgcacgggcaccttcggggcggggctcgcgagggagatggctccagggcgtccgctgctacgaggtctgtggtcccgacgaggagccgcaggagcgcagcgccgcaaggacgacgcggcggacgcgctcagggccgccaggcaggtgctctcgggcgatgacctggcggtcccgaagtcccaggacgctgggtcgaggaggtgagggccctctacgtccgccagggagggcctcttgaggtcgtgcacttcgctcccaacatcgccctggcgaccgtgaggaaggcccctgacgacctgagggccgccttgagccgctcgggacgaccggcatctgcgcgcgtgcgcgtgctgggagacgatggctcccgccctctcgagagggcggccaatgtctcgctcagggcgctggggaaggcctggtcgcccagcgctcgtccgcccgggacctcgaaggggcgatcgccgacgccgtcagaaagggaacccggcgctcgccgcgatgtaggggtgcggcgcgctctcgccgcgcctcgcgaatgccgcggcgacaacccaggagcctcggaggccctcgttcccgccctctgcggcgcatcgcctatgaggcctccagcggcaaggtcagggcgccatcggctcaaaccgcggcggcgaaggcgggcgaacaggggccctgcacgtgatcgcgatgcacaggatgcgcaccgaaccccggaccatcgcctacgtggagaggcgaagggccgaggggctctccgaccgagagatacgccgctgcctcaacgctactcgcgcgcgaggcgtaccggctcctgacgaatcccgaggacgtcccgcgagggaacggccccgggcgtagggaggccaggcatcgcgcgggcgtctcgcagagggacgcggcgaaggcgcggggggtcacggcctcgacccctctgggacctcttctgttggccaccacagtttaagacctcgcgcccgttacagaaagttggttactatggctcccgatggatgcggaagaccccgcccgccgacggcgcttgacaccagataacgcatcaggagaggcgaaccgggagatcagcgtctctacagggccgtgtcagtccctttccctcggtcgagtcgatggtgcgccgtgagcgtggcctccatactctcggaggaggggcgctgggccacccagcgcgtcttcagcgaagagtccgccgccctcggcttcagggaccccggacccagggaggccccctcgagggggaggagggaggcactcgagagaagggccgcacagatagtctcggagatagccgagagctgcggcctcaagaaggagtaggattctggcagcgtcggcagcaggtgatgtgccttcttacaccacgctcgtgcgcgcgatcggaacgcaccagcggagcacgccctctgtcagaaatctcacgccatgtgtacacgcggtacggactttctgacaaccgggggtcgaaaggaaccactgtgtctaaaatcacgtcccgcgtgtacacgcgggacgtggtttcagacgacggtgacgcgttttcgtcccgtcaactggggaaatgcgtggagataggaagccgatgtcaacattctcatcccgtgagtacacgcgggacacactttctggcacggacaagacgtcggtacggtcccccgcccaccccagggggtccagagacggcaacctgtgacgaagcgcaccgaagcctgatgaaagctcgctccccttcttagaccttgatgtccttacctccgagtcaccgtacgggctcctggtccccacgcaagtagacccacccgggaggaggcgccaaaagatggtttgtcccaaacccggaccgaccgcccctctccccttctttgacaacgaagcccccacccgcggcgacgccggcatcagcccaaacggatgcctccctctcccccgggaagacaggcggcagccccagggcaggagccgaggtccaaggcgcgctggcacccgtcactgttaagttagttttggcgcgattcggcggatggcatacaaatgccttgtccgctgtagccccatgggatatcgtctgcgcatgcgcaggaggccgcggaccatgcgcggccatgacacgtcgccgctggcggcaggttggacagagatgcagatgggtcattcccacgggggcacccaacggggccccataggtcacgacgtagacacccgaacgacgcacaggaccaaggggacgccacggggcggaaccccgcgcgaggcgggacagcactccccccatgctcacgtcccccaccacgaggcacaccagggggcggagaggatcgtccccgtggagccgaggggcaaggcccgccggcctcggcgccacggcggcagggccacggtcatcgcgattgccgcaatcgtggcactcgcggcgggcggcgcgtggatgtggcacaaccgctcggtgcaggtcaccctcgacggcgaggcgtaccagaccaagaacggatccacgctcgagcagatcatcgagcagaagggcctctctcccaaggcgggcaacctggtctcgatcaacgggaacgtgatcaagcagggcgagggcaatgccttctccgccaaggtcaacggaagcgacctgtcggaggaccagatctcctcgtaccatgccaagtccggcgactccatccaggtctcggacgggacggacaaggtcgaggactccaccaccacgtccgaggacgccgagcccaagctcacgatgaagggcgactacggcgccgtagcctacgtgtcgcagtggggcaagatgggcaagaagaacgtgaccacgggcaaggtctcgggagagacgaaggagaccgtgacccaggagccccaggacgtcgtgatcaccctgcacaacgtgaagcccgacaacgggaagaagctcgtggcgctgacctttgacgacggccccagcacctacaccgagcagtacctcaagatcctggcccagtacaacgccaaggcgaccttcttcaacctgggcagccagattcgcgagtaccccaagctgtccaaggcgatcgtggacgcgggctgccaggtcgcgagccacaccgacaagcaccaggagctccctgccctcgacgcctcgagcctgcagcaggagttcaccaacaccttcaagtcgatcaaggacgcggacggggtcgacacgaccatcttccgcccgccctacggcgagttcaaggagagcacctggctcaagtccggcggcctggtgtccgcctcgatcatatggaacctggactccgaggactggcgcaggccgggcgtggacgcgatcgtctcaaactgcaccaccggcgtgacctcgggctccatcatcctcatgcacgacggcggcggcaaccgcgaccaggacgtggaggccctccccaagatcctgcagaccctcaccgaccagggctacaccttcgtcaccatgaacgagctcatggcgtcggacagctccatccccagcgacatcgccagcggcaacgccacgatgcctgagggcagcgtctggcccacccagatggaggagtagccgcaagccacaattaacccggcagcacggcagcccgcccccagacgaaagcccgggggcgggctcgtctcgcccgacgttggccggatgctgggtataagcacctagaacgagagatgctggcgccagcgttggcgcggattgggttttcatgggttctgagcacgacgacggaagggccccgcgcaagagggccatcgaccttgcggcaaaggttgccgcggcatgtgggatagcgggcgttgcggcgtttgccgcgcttggcgtggaggcggtcacggtcgcgctggcggtcgcctgcggtgcggccgggtgcgttgcggcgaccggtcaccacaatcgcgaaaggggtggggagaagggcgacgccacggtcccgccccgtcccgaggggctcgagtacaacgcgcccgcgacggtcgccggcgatgccacgcgggcggagtcgcccaagcccgaggcggcgcccctctcccccgccaacgagggggacgacgagacggccgcggaggagcgggacgacgccgcaagcacggacggcaccccctccgtgctcgacttcgacgcgctgatgaccaagcttgtctcgaccgcggaccccgtcgccgagctccggctgttcgtgggagacgtgcgggcgcgagagcgtgccaccacgcacggcgaggccacgggcgagacggacgaggccaccagggacagccgtcccatgccgtcgggcgcggagctctacgccgcccgggtgctggaggaggcgggcctgttctccaacgacgtggacctcccctccatgcggtgcgtgcgcctgagcacctccgggatgccgtacctcagggtgacccagcgcgagctgccctacctggcccgcctgagggtcctcaagctcgaggcggcgctcaccgccgtccagtttgtcgcgagctactttgacgacgacctccccacggtcacggtcgaggactgctgcaagctcaaccaggaggtcgcggcctccatctgcgcgcagctcccccccatcgcacaggtgtcccccacgcaggacggcgatgagcccgacggcgagtgggcggtgcgccgctccatatcgacagcgctcgagacggtgcagctcccctaccggctctccgccaagtggcgcgcgaacgtctcgtatggcaacgtcgccttcgaggtcgcgctgacccccgaggccgtgtggccctcgtccatgttcgtccccggcgtcggcctggtggccagctcccgcgagatgcgccgcaaggcagcctccgcgtacgcgctcagggtcgccctgctcctggcctccgtagcgttcaggagctcggagagaatccgtcacgtgtgggtcgcagggacaatcgacacgacgacccggcatcgctgctacctctcggtcgacttcgaccgcggcaggttcgcacgcctggacctctccgacacgcacgacctctcggcgatctaccgctccttcgtgccccagatgcgcttggaggagggcatactccgccccgtggcccagggcttctcgctctccgagccacgcttctgccccccagaccgctacgtccccgtgtcgctctcgtccaagcggcttcccgccgcgcaggcgaaggcgctggggaccgagcgcgtgtacgggctctccatcgaggaggccgagaagcgcgcactcgtcgcggctgacatcatgagcaggttcgcccccaaggacgacgccgaggcaacccagaagaacgtgcggaccatcctgaacgtcgcgggggacgaccccgacccgaccgtgcgcggggcggcggagaggtgcgtcgccaagctggtctcgggcgagatcgaggacgccgagcaggtcggcgaggagttcgtggtgggtgacgcgctggaccgcgccgcacaggcggcacgcgacgccctgcagaggaacgactacgccgagggggcgcgcatcgcgcacgaggcgctctcgcccgtcgacgcccgcggggactaccgcgatacgaccaccgtggtgtggcgctactttggcagctacgtggaccgcgccatgtacaaccgcctgctggagcccgccggcgcctcgaccatgctcgtccccgacgcctactacgagtgcaacctcgcactcgccatgtgcctgctcgggagcggccagggcgaccaggcgctccaggtcgcccgccggttgtgcgagctcgcacccctcgaccgcaacgcccgtctcctcctcgtccgctgccttgagggcgcctcgaggaggcccgaggcggaggaccagctcagggagatgctcgacctggcccacgaccccgagaccctgggggtcgcctactaccgcatgggctacttcatgtggcaggacggcgacgtcacggccgcccaggcgtgctacgcactcgcgatgaactacctccccaacgccatcccggtcatcgccatggagctcattgcgctctccgcccaggagggcggcacgctgcgcgaggagatgacggcggaggagatacagagcgtcctggagtcgtaccagatccccatggcgcccacggagcgggtgtcgacggtcttctacgactgcgtccgcgcctcgctggacgcggaggtcttccccgtcgcccgcaacttcgttcacgtcctcgcctcgtttgcccccaacgacatcctcatgggcatcatccggtccatggagggcgagccggacgagtagcgcctggcaacggcacaaggtgagaggaaccacaggcgccgcccccgcccgcatcctcgggcaggggcggcgccttcgtccagcgcggcgacgtgggggcccacctacactgccactctcgcctcattgaagccataggtgcagtagtggcggtagtactcggcggtcctgttgccaaacgcggcgaccacgtcggggttgttggccttgtacgtggcgaggtcgaacatcctgctcgagaccctgccctcggccatgccgtgctccacgaagtgcctgagcgtgagctcgggatcgccgtggaacgccgcagcgacgtcaggattcatctgcaggtagtagtcgtagtcgtacaccaggccgtagtcgaagccgtcgagggtgaacggccggttggtggcgtcgaagtcccccagatgcgagacgttcgtgccaaaccaggcgttgcgcgcaaagagccagtgggccaggtagtccacgttctgcccccaggtgcggaacggcgtcacctcgttgcgcatgaccgagatgccccacacgaccttgtccatcgcctgggagtcggccacctggctgcggtagtacgccagcgagtggaggtacccggcatcgcccgcggcatcctcgttgttggagagaagcacgctgcccacgagcttggacagctcgttccgatagatctccttcgcgcgacgctggaccgagggaatgctgataacccaccggccggttgggatcacgatgtcctcgtaccggctgaagtcggagttgggccagtcggtgcgcacgcccatggagccgtcgaagtcccacaccggctgcgccatgaaggtcgtgctgccagagtccaggtacaggtaggtcgaggtgttgaaggcgtcgatgttcttgcagaactcgctcagcagccaggtcttgctcaggctgtcgaggtccatggagtaggaaccgctgaggttgaagcggttcgcccgcgcgttctgcagagcctcctcgtacgcctcgctgatgcggcggatggcatccttcgaggcgacctcggggctcttcaccacgacggtacggtcggaggtctggaaccagcaggtctcccccttgtaccaggcgttgtcgatctcgaggagatacccgcccgagatgtcgtccgggtccttcacgccgtccacgtactggtacgtgtagccgtacttgttggtcgccgtgcgggtggggagggagcccaggtccacgtcggggtttgcctcctcgatgcggtcctccaggctgtcgatgtccacgcggccgggcttgacctcgaccttctcggtcaggaggtacgaccagcgatactccccgtcgtagtataggtccacgggacggcactgcacgcccaccatgcccagctcgagggcaaggttgtaggcgatggtgctgtggagctggctcgcatcgttggcgttggcgaggaggatccacttcttctgggcgttgtccttctcgcccgtctggaggaggtcggccttcttgtttaggctgatctggtagggcttcttcttgccgccccaggtggagttgccgcggcccttcacggtcgagaacttgcccttgtcgggatcgtccttggagtagacgactgtgccgtcgtccgcgatggcaacgacctccacgttggccttggtgttgtggtgcgggtcggcctcaacgaaggcgcgccccttgccgtccgcgtcctcgctgttgaggaagatcgtctccaccccactcgagcgcatcaccacgacctggaacaccgagtcggacccctcccgcgcaagcgagagcgtgacgctcttggacgacgggtcaacgccgcagagggccgcgaggtcgacggcagacccgtcgatcgtgacgaagtcgccgttgccccgaactcggacggtcacggggctgccatcctgcagggatgccccaagcgtcacgttagagagggacgcatacgaggggagaaagacgtagagcctcccgttggcagagaatgagcggacggtctggggctgcttccccttttgcgtggagaaggtggcggtgaggtcgggggccagcaccgcgttggcgtccgcaaggtaggtctggtcgtcccagctgccactgccgctttggagcagccagccgctccccgacagggtgagagaggttccgtcgcccagggcgtgcaggccggggatggcggcatgggcagtctcgtcgatgaggtagctgtggcgcgtaccgccgtcgtaggcggaggtcgtcaccttgccgggaccctccagccttccgtcgttgttcgcaaggtacacgtagccggtgccgcggtccacgtacttccctcggaccacgctgccgtcagaggtggcacgcgcgtaccagccggagccctcggaggggtcgacgagcctcgagcgcgcgatggtcgcgtcctgcccgagccagtaccgctgcagggagccccaggcggaggtcacgatccaccttccctggcccaggcggacggtcgcatggttggagccgtaccaggcgatgccctcgtcgctccaaccgaccttgacgaggttcccgcgctcctcagccgaagccgtgaagttgtgcgacccagatgtcgcattagggttgtactgacggaacaccgccgtaccggagcttgtgtcagagtaccagccgatgccctcgtacctccacccggccttgcgaagcatgtcccgctccacggcgttggtggtgtagtggtggtcgccggcattggggttgtacatgcgatagacgggcatccccgacgtcacgggcgcgacccagcccacgccctcgtagcgccagccgcgctccgcgaggtacagcatctcatccaacgacgaggtgtagaagtgttccccgctgttggggttgtacaggcggtagaggttctggtacctggagctgtcgggcttctcagactgggctgcctgcgcctcctgcccggatgcatctggctgcgcggagggcgtctccgtcgaagcgacggcgtccgcaccctcgtcgtggttcgtcacgccctcatccgcaccggcagcgtccgccgtctcgtcggcaccctgctccgtggggatggtgacgcctatggaggtgtccccctcggcgccatgggagacgtccgcgacatcagtgacagcgtccttctcccccacctgcgcacctggcgcctctgcctcctggttcgtggctccgtcgtcctcggtggagtcggagggaagaggggcgacctggtcaggggcggtattcccaccggcgtttgcgccctccccgaccgcctcccccgaagcggggcgctcatcggtcatggaagtttgggattccgtgaccgacgccggagaatcggctcccccatcgcccgcgacgacggggctggactcctccgcaaccggctccgccaccgggacggccgagtcacgctcgaccagcggcagctcccgcgcccaggagacgacgggggcggcggagagcgaaagcgcgaaggcgaggcccgcccctgcggcagcagcggcacgattcctgcgaggcttcatggtggtacctccgaaagacgcgttcagatgcaatgaataatcttaatgcagcccaaagctgcgtgtgcacgattatccgagcgtggccaaacgcaatccgcgggcgtccaaggaccgcccgcggagcctgaacccctgctcgtctccggggctatcgcgcaaggggcgtcagcacaccatcatcgcgatggcaagcacgaccatgttgacgacggcggtgacggcaaccacgggaagaatcgcgctcatcactgtcgctgccgtacggcaagaggaggggagccgggcgccatcgcgaacggatggcaacccggctccccctgcgtctctcccccacttgctagaggctgagcctcatcagacgggcgatgctcacgatgtagatctcgagcgcgcgcttgaactgggactcctcaaagccctcgtctgcgctgtgctccgcgcccacccagtcgggcatcgggaagtgcgggtcgttgggaccaaacgcgccgccggccttgaagtggcgcgcgtaggtgccgccgccgatggtgtagggcttgtcgttgcgaccggtgtactcgttgtaggtcctgaccagcgtctggatggtctcggcgttgggatccgtgtagaacgggaccatgtccaggtcaacgtggagcgtgcagtggtgcgcgtcgcacagctcctgcaccttctgggtgatcgtctgggacgtgatcgacttggggtagcgggcgtcgatcgtctgctcaaagcggccgtccttggtgcggatggtcccgccgatgcaggtgagcgggtcaaacaggtcgtcggtcgccgcgatgcccagcgtggagccgtccgtggagccaaagacgtgcctctccagctccaggaagtcacgctcgccctcgccgcacaggtcgtgcttaagcaggtagtcgaccaggaggccgatggcgttgatggagccctcgggcgtggaggcgtgcgccccgatgccgtgggcggtcaggcgcacgaggccgtcgccctcgttcgagacgtcgatgcggtcggtgccctccaggtcggacgcgtccgcgcgcacgactgcgtaggcctcgccggcgaccgcgttgcccacggtgccgccgtcaaactccacgatgcggtcgctgaccctgtcgctggtgatggtcgcggagtagccgcccttctccccgcagatcagcgggaagtccgcgtcgggcgagaacaggaactcgggctgctcgtagtgctccaggtaccactccacgtcgcgcatgtccgtctcctcgttgttgccgaggatgcagcgaatcgtgtagggaagcctcttgccggtgcgggcgacctcgtcggcaaagaacttggcggcatacagcgagaggaccgtggggcccttgtcgtcgagcacgccgcggccgatcatgtagccgtccttgcgcgtcaccttgaagggatcgaagtgccagccggtcccctcgggcacgatgtccgtgtggccgatcgtggcaatctgcttgggggactcgccggggacgtccgcgtacccaatgtggccctcgcagttatgcgcgtccaggccaagcctcgccgcgatcttgaccgcggcgtcgagcgcgcggtagggctccgggccatacggcatgccgggctgggcggcatccatgtcctcgacggacctgatggcaaccagcgtgctgatgtcgccgacgacgtcctcccacaccgactcaacgtactcgtgcacgcgtgccttgagctcctcgtctgccatgaaacgctcccttcgcatagatgcggtagtttattgaaacggacacaggttaacacgtcagaaacaaatggcacgccccccttccgccgacaggtagcacagcggcagcggatggcatccctctcgcctaccatggagggtacacgtcgaagggagcgagcgcatggcacaggcaccggacgggctgtggcccccaagctttggggccgcggtctttgactttgacggcacgctgagcgacacctcggcgctgtggaggcaggtcgaccgcatattcctcgcgcagcgcggcctggcccccgacgctgagtactcgcgcgccatgagcacgctcggctttgccgcgggggcggagtacacggtccgccggtacggcctggacgagaggcccgaggacatctgcctggagtggaaccgcatgggccgtgcgctctacgagacccaggcaacgctcaggccgggggcggaggcctacctgcgggcgctgcgggaccgggggatcccgatcgggctcgcgacgaccaacgaccccgacgtgctccgctccatgcgctccatccacgtggaccggctcttcgacgtggtggtgaccaaccgcgagtgcccggtccccaaggaccggccggacatctacctcacctgcgccgaccgcctggggcaccggccggactcgtgcatcgtgttcgaggacatcgtccccggcatccgctccgcgcgcggggctggcttcctcacctgcgcggtgcgcacgggggacggcatccagcacgaggcccagatccggcgcgaggcggacctgtggctggaggactggcgcgacgtcgcggtgggcgaaggggaggggtgatcgcccctctccccctcgttcttccctactgcaggtcgagcctcatcaggcgcgcgatgctcacgatgtagatcttgagcgcccgcctgagcgactcctcgctcaccgcctcgtcgggcccgtgctccatccccacccaggcggggacgtcctcggcgggctcgtgggggccaaaggcgcaggcgttgcggaacttgcgtgcgtaggtgcccccgccgatcaccaggggctccgccctgcgacccgagtactcctcgtacgtggagaggagcgtgctgatctcgggcgaggcgggatcctcgtagaagggcaccttgtcctggatgacctcgaacgacgccccgtggtccgcagcaagggaggagaggcgcgcggcgattccctcgcccgtcgtcgcgtcgggatagcggcagtcgatggtctgctccaggaggccgcctgcgtcgcgaaccgtcccgccgatggccgtgagggtgccaaagcgctcgttggagcaggcgatccccagcgcggcgccgtcgtgaccgctcgcgcacaccagccgctcgagctcgaggaactcgcgctccccgtcgtcgcagatcccgttccgcagcaggtaggtggcaagcatgccgatggcgttgaccgtcccctcggggagggacgcgtgacctcccttgccgtgcgcggtcagcctggcgagacccccgtccagcgcctccacgtcgatgcactcggcggcgggcagggtgctcgcgtcggcgcggaccgtcgcggtcgcaaggccggggatggcgttcacgaccgtgccaccgtccagcgagacgatgcgcccatccgtcccgtgcgcgcggcggaaccttccgtggaacacgcccttctcgccacagatcagcgggaagtccgcatcggggctgaagcagaacaggggctgctcgtagtgcgagaggtaccaggtcacgtcgcccatggtggtctcctcgtcgttgccgacgagcacccgcagcgtgtaggggagcctctcccccgtcctctggacctgacgcgcgaagaagtgggccgcatagagcgagaggacgaacggccccttgtcgtccaggacgccgcgtcccatcaggaagccctcgcggcgcgtcacgtcaaaggggtcgacggtccagccaagcccctcggggaccacgtccgtgtgggcgatggtcgcgatctggcccgcagactccccggcaaggtccgcatagcccaggtagccctcgcagtcgtgggcgtcgaggccgagcctagaggcgatggagagccccagggcgagagcctcatgactcttgggcccccagggcatccccggggcagcctgggagaggtcctccacggagcggatgcggaccagggacctgatgtccgcaaccacatcctcccacacctcgtcgacataggcgtcgacctcgcgcttgagctcctcgtcggacatatcggtctccctccggtcgtgtgttccggaaagagtgtaccgtttgcgccctcgcgcgttctcgctcgcacgaacgggacacgggacgtctcgccccatccctcgcgaagggtggcggggcttcctacctggaagcgtcggcgcggtcgcgcgactccctctcgtactcacccatcacgcggagctcccactcgcggcggttgcccttgttgaccgtgtcaaggatgagcccgcagcagaacaggagcacggcgaggatcccaaacgccatcgccagtatcgccgacgggaagcggcggaccaggccggtcagctggaactcgtggatgacggggatgccgacgagcaggcagatcacgagcgagatcagcgcgaggatggagaagaacggcagcggcttgtagtccttgaagagcgtcgcgatcatgcccagcaccttggcgccgtcggagaaggtggagagctttgactccgacccctcggggcggtcgcgatacacgatggggatctggacgatgcgccagcgcttgtccaccgcgtggatggagagctcggtctcgatctcgaagcccggggagaggaccgggagggtcttgacgaaggcacgcgacattgcgcggtagccggtcatgacgtcggtgtactcaaagccgtacagcaccttgatgagccagcggaccaggttgttgccaaagccgtggaaggcgcggtcgttctcctccccgtaggtgccgttggagaggcggtcgcccacaacgtggtcggcggagccgttgaggatgggctccacgagcttgggcgcggcctcgggctcgtaggtgtcgtcgccgtcgaccatgaggtagcagtcggcgtcgatgtcgcggaacatctgcctcacgacgttgcccttgccctggcgcggctccagcaccactcgggcgccgtgggcgcgcgcgatgtcgcccgtgccgtccttggagttgttgtcgtacacccacaccgtcgcaccagggaggacgcgcctgaagtcgtccacgaccttggcgatggtgaccgcctcgttatagcaggggacaagcacggcgacgtttgagtagtccctcgatgcgctctggtccatgtctctccaagtgacgaaatgcaggttgacaagcctagaacagtatatctgcactaccgattgggcaagccatcgccatcagataactgcaggcaagcaaaaagccccgcccctacgagaggagcggggccagcagttttgcttagtcccaaatgggtccgcgcaagcgcttagttagatcttacgaacgttggaagcctggagcttgccattctggccggtagtgatgtcgaactcgacagcctggccctcgtccagagtcttgaagccgtccatctggatctcgctgtagtggacgaacaggtcgtcaccatcctcgcgagagatgaagccatagcccttgtcggggttgaaccacttaacagtaccctgtgccatgaacgtgcctttctttcttgcccatcgggcgaaacactgcgcttgcgcgcgatacgttgcgacttggtgctcccaagccacgagttctatcttaccccatcggcatggccttctgcccaacaatccgttgaaggggcatttggggccaatggcggagtcgtcggagccgccgcctagaagatggcggcgaggatgaccaggccgttctcgaccatcccgaccacaaccagaaccatgcccacgatggcgagcgacaccccggactccatgtcataggcacacgtcgcagcatgcccctcgccttcccgggtggtcttccccccatcccccctcacgggacgagcgccctcgccggaaagggcgcgggagaccaggagcaggatggggtacaggaccatggtcagcacggggaggaagtagcgtgtctggacaccgcggatcgtcccctcgcccacatcggtgtactgcaggtagagggccgtgttggtcatcccgaagtagaggatgaggaggacgagagaggcgatggcgagccaggtgacctccctgcggtgggaggaggcgatgccgcggcatgcgatggcctccgccgagagcgcgaggaagaggccaatcacgcagaagaacttgtcgccgctacccgcgcgcgcactgaggtggatgaggtcgccgaagtcaaacgaggcaatgtccacgaagctcttcacgttgagccagaggaagttgagcggatgcgcgaggatccatgccatctgcgccctggggtcgaccccctccttgtacatgacccccgtgttgatgcccgagaccgcccgcatccagagcacgaagagagccaggcacacaagggcgctgacaaggacgagcagcccgtctcgcttgggtcgcgcacccctgcccgggacgaggaggagcaggaggagcaggaggagtatcgacgtcaccttgaggaggccgaggaggatggtgctgacgcagagaagcgcgagggtggacctcctccggtcgtccgcgaagatggtccagagcagcgccgcgaggaaggccgtgcagcagaggatcgtcacggtgtcggcggtaacggtggacgaggcaaccacgttcgcagggaccaggccaaagtagaagagcgcccacttccccatgggagccttcctgatgagcaggaacatcacgagggcgaagaacgcgatcccgccaaaccgcatgccgaggaccacgctgcggacgctcccgagggcacggccgacgaggaagcccagcagctggggaaggtagactacggggttgttcacggaggagttggagaagaggaaggggattctctcaccctcttcgtatggcgcgctgccgcccaactgggaaagctcctcgggcgtgtaggggtcgctggtccccaggaacttcgtcgtgttgccgaagacgatgtccagcacgtgctgcgactccagcccgccgtacgaatcgtagtccctgcggtgcgggttagcgaacgtctgtcccaggtactcctcgggaaggcgctgcgggaggatgcctcccgctgcaatctgctccaccctcccgatgtggctcggctcgtcgaaggcggcgccaacgggggtgacaagggcgcagaatatcgagccgacgaggaagagcaccaggaaggcccactcgggactctcggcaaccctcagcaccatgctggcacgcctcctcatgtgaccaccctccgactccgccaatcggttcacccccaagctacgaagggacccacgggctcgcacccgtgggtcccaccaaccttaagacaaattgtaagtgatgcctagctcgcaagcgagtcaaagtttgcccgatagctcgcgagcgcctcctgccagggcctcatgcggttgcccacacccgactccaggtgcgcgttcttgagcgcgctgaagtgcggacggtcggcggaggcggggttcatctccttgtactcgtcgctggtgcagcggacgaccttggttccggtgccaaactcgcggaagatcgcctcggcgaagtcggcccaggagcagatgccctcgttggtgcagtggtagatgccgtagtcctccgtggcggcgaccgtaaggatctcgtacgcgaggtcgttggcgctggtggggttgcccacctggtcgtccacgaccgtcacggactcgtggctctgcgccaggcgcagcatggtcttgacgaagttcttgcccacgtagccatagagccacgcggtgcgcatcacaaacgtgcgcgggttgctcgccagcgcgaggccctcgccggcaagcttggtgcggccgtaggcgctgatgggcgcggggacgtcggactcgagcctctcgccctccacgttgcccgggaacacgtagtcggtggagacgtgcacgagctttgccccctggcgggcacaggagcgcgcgaggttcatgggaccgagcgcgttggcgctgaacgcgccggtccagtttgcctcgcagccgtccacgttggtgaacgccgcgcagttgatggcgaggtcgtagggaccgtgctcgtcaaaccacgcgtcgaccgcggcggcgtccgagatgtcgagcgagtcgatgtcgatgtagtcgacctgcgcgtcgcgatacgcctcggggatggggccgatctcggcggtcccgccctcgatgagcctcctcagctcgttgccgagctgcccgcgcgaaccagtgacaagaatcctcatgagacggtctccccttctcccgcttgccgtgcgttccgtgatccgagccgatgctacaggccggcagacttgcgccactcctcgaaggaggggtgcttggtgtccttgtcggagaggttgagctcaacgccctcgacgagcggccactccaccccgatgctggggtcgttccacatgaggccgccctcgtcgttggggtggtacacgtcgtcgcacttgtagcagaacaccgcggtggagctcagcacgtagaagccatgggcaaagccttgcgggatgaagaactggcggtggttctcggcggagagggtcacaccctcccacttgccgaaggtggcgctgccgggacgcaggtcgacgcagacgtcgaagacctcgccctccaccacgcggacgagcttggactgcgggtgctcgatctggaagtggaggccgcgcagcacgccctgggtgctcgcgctctggttgtcctgcacgaagtccacgtcgatgccgccggccacgaagtcgggacgcttgtaggtctccatgaagtacccacgggcgtctccgtagctcttgacgtccacgatggtcaccccctcgatggaggtgggggtgaacgtgaagttgccggatgtgatcggctgggacatgcgtcctccaaacgtttgatgtcgtcggacccaggtacgggccaagggtcattctattccataccacacgggggccatgacaccccaagaactgaacacagtgcccagggcacgccaagtggctacgcgcgggaccaggacccaccgccccagtcgaggctcccgtacaggttccaggggtcgaaggaggggttctgggtcgggtcgccgtcctccagctctccgtgcatgcccatgaagaacgcccggtcgtgctccgcacgggccccctcgtcccacatcatctggcggggcgcattgagctcggctgtggcatagggatagtagacgttgacgagccccaggtcgcgagcgcgtgcgcagcagtcggcgagcgcgtagcgcatggtgaggaagacgtcgcccatccccagctcctcaagcgcggaggagcggaccatgcagcactccgcgtcgagggcgacgcagtcgtagggccgctcggcacgtcccacgtacccgccgtcccccttggggagaaggcggaacctgtggccgagggtgccgtcggggtggaccttgatgcccgcgtagtcgatgaggccgtccgacctgttcacgcgagggctcgccgcaaagacctcctcgcgctggaacaggcgcacgagggacttgaggtcgtcgatggcgaggtccacctggctggagacaaacagcacgaggtcgccgctcctctcccccagcagacgctggacgtagccgggcccctcgacgccacggtcgacgacccacaccgaggcgccggtgttgcgggcgtacgcgtggagggcgtccttggtcgcctgggacaccccgttcttgcccaccaccgcgagggagggccagggcgacgggtcgtccaggctcactcgataggtgaagaagtgctcgccacgcgagacggacccgcgcagaccgcgcctggcaaggtgggcgcggatggcctcggcgcccgcgtcctgcgcatagggcttgctcagcgggtcctttgcggaggagccccccgtgatgcgccagtggtacaggacgtagggcacgtgcacgacgcgcgcgcccgcgtcgatcgccgagagggccaggtcgtagtcctgtgcaccctccatcctggcctcggagcggtcggtggcgtccaggaagtcgcggcgcacgcacagccagtggaccatgtagttgtcgtccagcaggaggtcggggttgtagtcgggcttgagcagggggagctgtggcgttccgtcctcgtcgatgttgtcctcgtcgcagtagagcaggcccgcctcgcccgcggagtcggcgatggcgcgcacgtactgggcgagcgcgtccgcctcgagcgtgtcgtcgtgatcgaggaagcagacgtagtcgcccgtcgcctcggagatgccgcggttggtgttgcccacgatgccgtcgttgtcctgctccacgacgcggacgcgcgtgtcgtccaccttgcccagcgcctcccggaccccctcgtcgtccgggctggcgttgaccaccacgagctcccagttctggtacgtctggtcgaggacgctctgcagcgcctcccccaacagcgccgggggcgtcttgtacgcggggaggacgatgctcatgagggggccgtcctgagggacctcgcccttggcgcgcagggagcgctgccgcttgagccagtccggatagctggggtcgaccgaggcgttggcgatgaggtccccataggcggagatgccacgcttgagctcctcgccccccacgaaggcgaacctcccgcccgcgtggaagaggaggcgcccctgggtcaggggggtcgttgccacgtactcccaggcctgccacgtgacggggccgcccgcctcgcccaccgtgacggagtgggtccccatgagctccatggggacgtgcgcgacgccgcgcacgcggcgggactcgccggcgatggcctcgcaccccggcttggcggggcgcttcccccgcgcgcacgagagcacgagccacgagtacgacttgggcccctcctcgaaggcgccctcgccgctcctgaggcaggtgaccaccctgagcgcgtggcccgccctcagctcgtcgtcggtgagggggttctcggcaaggtagccggcgagggaaagctgcttcatcgggttctccaagcgtcacgtgggctgttcacacgcacatcatagcgcctgggcgggacgcggcggaacacgccccgcccaggctcatccgcgagcgcgcggcggctagattccgaggtaggactcccagaactcgcgggaggtcatgcgcggggcggcggcggagtacgcctcgcgcagctgagtctcgttcgccttgaggcgcttgaggtcctcctgccagcggccccacacggccttgaagcggtccctgtcgaggtgccgtatgacgccgcgctggttctcgaggtccacggccacgatggtgtccttgcgccggatgaggtcggcggggtacagccagccggcgacgtcgatgatcgcggcggtccccttctgcacgtaccccaggtcgacccgctggccgttgaagctgaggtagtcctccaggcgctgcgggaacgacctcctctcgatcgcgtcggcccgcttcatgccgtcgacctcgtagatcgcgctcaggtcgatgccctgctccttgcactgcctgcgcagctcggagaaggggacgagcttctccgcccgcctgttcgcggccatgaaggcgcgctcggcgtttccgggctgctccaggaacgcgggccccttgaggaagtcctcgaacccgtccaggacgagctcggcgttggtgtagttgaacttcttgagctccagctggaccaggtggaacatgtggtcgacgaagtcggccatgggcgccacgccggtggcgtactgcgccacgagcgcgttcctggtgacctggtagcgctcgaccgcagcgctgtagcgacgcacgaacgaggggtgccacaggcagatcccgttcatggtcatgaagcgcgccttgcagcggagggcgtactcgatgtcgtcgtaccgcacgaacaggggcaggggcaggccgtgctcctcgatcgccgtgacggggatgacgcagtaccaccagccgccgtactgctgggactggtccccatggccggggaggctcggtcttgcctggtccatctcgttggtggcgacggagtgcacctgccccatgtgggcggacggcttgagggggacgcagtcgccgttgtaggtgacgtagcctatgtcctcccacctcacgtcgggctcgaagaggtccatcatcgcaccctccacgaaccggtcggcgtgctcgtcgtccacgatctgcagcagcgcgtaggtgcggatgatgctctcgggagagacgagcacgtcgtcgtccatcaggagcacgtgggtcgccctcggctcctggcgcagcgcctcgatcatcccgcgggcgtagccgcccgagccgcccacgttgtcgttggggtggatgcgcacccggtcggtctggagcgcctcgacatcgagcgtcctcccgttgtcgaccacgtgctgggtgaagtgtgccgcgaccggctcgtcggagcccaggacgtacctcttcaccaggtcgacgttgcgcaggatgtagctctccttcctgaaggtcgtggtgcagagggcaagctcaacgtcgcggaccctgtcctcgtccacctcggcgtagtagtaggagtcacggacgaggacgcccccgtcgccctcaatggacacggcgaacgcctcgacggtgtcgtcggggtcgttggggaggtcgagctcgatggcatgccactcgtccgacgccgggacctcgagcgcgctcccctcgaccggctccgcctcccagctgaagccgttggcgcgcgtgagcgacagggtgaacgcaccaccgcgcacctccaggtggaggtggaagttgcgggcgatggtgtactccctccaccggctcaccgagagcgcgttgaagaacgtggtgaagtcgtgggtgccgtgcgggcccagaagccaggcgtcaccctcggcgcgggtgaccgcggaggtggacctgtggagcagcgtgggctgctggaggaactgcgccgcgtcgtccaggagtatgttggcgagcttgtgccttatcatgtctctcccctcgttatctcggcatacaccctaacaggcgtccgatgggcttcctcccctgcgggggcgttttcaagaaataacccccgtaggaatgcgggcgacgcggatggatatctggcggtcgagggcggaagagcgggctgcggcggacacgacaccctacgatgagggggttagcgcatacgtgacgagggggacacatgctccagaggctcaagggaaccgcactgggcaggcaggcaagaagcgtggtgctcagggcgagaaggcacgcctacccaaggcccgaggtcgcctcggtccaggcggtgagcctggaggcggagcacctgcacgtgctggtgcgcttccccggcatcggtgacctggatcccgcgggcctcgcccccttcgccagcctggagtacgcggaccgctcgcttcgcgaggaggtcccgtccgaggtgatgaggatgcgcctggaccaggcggacgacggcacgcgctcgctgaccgtgctcctctcgctcccctcccccacgctcgggattcccagcgccctcgtcgtgggagacaggaccggtcaccttcccggcacgtccgttccgctgggcgagccggagctcacccgcatggcttgcgagagcctgagggactacacgccggcggaggcggacgcggagtacggcgcctggttccgctctcaccgggccaccgaccggcagctggatgcccagcggagggaggcggcccgctgggacgacggcccgctcttctcggtcgtggtgccgctgtacctcacgcccgtcccctacctggtcgagatggccgactcggtccttggccagacctacccgcacctggagctcgtgatggtcaactcgacgccccaggacgtcgacctgtcccgcgaggttgcgagaatagcggcgtcggacgcgcgcgtgacggtcgtgaccctcgatcacaacctgggcatctccaaaaacaccgaggccggggtcagggcggcaaagggcgactggatcgcgttcttcgaccacgacgacgtgctggagcccaacatcctctttgagtacgccatgcgcgtgagggaggacccctccaccgacatgatctactgcgacgaggacctcctcgtggacggcacgtaccgccgccccgcgttcaagtccgactggtcgctcgttcaggaggagaccaacaactacgtctgccacatgctgaccatgcggcgcgagctggtggatggcttctacagccgctacgacggggcgcaggaccatcgcctcaccctcgtcgcgggcagcagggcgcgccatgtgggccacgtgcccaaggtgctctaccactggcgcgcgcaccccggctccactgcgaactcggcggttgccaaggcggagtcgttcgaggcgggtcgcctggcgatcgaggaccacctgggcgacctcgggcttcccgcaaaggtcgagagcatccccaccatgccgcactgctaccgcttcacgctcgacttccccgagccgccgctcgtctccgccgtcgttatgggcatggaccagcccgccgccgaggccagggcgcagggcctgcgcgacatcctcacctggcccaacctggagcttatcccacaggtcggcaccctcggggaggactatgccgactgcgtcaacgagggcgtcgcacggacgacgggcgactacgtcctcgtggtggcgagtgacgtggtggttcagagccccgacctggtggagcagctcctctcccttgccgtgcggcgggggcatgccatcgctgggaccaaggtcctgtgcccggacggcacgatccagtgcgcggggatgaccctccagcgcgggggcgcggtccccatcgggcgcttcctggagtcgttctacggcacgggcaagggctacctggtgctcccacacgacctcagcgcggtctcgggagagtgcgtgctgttcaggcgagaggtcttccaggccgttggaggcgccgtctccgggctggacgagaccaactgggcggtcgccctctgcatccaggcgggcaggctcgggcttgggacctgcatcgcccccatggcccacgtggcgcggtgcctgcccccggctgcggccccgtttgacgacgaggagacgaaggcatggggacgtcagcaggagcgtctgcttgggatgttccccgcggagttcagcacccgcgacccgtactacagtgcctcgtggtccccggacggcctgttccgcctgcgcggggacgaggactgagcgggcctatctgggggcacaccggatgcccacgcgcaaatgcaagatgtgaggacatccgttagtcaaagaagaggagagggccacatctccgcagttggactgccctcttagggagatgccccctccgtagtcctcggaacggcacgggctcccgccgtcacggaggttggcacgtcccgagatgccggccaacatccaaagccccacctggccagaaaccccatcccgtgtgtacacacgaagtggggtttctggcaaagtcaggattccgattgcccttcaactgggggaacgccaccggcggggcggccacgcgtcagaagcctcatcccgcgtatacacatggggcggagtttccgacgggctgccccacctccagcgcccggatgccagaaagctcgccccacgtgtacacgcgggatgcactttccatcggcgcgggagttccctcgcctgccaacggggcgaacgcgccggcgcgcgaggcccatgccggaaaccacgcggcgggcgtgcgcatggggcggggcttccggcaggcaccccggggccccgcccgcatcttgacccccgtgccgcgagccgcgccacccgcacgggggaatcggtggccttggaacggagctggttccaccgcccggcccgggcggcccctcctcgcgtggtcggttgccctcgtccccttcccgagcacttgtcagcccggggatggcgcgaggcgccggccggtcccttctttgacaggccagctggcaacgaactcccggcatgggcgctcacgtcaggcccccgccgccatgggtcaggaggctgacgtttcatacgagttcccacctggggaaacgccagatgagggtcacccgcgtggaccccctcccatggggaacgctcacatcgggactttgctgccacctgggcccgagggtggaggcaactggcgacaaatcaatcgcataggcacttttcgcggttcgcatcgtcagccgaatggcgttcgcccggttgccggttcatcagacatccaatcatagcaggaatttcccgcatgagtgcacgcgcagggccttcgccgccaagcggggcataccgcacgactctaccgaccctgacgcttggagaacagccaggggtagccatctcagggcccccgaccgcctggcaaatcgaccccttctttgccattccccccagcttcgctctcacgcaccggcacgtcgcggctaccatccccgagggccctcgggcgcagtcccatgccaagcaaagggcggggcggacccagtggattcgccccgcccccgcggtcgtcgctcttctcgccctgccagctatcggttggcgtacatcttctgatagtagtcctggtaggcgccggaggtcacgtgctcgacccactcggggttgtcgaggtaccagcggatggtcttgacgatgcccttctcgtacggggtctcggggtaccagcccagctcggccttgatcttgtcgggggccatgccgtagcggcggtcgtgtcccttgcggtcggtgacgtgcgagatgagcccctcgttgacctcggggtcgccggtgaccttggagacctcggcgatgatggtcttgacgatgtagatgttggcgcgctcgttgtgcccgcccacgttgtagacctcgcccaggcggccgtccgtggcaaccatgtcgatggccttgcagtggtcgtccacgtacagccagtcacgcacgttgagcccgtcaccgtacacgggaagcttcttgtgctgcagcgcgttgtggatcatgagcgggatgagcttctcggggaactggtacgggccgtagttgttggagcagcgggtgatgaccgcagggaacccgtaggtgtcgtggtaggccttcacgaagaggtccgcggaggtcttcgaggcgctgtaggggctgtgcgggttcaggggcgtggtctcgcggaagtagtcggtgtgctcggggtccgcggggctcccgtcggggttgaccttgtcgggaatcgcgagcgagccgtacacctcatcggtgccgacctgcaggtaccggtggtcgccaaagccgcccttgccgtcgtcccaggcggcgcggcagcagttgagcatgttgaccgtgcccatcacgttggtatccgcgaagatgccggggttggcgatggagcggtccacgtggctctcggccgcgaagttgatcacgtagtccggcttgtgctcggcgatgacctttgagatcgcctccttgtcgcggatgtccgcgtgcacgaaggtgtagcgcgggtcgtcctggacggaggtgaggttctcgaggttgccggcgtaggtcagggcgtcgacgttcacgatcctcacgtcgtcgtgcttgcgcagcatgtagagcacgaagttggagccaatgaacccggctccgccggtgacgaggtaggtcttcatgtgatgcatcactccaagggatgggtctgggattgcttcgcgggtaccagtctatgggcgagaggggcgcgcctctcccgccactgggcaattcgatggaatcaccgttgggcgagaggggcgaggtgcctagtcctcgtacttcccgctggggacgatgccgccctcggcgaccatgcgcaggtgcctgccgtagtcgctctttccgtagcgctcggcgcaggcgagcaggcgctcgcgggagacccagccgttctcgtaggcgatctcctcggggacggacacgggcaggtcctgggcccgctccacggtgcgcacgaactcgcccgcctcgtagagcgactccatggtcccggtgtcgagccaggcgtagccgcgccccagcgtcaccacgtcgagcgtgcggtcctcaaggtacatgcggttgaggtcggtgatctcgtactccccgcgggcggagggctcgaccctggcggccagctcgctcacgcgcgagtcgtagaagtagaggcccgtgacggcgtagttgctcttggggtgggcgggcttctcctcgatggagacggcgttgtagtcggcgtcgaactccacgacgccgaagcgctcggggtcgtccacgcggtagccgaagacggtggcgcggcccgcctccgcggaggcggcggcgcgcctcaggtgcctgccgaggccgttgccgtagaagatgttgtcgcccagcaccagcgcgcaggggccgccgcccacgaactcgcgcccgatcacgaaggcctgcgcgaggccgtttggctcgggctgctcggcgtaggagagcgacaccccgtagtcggagccgtcgcccagcagcctcctgaagttggggaggtcgtgcggggtgctgatgatgaggatgtccttgatgcccgccagcatgagcgtggagagcgggtagtagaccatgggcttgtcgtagacggggagcagctgcttcgacgtcacggtggtgagcgggtacaggcgggtcccgctgccgccagcaaggatgattcccttcatgtcttgacctcccgaggtcagatggctttgcttcggttagagattgtatcagcacgtcctatgcgggggcgaggtcgtggcgcctctccgccgcggacggacgcgcaccctacgagagcgcgcagtaccagttgtccctcctgaagttggggttgtagtacgggtcgggcttggagaggacctggccccagcgccccgcaaacgccatgagctcgcgcgagagcttgtacgagatgcgccgggagtccccgccgtggcgagagacggactcgtagtgcctgagcacggcgtagttctgctgcagcacgtgatagccggcggcctggatcttgaggcagaggtcgatgtcgttgtagttgaccttgaactctcgctcatccatcccgccgacctcgtcgtagaccgcgcgcttggtcatgaggcaggcaccggtgaccgcgctcgcccggtgcgggagcacgttccactcgtagtacccgggggcattgcccggcaggttcacgctggcggccacgggtcccgagaagccccccacgagcacgcccgcgtgctggatcgagccatcgggatacaggagctttgcccccacggcgcccatgtcgctcgacaggagcggccccatcatctgctcgacccagtcgggcgagatgacctcggtgtcgttgttgagcatcaccaggtactggccgcgggcggcggcgaagccaaagttgatcaggcgcgagaagttgaactcgccctcggtgtcgcaggtcacgaccctgatgcgcgagtccctctcgagcctgtgatagtactcgaatatctcgtcgctcctggagttgttctcgaccaccacgatctcgtagttgggccacgtggtgcgccggacgatggagtcgatgcagcactccaggacgtccctcatctcgtagttgggaatcacgatggagacgagcgggtgcgtctggaaccggtagcgcacgtcgcagcgggtggggaagcggccgcccatgaccgcctcggcgtcgatgccgcagcggtcgaggtgcccctgaaccgcccggcgctccgcctcgagggcgtacgacttctgcgccacgccctggccgcccgcggtggagttggcgtgcatgcgccagtggtagaggatcctgcgcacgtgatagacgttgcgggccctctcccccaccaagaaggtcatgttgtggtcctgcgacccgtcgaattcgctgcccggaagctccgggagctcctccaccacgctgcggcgcacgcagagcagatgcgtgacgtagttctccgcgcacaggcgctcggggtcccagtccggcttgaagaacggccccacgcggtgcccgtccagcaggtggtcctcgtcgcagtagatcaggtcggtgtcgggacggtcgctcaccgccttggcgtaccagtacagcaggtcgggctcgagcgtgtcgtcgtggtcgaagaagcacacgaagtcgccggtggacgcctcgattccccggttggtgttctcggtgatgccgtggttgccgtcgaggttcaccacggtgatgcggctgtcccgcgcagcgtaggtggccacctcgtcggcgagggcgcgatcctcggggctcgcgttcaccaggaccagctggaagtgggggtaggcctgcgagaggaccgagtcggccatctcgtcgaagaagtcgagcggggtcttgaagagggggaccacgagcgagaaggtcggacgctcgggcaggagctcggacgcgtgggccatgagggcgagctcctccgcgctggccgagtgctcgcgcacccactgctcgtagcgcgggtcctggtcggcgggcaggacgctctggcgccagctcccgcggagccagtcggcgtagaagccctcaagcgtcacgaaggagtcctcctgcccctcgccctctgcggagacccacagcacgataccgcgcgcctgcttggggaggatgacgccaaaggtgtacatgcgcgtgaacagctgcgggttgccctcgctggggctgcaggagtcgcccatcgcaaagtggtcgtcagccagcagctcgccgtcttgcgagaggacgcggaccttgatgggcaggtgggccgcctcctcgcccgccacgttggagaccatcgtggcgcgtaggtcctcgccctcctcgagggcgatgaggttgtgcaccaggagcttggggcccgcgttgccgccgcggctgtcgaggttgcggatcgactccgcctggccgtcgcgcagcgccgtgtgcatctgcgacatcaggcgcgccgcctgcgggcggatgtggatgcgcctgcggcacagctccgtcccgtccgcgcccagcagcctgaccagggcgacctggaccaggttgatcaccgcgacggagaggacccacctgctcccgcccaggtccatgaccgtggcggggacgggctgcccacccgtcgccatctgcgcggagacgacgaggcgggagccctccggggcgccgtccaccgtgatgcgcaggaagaccttgccccggcccctcgtgaccttgtcgtacgaaatcctcaggttgtctgccatggggagaagctcctccgtctagaacttgatgtcgtagtagccgtccagcgagaagagcggggagtagagcccgctcggggcgtagttggtctggggccagagaccgcggaggcgcgtggacgccatgcgctcgcgcaggtcggtgcccgcctccggggcaccaagctccgcggcggtcatgggccgctcgaccgcgacgcgcgggacctcgacggtggtgaggcccctctcacccaccttgcagctgagtgcgacgccccaacgccagtccgtgagctcgccgtcgagcccgccgacctccaggaagaggtcgcggcggagcatgagcagggtccccgtcacgccgcacgcctcgtgggggacggcctcgtagcagcggatctgcgggttgtcactcgtgaggcccaggtccaggcgaagcggggcggcgttggtgaaggcgaccgctccccccgccttggtcccgtcggggaggttgacgcgcgcgccggcgagccccaccccggggtgcaccaggaccgagagcatgaggcgcgcccagtcgggctcggtcacccggcacggggactggacgagcgccagccactcgcccgcggccctctcagccgccgcattggcctccgcgggaccgccctccgcggcgatgacctcgagcccgtcccagccgccgagcccacggatgccctcggccgccccagccgcgcccgcgccccagacgacgacggagacggacgggtgctcgccctcgtcgagcaggggctcgtagtagtgcggggcgcccggcacctcgtgcgcgcgaacgggcagaccgagccgccggtagtgctcgtcgatggcgcgacggcccgcgtcgagcgcctcgggcttcgcgagcgcctggccggcggtggagccggcgttgacgcgccagtggtagagcacccgacgggcgtggtacacgttgcgggcgcgctctcctgcgagcagggtcatgcggtggtcctgcgccccgtcgaactcgctcgtgggacgcgggagctcggcgagcaggctcctgcggatggtgagcatgtggcacacgtagttgttggtctcgaggtagacggggctccagtcgggcttggcgaaggggaaggcgtagtgcccgtcctccagcttgtcctcgtcgcagtacagcaggtccgtctgcgggtaccggttgatcccctccacgtagcggtacaggaggtcgggctccagcacgtcgtcgtggtcgaagaagcacacgaagtcgcctgtcgcagcgtcgatgccgtagttggtgttctccgtgatgccgtagttgcgctcgagctccaccacgcgcaccctgcggtcgcggttggccagcgcccacacctcgtccgccagctcgcggtcctcgggcgtggagttgaccagcacgagctcgagccttccgtagctctggcgcagggcggactccgccatctcgcggaagaagtcgacgggcgtgtgatacaggggtacgacgatggagaaggtcggacgcagcccaaacgcgtcctgcgaggcgcgctgggcggcgaggtcctgggccgacgccttggtgaactggaacatctcctcgtagcggtcgctcagctccgccggcgtggcgtgcgagccccagacgccctcgagccctcgcaggtcctcctcggagaaggtcttgacgccctcgcggggggtcttaccgccgatccggaccaagacgtccgcgccgggcgcgccaaacgggatgcggaacgacaggcccacgtagcgacgacgggcgccggggatgtcctcgtcgtccactgtcacgtcgcccaggagggtgccccccaccgtcgtgccgtcgtcgagggtcgccgtcgcacgaacctccccgtccgtctcctcgccgtcgcgaagccacgtccagcacaccacgcgaaggagctctcccggcccgcgcgacatcacgctgacgctctcctgcgagaagtgcacgggccacgccgcggtggcgccggtcaggggtttcgcatcgttggttggcattgagacctcgctgtcctctgggttcgttcgcaggctcgattgtagcgcggcaccccagcggcccccgcccccatgcgcacgcatcagggagaacccacgtatgggggagtcgggcgcaacaagaaggggccgccgaagcgacccccgtatccgttcgcaagttggtcgggcacccctacagcaggcgcagcacccagtcccacgggtagttggagtaggagctcacgctgatctccctgccggtctggtcgccggccttccccgtgacgccgcccgtctcgctcaggtgcgccgcgaccatgaggccgttgcccaggtagatggccacgtggttccaggtgttgaggaggatgtcaccacggaccagctcggagtacctggtggtgctgatggcatcgcccaccgccagggcggtgaacttgccgtacttcacgaggttctcgcgcatgttgccggtgtaggtggcggacccggtgttgatgcccgcctgcttgagcgccgagatgaccagcgacgagcagtcgtagtccggcccccagcggttggtctggctgtagccgtgggagtcgtcctccgcgacgtcgacggcccaggacacgtacttctcgatcctcgccctggaggggatgaacacgctcgtgtcgatggacttggcggagagggtcgaggcgtaccaggccatcccctcgtagcgccagccctgggcgacgaggctgttgctctccgccctgctggtggtgaagttgtgcgcgcccgcgcccttggcgttggggttgtactgcctgaggagggcggagcccacgttgctcccgctcgcaccgtaccagcctatgccctcgtagcgccagccaagcgagacgagcatgttcttctcggcggcgttggtggtgtagtggtggtcgcccgcgttggggttgtacaggcggtacacggcgacgccgctcgtgggggccacccagccgatgccctcgtagctccacccggcgttggcgatcttcacgccctcggccacgttggaggtgtagaagtgctcaccggtgttggggttgtagaagcggtacatgttcacgccggtcgtgctggcggcacgcggggcagccgtggtcgcggcggggcgggcggccggctcggtggcggtgtcctgcgcgggtgcgtccacggtcgcctggccgtcctgccgcgagccctcaccctcggtgggggctgcgtccgtctgcgcatcctcggggcccttcgcgtcggcagcgcccgcagcgtcggtctcctcgcccgaggcaccggtggtggtttcgccggtctcgcccgacgggacggactcggagccagcgggatcggtcgcggagtccgagccctggccactctcccccgtcgttgcgtcggagccagctgcgttcgcggacgagccatcggtgacagcctgggtcacagcctcatccgagccatccgtctgcgagtccgtggttactgctgccgcctgggaggaggcgtccgtcgccgtggcgacgccctgcagccgggtctcctgctgggcctgagcgcttgtgtcgggagccgtcgcggactcctccgccagtgcgagcgagggcgccccgagcgtgagtgccgccaggatcgctccggcggcgatggcgccgccatgccttctcgcctgccctgaagtcatcgaatcaccccaatgtgagagatacgggcacttgggaaaagtcaagtgtcaatggtagcagcaggaaggcccctgccgtcaggtccctgcgccaatcgacacacgcaaggcacgccaacgttaccttcggtcgcgcaatcgcaccctaggacaaccgcgggcagagagcgctgccctgacgctagctcttcctcgccagggaatcccagtaggcagtggtaccgtagaacgcatcgacgtcgaccccgttggagtagccgccgaccttggtggagtccgagtactgccagatcgtggggctcgaccacgccccgtagttggtggagatgggcgtggggtttgagacgtaccccgtcccgttcatgtacttgtgggggtacgaggcgacccacagcttgtagccggaagccgcgacggagctccagtcgtaggtgctcgtgaccccctggctcatgtagatcagagcacgcaccccggtgaggcgatacacctcgtccaggaactgcttggcgtaactgggcccctttcggagcgcctcggaacccggggtgttctcccagtccagcaccaggaccgcctggcctatgtacgacttgatggtgttcacgaagtactgcgcctgctggaccatcgacccatcgccgctgctcacgtcgatgaagtggtacacgccgagcttcttgcccgatgagagcgtcgcctcagcctgcgtggagaaggaggggtttttgtagtgagtaccctgggtcgccttcacgatcacgaagtcggcggtgaccttcgagatgtccatgtcaccctggtagctcgctatgtcgatgccgttgaggatcacctggaagagggacttgtcgaacgcgagcgaggcgtgcgtcgaggcataccaggcgatgccctcgtagcgccagccggccttcacgaggttggcgttctcggcggagctcgtcgtgaagttgtgggcgccggactttgcgttggggttgtactcccggtagacggagaggcccgccgacttggtcgcggagtaccagccaacaccctcgtagcgccagcccagggcaacgagcatgtccctctcggcggcgttggtggtgtagtggtggtcaccggcattggggttgtacagccggtacacggcggttccagacttgagcgcgacccagcccaccccctcgtactgccagcctgcggtcacgagcgcctggccctcgtgggtgttggcggtgtagaagtgctcccccgtgttggggttgtagaaccggtacatgttctgcaggttggaggtgtcgtccgccgccacgcgggcagcaggcgccgtcgtggcggtggagccgcccgcggcatcggaggagtcggtggccgtctcgtcggatgcggtccccgcgtctgcggcaggggtgtccgatgccgtgccgtccgtcaccgtgagagaggagcttgcaccggcattggacgcatccccgtcggcagtgctggtgccgacgtcggaggcgccggtctcgccatccacgccgcccgttgtcgcctcggcagcggaggtcccagaggacttcgcctcgtcagacgacccgccggcagtggaggcggcgtcattcccgttcgaggcggtggcatccgccgtgggggagatctcggactccgtcgcgcccgtcgcggacccatccacctctgccgcatcggcagcggattctgccgtctcctggtcggagggctcagtgctcgtggattgatcgtcggtcgtaccgtcggaatccgcggccgcaccttcagaccccacggcctggccagatggggaggcctgtgccacggactcggtcgccacgacctgagtctcctggccttggccggcgagtgccttggaggccgcctcctcggcgttcgccgtcacgggcgcgtaggcaaaggccgccgcgagcaccgcccccgcggcgatggagcccatgcgcgaccaagggaagttctcgggagccttcatcaataaccaccccgaaggaaagagatcgtttcttcccggcaagagcaggcgcaaggcccgtcctccgccggaaccatccgtcacagaatatgccacgacacgggccctccacaaaacgaggaccgcatcgtgacaacccttgacgaaagacaatcgatttggcgtcacagggtcacgtctatgatggggagaggtgccgcgtccgtggggcccgaacgctactcccgcggggccgagagctccccgtcgagggcggcaagctcctgcggaaccgtcccgggctccacgttgaacgagccctccacggcctcggcctgcgccaggcgcacctcggcgaggtcggcctcgcccatctcccggtaggcgtccgcgaggcgccgcaggacgtaggcgacgtagcccgccaggctgtcgccgatgccggagagcaccatcatcgtgacgagggagtcggggctcaggcggagcgccacctggggatccaggtccagcacgcccgcgaccgcctcctctgcctgcgccgccgcctcctggtcgcccctgaggagggcgcctcgcagggcgggggtcactgagtcaacaaactggttgatgacctcaagcaggtagtcgtgctggagcatgcgttcctcccaagagagtgtgcgggcatttccatgagacagtctagccgttgcggggcgggacagccccggctaggagctgggcggcgggatgacgccaaggtgctcgaacgcaagggccgtggcctgcctcccctggggggtgcggatgatgaggccgcgctggaggaggtagggctcgtacacgtcctcgagggtggacgggtcctcccccacggcgctcgcgatggtcgtgagcccgacgggacgcccgcggaaggtcctcgtaagggcgtcgaggatcttcttgtccatccagtccaggcccatctcgtctatctcgaagaacctgagcgcctcggccgccacctcccaggtgatgcacccgtccgcccgcacctgcgcatagtcgcgcacgcgcttgagcaggcggttggcgagcctgggggtccctcggctgcggctggcgatctcctccgcgccctgctcgtcgatgcgcacgcccaggatgccggcagaccgcaggacgatgcgggtgagctccggcacgctgtagtagtccaggcggtagctgatgccaaagcggtcgcgcagtgggccggtgaggagccccgtgcgcgtggtggcgccgatgagcgtgaagtgcgggacgtccaggcggatgctgcgcgccgccggccccttgcctatcacgatgtcgaggaagaagtcctccatcgcggggtacaggacctcctccacctggtggttgaggcggtggatctcgtccacgaagaggacgtcgccctcctccaggttggtgaggatggcggccaggtcgccagtgcgcgcgatggcgggtccgctcgtggtcttgaggcgggcgcccatctcgtttgccaccacgttggcgagggtcgtcttgcccaggccgggaggaccggagaagaggacgtggtcgagtgtctcccccctgtccttggcggcggcgatgagcacgctcaggttctgccgcacgcgctcctggccgcagtactcgctcagcgtggtgggcctgaggctgtgttccacgtccaggtcgtcctgcgtgagctcggtgctgaccgcgcgccggctgccctcgtggccccgggcgtcgtcggcgaagaggtcctcgtcctccgcctcccacatcacctaccgcccccaaggcgcctgagggcgtacgagacggcggactcgatggtggtggcgccggcttcctccagcccctccagggccagctccgcctcctgcggggtgaaccccatggagagcagggcgtccgttgcctcggactgcaccgactggccggaggggacagccgctgccacccccgccgccacctcgccgggagacgagagccccacgagcccgcgcagctccgcgtcgcgctggaacacgccctccagctccacgagcaggcgctgcgccttcttcttccccacgccggggacctggctcatgcgggtgacgtcctgcgcggtgacgacggtggccagctgcgatggcgtgaaggtggagaggaccgagagggcgagcttggggccgaccccgctgaccgcgaccagccggtcgaacaccgctcgctcctcccggctgcagaagccgtacagctccgccgcgtcgtccctgaggacgaggcgcgtgagcaccgtcacgcccgcctcccccgcggggggcagcgcggcggcggtgttcgccgagatgccgagctcgtatcccacgcccgccacgtcgagcaccacgtggcttgccgtcacctccacgatggagccggtgagctgcacgatcacttgctgttcctcctactctgccgggagcggcccatcacggggctgccgccgttggcccttgccgcggtcgccgcggcggtgacctcgcgcgccatcgcgcgctcctgctcgcgctgagcccgctcctgctccagcacctgcaccgccgccgcgtcgcgcgtgacgctcatggtgtgcgagaggtttgcgtggcagatcgccgccgcgagcgcgtccgcgcagtggtcgggccttgggtcgtggtccagcctcaggatgttcctgaccatgtagatgacctgccgcttgtccgccgagcccgtgcccaccacggcctgcttgatctgcatgggagtgtactcccccacctccatgcccgcccgcgcgcaggcgacgatcgccgcgccacgggcatgggcggtggcgatggcggagcgctggttctccccaaagaagatcttctcgatggcgagctgggagggctggaaggtctctatagccttcgacacctcgtcgaagatcctccccagccgccggtcgagcggctcgtccgacttggttgacacgcagccgtacgcacgcgcacggcacgccgtgccccgcgtctctatgatcccccagcccgtgttggcaaggccggggtcgatgcccatgatgaccatccgctcccccatgcgaggtaccgtctagaacgtctgttctatcataccagaaccgtccaccggcacgggcgaggcggcaaatcccggggcgggagcgccaccaggcccctagttctcggagaagggattctgccagggtcgacgaccctcgtcgcctgcgggggcaccgtcagcgccctcccggccggtgtccccccgatcggcgaacccccgctgctggaacgcccctccctgggagaagtcgtgcagccagccgagggtgtcgcggagcctgctcatcttgtccgcctcgctcggctcctcgtcgcttggcgcgtcgggggcggcgtcgtcgggaacgtcctccccaccggcgtcggcgggcgtggcgaacagcgacatcaggcgcgtccagtcgacgtcgccgccctcctcgacctgcctgccaagctcctccaggccctcgcccgccgccgtgggggacggccggtccgccgcgtcgtgccaggccaggccgagcggcctgcgggcgtcccacagggtgcaggtgctggcgatgaggcacgggccacatgcgaggcgccatgacccgccgtcgtcgagcgcgcggaccacggcggcgcacagcccagcgtcctcccccgtcgccccggggagctcggacagcgggtgcccccactcgacgtggtcgaggatgatggtgtcgacggcgtgggtccactcctcgtcggagcgctggtccctctccacgccgggcacggagggaacctcccagggcgcaagcgccaggcgcggcatgacggggctgatcacgttgcgggcatgggcaagccccaccacgtccgtgaggtagacgtcacccagcgggaggatcggggacgccccctgcgcgggctggcggtcgagcagggcaagggcggtcttggtgaggggcgagaggaccacgccgtcgtcctcgtcggcccacgccaacgcgtgcgcctgtgcgacgcccagggcgagtcccgggccctgctcccccgccgcaccccttaggtcgcgcgactcggcgcggaggttggacgcgagggcgaggcatgcgggcctctccccctcgtcgacgggcgagacgagcaggcgcacgttggtgggccccagcgcgtcggtcgcgagcaccgccaggacctgggacgacagcgagccgtccagcaccaccaccgcacgacggcggcccatggaggcgatgcggtcgcgcacacccatcgcgagcgcctcccacaggaaggtgggctcgtcgtagacctcgggggtcaccggcgagtcgagggggccggacaggtgcgggtccacgtccacgcaggtcagcgactcttcgaaggcgggcgcggaggccgccagctcgcccgcgggcgtcacggcgaagctcgagccggtgtagagctgggccccgtagcatcccagggagcccacgcctatgacccaggcgcccatggcctcggcatcctggacgtacctgccctcctggaggtccgcccccaggagcgagctcgggtcgtcgatggcatagccgtagccggcgacgtagatgacggcgtcgaggtcaaagtcgaagtcgacgtagtcgtccaggtcctcgtaggtgaaggcgacgcccagccggaggtcgccgagcgtgaactcggggaggtcgggcgccggggcgtcctgggcctgggggtctgccccctgcgcctgcaggacggacgaggcgtaggcggcgagcttgagcgggaccacgtgcccgccgtccatcaggaccgcctccgccacctgctccccgtcgaggtcgaacaccacggggacgatgcaggcgcacgccacctggcgggcgaggcgctcgaccgcggccatgacgtcggagacgaacccctcgcgctccccggtgaccgccaggccctcgggcccggtgagcgccgccatggggaacaccacgaggtctgccccctgcaggctggcgcgctcgctgagggagaccatcctcgccacggtgcggtcgaggtcgcccgcagccgtcgccatctgtgccatgcataccctcatgtcgcacctccgcgtccgtgcgccgacggcagcgccgccgactggcatgagcctaccccaaacgaagcgcggcgacccgtcagagccgccgcgcgaaagccgcccgcaacggggcgggcaggtgtcccgaccctagagctcggtcttccagaggccatggaggttgcagtacgcgtacaccgtggcgccctggcccttgtggcagaactttgcctgcggcttgtcgcccggcttgaggtgcttgacgatggtcttcttctcgtccgcgtaggcaatccactcgatgtagtgctcgggcgtcatggggtgctcgacggacccgacggtgaccaggagcttgccgtcctcggtctcggagaccgcggggacgtgcttctcggtcgcggcgtcggtggcgccggcgacgagcttctgcatgggctctccgcagcactgggggacgcagctgccctcgtccaggaccatgacgaggttgccgcacttgttgcaacgatagaacgtgagctcagccatgtggtttcccttcctagtgggtggcggcgcccgtgcgccgctcacctacattgtctcccgcgccgcggcgtttcattcatgtgactgctgattggtagcaaataaccgcgtgaggggatgcgggcgagggggacgcccctctcgcccgaccaccggaagccctgggcaggctaggcaagcgccacgtggccgtccttgcccaccaggtccttgacctctgccaacaggaccatgttgtgcgcgtccaccttggtggggagctccatgcgcatggtgtcccccatggcgccctccaccaggatctcgacccggtcgaagccgttgtagcgggagaagatcgagttgagctgctgcatgcggtccatgctcagcatgcggctcgacacgcagacctcgaacaccttggggcggttggtcttctcgttgagctcgatgggcatcaccgacgaggcgatgacctggttgccgcggtcgccgcgctccagcttgcccgtgaccttgatgaagacgtcgcccacgcgctcgccggtctcggggtccacctcgccctcaagcacctgcgcgcactccttgtacgtcttggggaacaccacgatcgtgacctcgccctccatgtcctccagggtgacgatggccatctggtcgccgttcttggtcacgcgcttcgagacgccccccgaggggatcatgccggcaaggcggatgggcttgccctcgggcacggtgtactgggtcatggtgccgcctgtcaccgggttggggacctcgcgcttctcctcgatctgggcgagagtgaagtcgcgcgccttgttgagggcatactcgtacgggcgcagcgggtggtccgagacgtagatgcccaggacctcgtgctcctgcgccagcttggtgtggcggtcccactcgtcggcggggttggcggggggcacctggtcctcgaagccggagcccgccacgtcaccaaacatgtcgaagagcgagctctgccccgcggcccggtcgcgctggcgcttggcggcggagtcgatgatgttggcggggtcgttcttgtccacgaactccatgagctgcttgcgggggtagccggtggagtcgaaggcgcccgccttgatcagggcctccaccacgcggcggtttgcctggctgccgtccacgcggtccacgaagtcgtggaggttcttgaacgccccgcccctctcgcgctcggccatgatctcctcggcgacgccctcgcccacgccgcggatgcccgcgaagccaaagcgcacgccgtctgcggtggcggtgaagtcgcggccgctctcgttgatgtcaggcggcaggatggggatgccctcgcggcggcagctggtgacgtagtgcacgatcttgtcggtcttgcccatgtaggacgtgaggaccgaggccatgtactccttggggaagtaggccttgagccacgccgtctgcatgaccaggatggcgtagccggcggagtgcgacttgttgaacgcgtaggaggcgaactccaggacgttgtcccagatctcctgcgcgacctccttcttgtagccgttggcgacggcgccgttcatccagtggtcgtagatcgtctcgtccgcgccgttgccctcccagtggaagatctggctcgtgagcatcttgatcttcttcttggcaacgggcttgcgcatgcggctgtcggactcgccggcggtgaatccgctcatcttgaccgagatctgcatgacctgctcctggtagaccatggtgccgtaggtctcctccaggatggggcgcaggcggtcgtcgtagtagctgatctgctcctcgccgtgcatgcgcttgatgtagctgtccaccatgccggcacccagggggccggggcggtacagggcgatgagagccacgatctgcttgtactcggtgggctgcatgttcttgatggtggcggtcatgccgtcggactccacctggaacacgcccgccgtgtggccgctgcccaaaagctcgaagatcttgggatcggagaagtcgatcttgtccacgtcgatgtcgacgcaggtggcgccctccttcaggcacttcctcacgccctcgggcatgcgttcgatgtcggaggcgttggggtagctctggcggatgttcgcgagcgccttgttgatgaccgtgagggtacgcaggcccaggaagtccatcttgagcaggcccatgtccgcgaccgagtggccctcgtactgcgtgatggtgacgttgcccttggtgtcgagcttggtgggcacgtggtcggtcacgggcgtgggcgcgatcagcgtggcgcaggcgtggacgccctcgcctcgcgtgagcccctcgatggagagggcggcgtcgatgatgcggtgcgcgtcctggtccttgttgtaggcctcctcaaagtccggcgagtactggtcgggcttcttctcgttcttgtgcagcgcgttgggcagcgtgagcttggggtcgttggagagcatcttcgagagcctctgccccacgtacacggggaagcccagcacgcgcgccgcgtcgttgatggcctgtttggccttgatcgtggagtacgtgatgaccttgcacacgtggtcctcgccgtacacgtcgcgcacgtgctggagcacgtcctgcaggtgctcgtcgtcgaagtccatgtcgatatcgggcatctcggtgcgctggggagagaggaatcgctcgaacatgaggccgttctcgagcgggtcgaacgacgtgatgttcatggcgtaggccacgatggcgccagcggccgagccacggcccgggcccacgccgatgccgttgtccttggcccactgcacgtagtcctggacgatgaggaagtagttcgcgaagcccttgccaatgatgatgccggcctcgtgctcgtagcggtcctcgacgttgatgccgttgatggtgacgttcttccagtcgtcgccgtagcgcttggccaggcccttctcgcactcctcgcgaaagcgctcctccgccgtctcgcccgggcgcaggccagggtactcgggcaggtacatgtgcgtccagtcgatctcgtagttgcacttggacgcaacctcgagggtgttgtcgcaggcctccgggatccaggagaagaggctccgcatctcctcctcgctcttcatgtagaactcggtgccccccatgcgcatgcgggtctggtcgtcgagcgtggtcgccttgccgatgcacgagaggatgtcctgcgtgggggcgtcctcgcgcctgaggtagtggaagtcgttggtcgcgatgaccttgatgtcctgctcgcgggcgatcttcaccagatactcgtccagcttgcggtcgtcccagccgttgcggaaggtgaggccgtggtcctggatctccatgtagaagtcgtcgccgaagatgcgcttgaaggtggccgcccactcccgtgcgccgtccacgtcgccgtcgaggatgcactgctggatgatgccctgcacgcaggcgctctggcagatcagaccctcgtggtactcctcgagcatggcgagcgtggtgcgcggcttgtagtacatcatctcgtggccggctgccttcgacatgcacttgatcaggttgacgtagcccgtctcgttcttggcgagcaggatcaggtggtagcggcgctgcttggtgccgcgctcgatgcagtcgtccgtgatgaagtagcactcgcagccaaagatgggcttgaccttgaggtgggggcggttgcccttgaccgagtcgaggtcgtggcccgagccctcccaggcggcgacgtcggactcccactgggcgtgcacgcagtcctggtagtccgcgccctcggcgtccgcctcgggctcctccaggtcccagcccttcttgaagcactccaggtcgtggcgccactgcttcatgcgcggggcggcgtcgttgtacttgcggcactccaggtccaggttggggatgccaaacatgtagccgtggtcggtcagggcaaccgcgggcatgccaaactcaacggcgcgcgccaccatgtcgggaatgcgcgtggccccgtcgaggatgctgaagtcggagtggttgtgcaggtgaacgaacgccatgtggtgagacctccggatggaccctcccgccggtcccgcccacgggcggggtggcgcgtcccaagggaggggcgggcgcgcgacgatgaacatggtagtcgaagccggctgccgcagcgttcccgggcggctggcgtcggcacggccacctcgggcaagacggcccgcgtcacgaaagctccgcaccggctccacggttgccggagcgggcgagacgggcgcggagccgtgcccgcaacccgtcccacccggggcggccgcgcgctagatccggggcgggttgtccccgtcgaacacgtagcgcgccaccagagggccgccgtgcccgtcgtcgacctccacgcaggcaaaccggcagtccacctcgtcaaacccggacgccatcagcacgtacgcgtagaagttcgcctgcatcaggtggcgcgccgacacctgctcgggcgagaggcccctgtcgcccgtcttgtagtccacgagcagcgcgcggggcgacccctcgtccgtcgccaggaggtcgatggccccctccacgtggtcgccgtagctcgagtcgaccgggaggaagaacggcacctccgccctcaccaggccatgggagaggacctccgccctcaggtctgacccgcaccacctccccagcgccgcgtccagccgcgcggacgcccgggaggagaggccccagtaggacttggcgcgctcgacccgccgggcgtcgggcctctccgcccccgactccaccatggtctgggcgagctcgtggaaggcggagcccaggttggtcgcgcggtcggcgtccccggtgagcggggcaccctccggctccgcctggagcgaggcgcgctcgacgggcctcgccgtcggggtcacggggggtacggcggcagaggcgtcggccgaatccatcgcacccgccatctgcgcgtgggcggacgagtagctgaagaccccctcgcgcgcggaccacgtctgcgacctgcccacggtggggtcggcctcgacccggtagagcccgaaggtctcgcccgcgccctccccgccatcggaggggacgacctccccctcgcgggcaagcgaccggaacaggtcgtccggctcggcggggagcggcccgtccaccagcgtgccggcggagtccgcgctcacgatgcgctcggggcccctgccctccaccttggtcgcgacgcagcgcaggcgcgcgggctcggagccaccgtagtccagggcgtgcacgccgggggacgggagccctcccggcccgcccgccccataatagagcgcgcccagcacgcccgtcgccagctcgggccccacggagcccttggagaccgtgacccccaatcccagcacgagcgcctcacgggcgcgcgtgagcgcgacgtagaggagacgggccttctcccccgccgcggcgtccgccgactggtccgagagccagccgagccactcggagagcgactcgggcctctcctccaccgggatgtcgcccacgggcaccgagcccttgggcttgaggcacacgcccaccccgccgcccgggaggcgggaggaggccaccgggccccggtccggcatcctcgaccagcactccgccacggcgacgacggggaactccagtcccttcgaggcatgtatcgtcatgatccgcacgctgcgcagctcgccgcccagaagggtcgccgggggcaccttcgcggtctggagccacacgtcgaactccgtggccgcgcgcgccgggcccagccccagctcggacgtgaggtcgcgcacgtagcgcaccgccgcgagcacgttggcctcctcggcgcgaccgtcctcgccccgacgctccaggcgggcgagccacccggactcgcgcaccacctgcaggcacacgtccgccacgggcatccgccgcatcgccagccgcgcgcgcatgagcacgtcgcgcgccaggcgcaggcgcgcggaggggggctcggacccaaagaggtccatggtctcgagcccgcggtcgatcgtcctcttggtgggggcgtcgagcgccctctgcctgcgggtgcccagctggacgaagtcgttggcgtccagctcgaacatgggggaggtgagcagtgggaacaggcccgactgcgtgtcgtgcgggttggcgagcgtgtgcagcagcgccgccatggcgcccgcctcgcgcgtggccgtgaacgtggagccgcccgtgaccacgcagtcgatgccgcgggcgcggagcgcgtcgatgtacagcgccgcattggtcgtggtgcccaggagcagcgccatgtcgcccggccgctccccgtggtcagcgcactcgcgcagccggtccgcgatcgcggccgccatgaccgcgccgttcgcccgggaggccccgtaggcgccctccaccagctccacgtcgattcgcgggaggtcgcgggcgcggtaggagtccctgcggccggggctggcgtccaggtgcatgaagcccctcaccacccccgcgggaccgccgcaggtggcgtccacgaacgagagcacgtccgcgtggctgcggtagttgacgtccagcctgatgcggtcccgctcgggcacgccctcgccgcgggcgcggaacacccccacgtcggcgccgcggaagccatagatggactgctgggcgtcacccaccgtcgccaggtgcctctcgccctcgcccgagagcaggcggatgagctccagctgcctggagtcggtgtcctggaactcgtccaccatcaccagccggaagcgtccggcgtagtccgcggcgaccgccgggtcgtcgcgcaccgcggcaagcgcgagggcgaccaggtcgtcgttgtccagcagcgactgggagcgcttgagctccatgaagcggtcgtccacctgccgggcgagggagacgagcccctccgcgagcggccggacccgggagagctccgcctccgcccgggcgagcgcgagcgcctcctttgcgtcggggagcagctccgctattgccttgctgctgcgggggaggctgacgcccgccaacgcctcgagcgccgcctcggggccgcgcgcaccgggcgccagcgccgcgtacccctcgagcgcgcgcgtggagggaacgatcttctccagtgccttcgccgtcacgccatgctgcgccccgagcgcgctcaccgccccctggaggcgctccatgcagccgtcgaggtcatcctgccccaccagctcgagcgagtcgaacccgcggggcgccgagtgcgccgcgtccatgagggccgagacgatccccaccacgccgttgggcgttccggcggccgtcccccccaggccgtactcgtcgagcgcggccgcgaggagcgggtctcccccctgccggacggcggagcccaccacctcctcaagcgcctggtccatgagcgccttggcctcgttgcccgatgccacgcgaaagcgcgggtcaagccccaggtcgagcgcgtgcctcctcaggatgcgcgagcacatgccgtggatggtgcttatccaggcggagtccacctgcagcgccgcctcgcccatgcccgcggagcgcagggtcgagcgcacgcgctccttgatctcgcgcgcggcagcgttggtgaaggtgatcacgagcacctgcgagaggtcgtccaggaacggtgcgccgccctcgcccgagcccggcgagagcgcccaggcgatgcggcgcgtgagggtgaaggtcttgcccgagccagcgcccgcctccacgaacacggggcggtccagcgtcctcacgatgcccagctgcctgtcgttgagggtggagaggtctatgccgctcatcgagagatcctcctgtcgcagttcatgaccgggcagtacgagcacgcctccgcgtccttggggcacgcctcgatgttgccgtcgagaagctcgcccaccttctcgcggatggcctcctcggtggcgtcgaggaaggcgtccatgcccctctcgccctccaccccgtacgaggcggagtcgtccaccgtgagggcgttgcacgcatcctccctgtgcgggacgtggtcgcccagcacgttctggagggcatttgcgctcaccgcgcccgcgatggcgtggtcccccctggtgcccaggtacaccgccgcggtgaccctgaggtccgggtgcctgcggcgcaccacctgaccgtagatcagcgactgcacgcgccgcggcagggagagggacgacccgtccggctgcgacacgtcgtactcccgcgtgaagcccgtgggggacttgtgcttgtagtcgatcaccacggcctggccgtgacggtccacgtccacccggtcgatggtgcccgtgaggtaggcgcccgcgtactccaccaggtcgtccctcccgccgaagttccactcgaagtagcgcggctcgtaccccaggaacagccctgcctcaaagtccagctcggagagcaggtcgtccctcagcgtgcgcagcaggtcgcggtccttggccgtgtgcgggacgaaggcctggtagcgcgagcgcttgccctcgcgtatggactggtggcgcagctcctcgtcaaaggtctgcgacaggatccggcgcgccagctcgcgcgtccggtcgtccccctccgagaggcgcgagccggggatggccaccgcgggcgtctcctcggggtcaaagccctcccccagcgcgtcggaggcctcgaccgcctggcgcaggagctcgcgatgcgtcacctccatgacccggtgggcgaaggtccccgtctccatgggcgagaagcccgcgtctgagtcctgcagcctcaggcgcctgaggctgaaccacttgtagggacactccaggtatgactctatctgcgaggcggagaggagcggacggccgtcaagcagctcggccctcccctcgggcgggaccacgacgagcgccctgttggaggcccctatcgtgccggacggcgcggggtcctcccctcccaggcgcgcggagggctcccccgagggcgcggcgttggcctccgcgtccgtctcgcccagctccgccacgacaagccccgcctcgcgggggtcgccgccggagtccacgccgtagcaggcgaggagctcggtcagcatgaccgaggggtagcactccctccccagggggtcgaacgagcagcgctccgccaccagggcgcgggacgggagcgccacgagggcggcgaagtccgcacgcgccgcgagcatggggtcggccttcggctccacgcccagcctgtcgaggatggcggtgaccacgtcgtccccgttgcccaccggggactccacggaggtctgcgcgcagagcaccaccgcgtccacgctgcccggagccagggaggcggcgagccggtacgggaggatggtcgcctcggcggtcgcgccgggggcctcgacgcgcgggcgggccaccacgctcgcctcgcccagggcgtcccgggcgagcgagaccagctggaagagggggacgtgcccctccgtcgtagggtcggccgtgacgcccagggacctcagcgcgcccgcaacctcgatcacggcggcgagcgaacctgcggcgagcgaacccgccagggcgtcctccccggcagcgtgctcctcgcgcgtctcgcccgcgtcgtcggtgacgtagtccgccaactcgccagcgacctggcccgaggcatagggcgagaggagcctcgccgccgcggaccccagcctgccccggagcagctcgcgcgtggcaccggcgacctcggggctggtgcggcgggggttgaggagcgtgtcgagcacgtcgcctggggtgagcaggcggtcgccgcgccacgcacggtcgagcgagagggcgcgcgccgtggggacgtgggagacctcgcagcggaggaagtcgctcagcgcgcgcggcggccaccaggacatgtcgcccaggtgcacgagcgtcccctcctccacgtcctccgcggttggccagccctccgcaaggtcggagagcgcggcgaccgactcggcgaactccaggaaggcccttcccgcctcggtggacgggacgcgggcggagagctgcgcgcgaacgctcacgccgcgggcgaccagcttgggcgcaagctccctccaggctcgcccctcgtccgacgcggcgacgaccacgctgcggcagcccccgtccacgagcgagcggatgctgcgggcgacggactccgcctccgcaagggggccggcgggcagcaggagcgagacggcgccagaggccgatgccctcccctcgcgggcgccatagagcgacgagaggacctcgcccagctcgcggggcctctcgaccgcccgacaccgcgcgtctccctcaccctccagctcttgggtggcaagtccgcggacctctgcggcggtgaccagcatgcccaggtcgtgccgaagcccctccgcggcaaactcgttcgggaggtgcgcggcgatggtgacgtcgcacgcggcggcaagccccagcgccagctcgcgcagccccctcgggaacgccctgaagccgtcaaacgccacgggtggaaccgtcacgccctgctcccccatcacgcccgcaacgcgtgccatggcctcggagccctccacgaaccccatggcgtggatggcgcgggcgtagtcccccaccagggagagggccgcgcactcggcccccgtgaggcccgcctcgtcgcgagcgaggtccccgtcctccaggggaagccacgggagagcgcgcgacgcgagcgagcagagcgcgtcaaccgtcccggggttggcgccgatgccgcccaggcgatccgggtccgcctgcgcgagggtgcgctgcatcgcggcgacgcgcgtggtgcggtcgatcaccctcgtgccgtcgccccagacctcccagcgctcccccacccatgcgaccggggtggagaccgtcacccccaggaggggaaacccggcatcggcgagcgagcggctcacgtcgacctgacggcggaagtcggggaccagcagcaccgcgcggccgccgttgtgcaggccctcctggagcgcctcccgcgtgcggaggcacccgaccgtctcttcccccgtccaggctatgctgagcgacatgatcctccccgcaatcggcggtccccgcgtggcatgcggggacgtgtgaacctacgcacgacatggtagcgcgagccccggacacaaaggggacccgccggacgcggcggggctgccctggggcgggcgagaagggcgcggcaactcaggcgggaacgacaccccctggcggcatgcccatgtggactggtcgcggggagggggaagcgcccgtcccccccccgcgcaggaccccaaggcagcggcgaccccgccccggctcagtcctccgcccgtgggccgtccagacgcgagagcaccagccgatagccgcccgcgggcccgttgaggcacttggagacgcggctcaccgtagtggacgaggcgcccgtggactccgagaccgcgacgtacgagctgccgccgcggagcagcgtggcgacctgaaggcgctgggacaggtcctcgatctcgcgcgtgctgcacacgtcgagcatgaacgcgcgcgcctcctcgggggtgcgaagcgtgcacagcgcccggaagagtcggtcctcctccacctcgagccgctccctctgtcggtcggactggcctggcatgcgcccctccctggatgtcccgggctcccaccctctcccacgcgtctactttagcgcactagtgcgataaagttccatggcccgtgcacagactgggatgccctccgacaccctcgggtagaatcgtcccgacacacgaggcccgcgcacccgcgggcgacgggaggaatcatgcgcttcgtaggacgctggctcgtcacaaccatcgcgatcatgttcgcaatcgccttcgtcccaggcatccaggtcgtgggcggcgagtacatgggtcccatcatggcggcgctcgccctcgcgctcgtcaactccaccatcaagccgatcatgcgcatcctctccctcccggtcacgatcctctccctggggctgttctcgctcgtcctcaacgcgctcatgctcgagctcgccagctacctggcgctcaacgtcttcaacgcaggcatcgtcctctcggggtttggtgccgcgttctggggggcgatcatcatcagcatcgtgtcctcgctgctgggagggctggccgactaggcggcccccagcggcctcgcggcgcttcacccccgcgtgagaggagcatgattgtcccccgcctggcacgatcccgttggccgcgggcttgctcgcgcacgagaggtgcctgccccaacatagacgaggagcgcctccactcggcggggcctcccctgcgcgagaggtgcctgcgccgctactcaaacggtcggcgaacgctcccgtccggaagcacccgctccagcacgatcgagtcctctgactcctggctcccttccgcattgcggggcgcgtcgcccccgccgtctccctcgggcggctcaaccctcacgatcctgcccgtggcctcgcgtcgcgcgaggatgccgtgccccctcggggccagggccccgtcgcgagccccctgtagagccccctcaggcctgtcggcttcgccggcctggtccgcctccactcgcgaggcgcgctcgccggcgtgcctcgacatgcgtcccgcaaccgtcttcagcaggtcggcggtctgctccgccacgctctcccccgccgtcgccagcgcgctcgccgccgcagaccgggcgctgtcgatcacctcgctcgcggcgctccggtacgcgtccacggtggtcgagacggtcgagctcacgagcttcgccacgatgtccttgctcgcatcgctggcgttggcggcggcggagagcaccttctgcacgctcgcggggtcgtacatcccgtcgaagctcgtcgcaccgcccgcccccaggacgtcgaagaactcgttcacgaacgcggcacgctcgtcgagcggcacgtcgctgtaccagcgctcgatcgcgtcgtcgatgattcgggcatcgttctgcagctccccggcgtccacaaggccctggggcgcgagctcccagctcatggggtcgtgctggttgatccggtccgccgtgctcctcacgtaggtgcgcggctcctcggggtggtcgaacagcatcccgatgacgctgtaggcgggcacgaagcgccggtacctctcccccagcacctcgtaggcgctgcgcggcatgacctcgtgcgccatccccggtccgtcgaagctccacaccgtcccgatgcggtcgcgcaggggctccgggcagctcgccgcgccaaacgccgcgaggttgcctcccttggagtgtccgcccacgagcacccggtgcccgcgccgggaggccctccgcaccgcgcgttccatgtactccctcgccagcgtctgggactccgtctgggtgaagctgagcatgaagtcctcgcgccagcccacgatcgtgaggtcggtccccctgaacgagacgaagctgtcgccgtcgggcaggtctatctgcagggcggcaaactgcagcgcccgggactcgtccaggacgtcgcggtagtcatgcagcaggagcccgccaaagcgacgggagtcgcccagggccctgagccagtccgcgtcgagcgaggcgagggtcctgagcctgccgctgatgtctccgcccacatgggagaggagcccgtccacggcgtcgcgcaccgtcaccgtcgggccaccagccaacgcctcccgcagggtcgtgtacgggatgtcctcggcgcgctcggcgggaacgaaccccgtgaggtcgatgtagctcaggcacgacagcacgagcgcgtccgcgtcgttcagggggaactcgcccatcgcgaggtccccgcgccaccgcaggtagtcggtcatgttcgccatccgcgcacctctcccctcgtcccaggcatgcgattgcttatacccgccgtgaccttcccgagaactcgcagtccccgtcgtccgcgcccgagtcaccgccaaaccagccgtcaggcctcatgccgtcggcctcccagccatcggcatcggtcccgtcgtcgcccgcccagtcgccagcgccccagccgtcccaggcgtccgccgcatcggcgtcgggcgcctcgggcggccatgcctcggcaccgtcgtgcgtcgtcccctcggggccgccgtccccaccgtgcgcacggggccctcccgagcccttggacacccctgccacgccctcgccggcgccagcggacgacccctcggcctcgcgctcgcgctcctcgagcatctccctgaagccccggagcgcatcgaacgggacgaagatcttggcgcgctcgctcatgggcatgcggggatgcctcaggtagaactggcggtcctcctccgtctgcgccccctcgtcacatgccactgcggtgccccccaatctggccgttgcgctcgcgggccgtcgcctgggggagaaggtcgtgggccctgagcagcgcattgctcccaaacttgtcgcgcaccgcgttgaccgcctgcgtgcgccggagctcccgctccgtgcgggggacgtcctggaagaggctcatctggatgccatccccatccgcatcgcggacctcccccagcgtgatgtagatgcggtgcagggggcggcgggggttggcgatggagcggtacagccactcgaggcggccccacacctcgtcgagcgagctcgagtgcgcgggcagcgccgccgtcccccgctcgaacagctcgccgacgcgcaccctcgccccgtgctcgcccgccctgccgtcggcctggcgacgggcctggtccgcgatgagcgcgcgctcctcacgcgtcgcccgataccccaggtcgaggtggagcgagcgcgcgaccttcccctgggcgacgaggtccatcaccagctggtccgccatctccttggcgatgaggagccctccctcgtagtcgacgtcgtgcgagagcacctgcccgttggcgagggagtggctctgggagcggtacgccttgatgtccgccatggtgacgggctccctcccccacgcgtggtcgatgagtatctcggcatcgatgccgaacgcgtcgtagatgggctcgcggggatggagggccagctgccccatggtgtggatgcccatctgggcgagcctgcgctgcgtgcccgggccaacccgccagaagtccgtgatgggggtgtgtggccacagcgtgtccctatacgactgctcgtcgagctcgccgaagaagtcggggctgtgcttggccgtgatgtccagcgccaccttggcgaggtacaggttggtccccaggccgcacgtggcggggatgcccgtctccttgaccacctcgctgcgtatgcgctcgcccagctccctcgccgtgcacccgtacaggtcaaggtaccccgtgacgtccaggaacgcctcgtccaccgagtacacgtggatgtcccgcgccgagaggtagcgcaggtagatggagtagatgtcgcacgagcgccgcatgtagagcgccatccgaggcggggcgacgacgtaggggatcccctccggtatctcgaagatccggcaccggttgcggacgcccctcgccttgagggcgggggacacggcgaggcatatggtcttgtcgctgcgggagaggtccgccaccacgaggggggcgacgagggggtcgagccccctctccacgcactcgaccgaggcatagaagctcttgaggtcgatcaccaggtactggcggggcacggtagcctacccgttgtagacgatcttgcccttgagggtctcgaccgcctcgtcgcccagcagcctcctggtgagcgcgatgccgagctcgatggcagtgcccaggcccttgctggtcaccaggttgccgtcctccacgaccgggtcctgcaggaccgtggcaccgtgctcggcgaggacgtcctggaagccggggttgctcgtggcccgcctgccctcgaggaggccgagctccgcgaggatcgagggggcggcgcagatcgctgcgacgtccctgccggcgcgggcgtgtgccacgacggcgtcacagagcctctcgcacgcacgaaggttcttggtgccgggcatgccgccggggaggaagagcacgtcgtagtcctcgaacgagaagtccgcgtcgtcgattgagcggtcgcaggcgatggtgacctggtggctggacgtcaccgagcggttcgacgtgatggagaccttgtcgcacgggatgccggagcggaagaggaggtcgcagaccaccagcccctcgcactcctccagaccgtctgcgaagaacgccgcgacgcgcttgtcggttgacttgcggaacatgagctacctccgatgaccgtgatggatgtgcgcccgattggcgggggcggggcgatgccgccgcccctactcgtcctcgggcgggcgacgcagccgcttgacctggccgcgacgccgcttgccctccagcctacgcctcgcggaggcgcgcgtgggcttcgtggcgcggcggaccttgggtggaatcccgcgcctgcggagctcgtcccgtatcttctgcaggcagagctgccggttgcgatactggctgcgggactccctgctgaccacgacgatgcccgtggggcgatggcgcatgcgcacggcggagtccgcggtgttgacgccctgccctcccgggccggtggcgtggaacgcctccgcgtcgcagtccctcgcgatctggtcgagcgactggcgcccgtaccgggcgtagtccgcatgcgacagcccctgtgccatgcccaccccttccaaaatgagaacgtttgttctactatagcagacacgcaagacgggctcaaacggaaatcgcgccccgggctgccgggacgcgattgcgaaggaggggttcgccgatggtgccggatcgctgcccgctacagccgctccgcgatggagtggatcaggcgctctgtcttctcccatcccaggcaggggtcggtgatggacttgccgtagacgccgccgcccacctcctggcggccgtcctcgatgtacgactcgatcatgaagccacggaacaggccggcgatcatgggcgaccgatgcacggagtcaagcacctcgtccacgatgcggacctgctccaggggcctcttgcccgagttgtcgtggttgcagtcgatgatcacggcggggttctcgtacttcttggtcacgtagcgggcggcgaggcgctccaggtactcgtagtggtagttggggtagttcatgccgtcggggccgatgtagccgcgcaggaccgcgtgggccagcgggttgcccgaggtctcgacctcccagttgcggtagatgaacgactgcggggcctgggcggcgtagatggagttgagcatcacgtcggtggagccgcccgtggggttcttcatgcccacggggatgggcacgccactggcgaccaggcggtgctcctggttctccacggagcgcgcgcccacggccacgtagcccagcaggtcgatgaggtagcggtggttggacgggtacagcatctcgtccgcggtgaacatgccggactcctccaccacgcgcaggtgcatcctgcggatggccttgacaccctcgagcaggtcgggggcgccctcggggtcggggttgtggagcaaccccttgtagcccgtgccgcgcgtgcgcggcttgttggtgtagacgcggggcacgatgacgagcttgtcgcgcacctcgtcctgcacgcgggcaaggcggctcacgtagtcgagcacggagtcctcgcggtcggcggagcaggggccaatcacgagcaggcggcggtcgctcttgccgcggatgatggacgcgaccgcctcgtcgaacgccggcttcctcgcggcgaggtcggcgggaaggggcatcgactcgcggatctcctgggggatgggcaggcgacgcttgaagtgcattgcttctggcatgaatgcctccgttggcatgatggttttcctcgcatgaagcgtggagtgcattatggcatgccaaggcccaagccaagcggccagaaaggttacgactttgcaacgtggctggatggagcggttgcgcggcgaacgccgtcacaccttcgtcatcgctatcatgtgatgcgttgtgagaagtaacgagcaccaaggaggaacgatggcctgcaccacgatactggtaggcaaggcggcgagctacgacggctcgaccatcatcgcgcgcaacgaagactcgcccagcggggtctacaaccccaagcgcatgcaggtggtccaccccagcgagcagccgcgccactaccaggcgaagatcagccacgtgagcatcgagctgccggacaaccccatgcgctacacctcggtccccgacgcggacgactcgcagggcgtctgggccgcagcgggggtcaacgagaggaacgtcgcgatgaccgcgaccgagaccctcaccaccaacgagcgcgtgctgggcgccgacccgctcgtggagtacgtccccgccaagggcaccgagggcgaggagggctacgtgcccgaggtcgtgggcggcatcggcgaggaggacatggtcaccatcaccctcccctatgccacctcggcccgcgagggcgcgcgtctcctcggctcctacctcgagcggtacggcacctacgagatgaacggcatcgcgttcagcgacgcggacgagatctggtggctcgagaccgtgggagggcaccactggatcgccaagcgcgttcccgacgactcgtacgtgaccatgcccaaccagcttggcatcgacgagtttgacctgagggacgccctgggcgaccaggtggagcacatgtgctcccccgacctggcggagttcatggagcgccatcacctggacctcacgctcggtggcgaggacggcgtgttcaacccccgcgacgcgtttggctcgcactctgacgccgaccacgtgtacaacaccccgcgtgcatggagcatgcagcgcttcctcaacccgcgcgtcaacttctgggacgggcaggacgccgacttccgccccgaggacgacgacatcccctggagccgcgtccccgagcgcaaggtgaccatcgaggacgtgaagtacgtgctgagcctgcactaccagggcacgccctacgacccctacggctccgagggcaccgaggcgacccgcggccgctaccgccccatcggcatcaaccgcaacggccagctcgccgtgctccagatcaggccctacctgcccgagtcgtgccgcgccctccagtggatggcgtacgggagcaacgccttcaacgcgctcgtgccgctgtacgcgaacgtggacaggacgcccgagtacctctccaacaccaccgccaaggtgacgaccgagagcttctactgggcaaaccgcatcatcgcggcgctcgccgacccgcacttcaactcctgtgcggtgcatatcgagcgctaccaggaggccgttggggccaagggccacgtggcggtcaacgcgacggatgacgacgtcgtggcaagggacctctcgcatggcgacgccacggatgccctgaccaaggagaacgacgccatcgcggcgatgcttcgcgacgagacggacaaggtgctctcggaggtgctgtacaccgcgagcgagggcatgcgcaacgcgttcgcccgcagcgacggctagcgcagggagcagtccccgcgcacgtggcgggtgtcgggggatgacctccacacccgccaccaccgcagggtcacacattgcggagagcccattgcagggagaccggtgcgggaccgagggggtcgaccgcgcgaaaggggccggggccaggcgagaggtgcgtcccgccgggccccgggccatctggtttggcttggtcgtgcgttacccgtccgtctcgcccgcggttgcggctgcggacgtggactaccgtccgtctcgcctgcgattgcggttacgggagtgggctgtctgccggcacgtgtagcccgcagccacgggtgaaccggcgggtgactcgacggcgagtgcaacccccgaccgcaggtgaagaacgccggggtaccgatgccccgagggatatggggctacgacagcttgatgcccatgagccagccccagcgcggggtgaccgtggtgccgtagtagctaatccaggagttgatgttgatggtgcggatgtagccgatgttgtccatcaggttgcccccgcccacgtagatgccgatgtggccgtagatcctgcccgcggaggtgtgcgagtgggacgacacggcgacgatcatgcccggcttgaggtttgacaggttggagctggtgcaccaggagttgtacatgtcgcacgcgttgccgctcgcgtagccgtagccggcgttgttgaacacctgcgacacccacatggcgcacagccccgcgcccggcgagggcgtggacttgcatgcggcgatgacctttgcctgcgagcccgtggtggtgccgtcgctggtgctgccggacacgccgctcgccgcggagccgcttgaggagctggaggacgagctgctcgtggacttggcgacagccgcagcggcagccttcgcggccgcctcctgcttggccttctcgtctgccatggcggcgagctcggcgtcgcgcttgtccatgagcttcttcacctgggagctgaggccgtcgatgacgtcctgaacctcctgctgcttctcctgcatctgcttgagctgggccttctgggtctcgttaagggactccagctccgacttctggctctggaggtcggccttctgctggtcgagctctgccttggcggacttgacgtccgcgatcatctggctgtcggcctcgctgaccttgtccaggtagtagatgttggagtcgagctcctgcagcgagctggagttgaggaggaccgagaggatgtcgaccccgcccgacttgtaggcggaggacacgcgcttgctcaggcgctccttcttctggtccagctccttctgcttagcgtcgatgttcttctgcgtctggtcgatctggtcgttgaccgactcgatctggtcgagcgtgtcggactgcttcttggagagcgcctggtactcgtccccgatggagtcgagctgcttctggaccttgtccagctgcgcctgggcgctggagaggtccgagttggtcttgtccacgtcgctctgcgagacggcgagcgcctgcccggggagggtcccgagcatccccgccgtggcggttgcgcccagcaggaacctgatcgcctggcgacgcgtcatgctatcgaattccacagaggtccccttgttcggttgagttgcgtgcgtgacatctgtgcccgtgatagagcatgcatcagcatactacccgcagcgccggcgacgccaccccgtctccccaagttccacaccagcccaagtgccctggaccgcgccccttgccgtgcggtcccgggcgagacgggctttgatgccagtggcgcatgatgccgacgggaggggacgcgagcgggtgccgcgcgcctctcccccacccccgtcacgagagcccgagcagccccttgaagaagctcacgatcgcctcgagctggtgtgcggcgcactattgttggctatctgaaaatcccagcacacggcctgtgcgaaacctaaaaatgccagcgtttttgaagcacttctcccctggccacggatacactgttccctaatgcagggccgtacctgggaaggggtggccgcatggcgtgggaatcgcatgatggggagcccgcgggctccggtgacctggcgcgcagggagcgcatgctccgctcgtacgtccgctcgctgggaagcgtcgcgatggtgttcatgggcggcgtgggctcgcgcgtgctcgcgcgcacctgccacgacgtgctgggcgaccgcatggtcgcggtgtcgccgtgcggcgggaccatcgccgcggaggcccaggagtccgcccgcgcgtggtgcgactcgcgggggatcgagctcctgctgccagacttcgacaacctgcaggtgccgggccttgcggacaaccaccggaaccggtgcgacctgtgccgccacgccctgttctccgagctgcagatcatcgcgcgcgcacgcggcctgggctacgtggcggagccgtccgacgccgacgaggtcgcggcgcggcccagcctgctccgggcggcgaccgacctcaatgtgaagagcccgctcatgcacgtgggactgggggcgcggggggtcagggcgctcgccgtgcgcatgggagaggacccggagccgccgtcgcagcccatctgcctggcagcccaggtggagcagggcgtgggcgtcacgcccgaccggctcgcgcgcgtggagttcgcccgcgcgctggtggcgtcgctggggcttgcgggcatccgcgtggacctggtgcgcggggacggggaggtcgcgctcgtgcgggcggcccgcacggaggcgggagctgccaccgcggcccgcatccacgccgacgggggcctgcgccgcgagctggtccgcgggctgctgggcctgggctttggccgcgtgtggctggagcttggcgagggcccggcggacgacgcgcagggcgacggcggcgggaccgaggcgccccaggcgtagcgccagaagatcgcatcgggcgagacgggcgtccctcccgggcggcggcgcgcgcgatgccggcgggatgggccgcggctcaggtgcctcgcgcctctcccccgcccggcgatgacgagccagctccgcctacttgttctcgatcttgcccacgttcttgatgatgatcgagacgttcccctggtcgtcggccgtgaactcgatgtagttggagtcggccgcgtactcgctggggaaggtgatctcgatgccggtgtcggtcttgatcttgtggttgcgcgccatgcggtttgccacgccccggcggatggggacctcctcgggcaggctctcctcgcgcgttgcctcctggtagcgctcctgcaggtcaggccggtcctcaaagaccgcctggcccacgtcctcgggcgagaaggactcgtccctgtccgcgttgctcgccacgtatgccttggcctgcgccacggcctccaccgggttgacgccgtactgctccgccacgtcctccacgatgcgctcgaccgactccaccacctcgcggctggacgcctgcgccgtgcactgcagcaggccgtcggggatcaccaggcgctcctcggtccccactatgcggggcttgtccaagaagtcgatctccatggtccccaggttcaccagcacgtacgagtcgaccttctgcgtggggttgggcagggtgctgtcctggcgcaggatctcgttctccggggctcctccggcgtcgctgcccaggtcgtggacaaaggcctgcttgcgcggcaggagcaccgcggccaggtagcggtcggccgagctgccgtcaaaggctgccgccgccgcggcgtcggggtcctcctggacctccttggagtccaccttcatctcgcgcgtgtccgtgaagtcggccatcagaaggtcgcactcctccaggtcgtcacagcggcggagctcctcccacaggtactcgcccacctgctggctgatctccacgaaccccagctggcccacggcgtactggcgcacggcgtcggcgaaggcgctctgctcgctgaactcgccgtgcttgctctcggggctggagctgatgttgcgcatgcggcgggcgacgtacgacctcacctggcgctcctccaggtccagctcgtgctgcgagaggtacgagctgccgctctggaagtcgaaggcgtgaaggattgaatggctgatcctgagcatgcggaaactccgtccgaggtcatggctaacggcaacctaggatagctcaggagagaggggacgggcacccgggttctggccccacccgccggctgcgtggcaccagcaggtcgcaggccgcgccgggcgggggtccgctggcatcccgggcgccgcgacatcctgcccaccaggggatggggccgccggccacggggcaacgtgcctctcccccgcctgcgcctcccacgccgggcaagcaccatacaagccgtgtatggattcccatctcattatgtatttaacaaatcgcagtcgcgcgcctaggattctgcgtgaacgagcccgggcagacgcaggcagaggccccgcccaggcttcgccgcggatgcgaggaggcatcacatgattgctggaatgggcatgcccgagctgatggtcatccttctggtggttctggtcctgtttgggcccaagaacctcccgaagcttggcaagaccctgggcgagacggtcaagaacgtccgcgagggcatggaggaggacgacacccccaaggccgcccaggcggcgcccgctcaggatcccaaggtcagcgaggccagctcggattccgacgcccagtagcaatcggcaggcgagaggggcggggcgcacccggtttcaactcgtcccactgggtgcggctgcggggcggagcttcccccctctcccacacttcctaccggggaggcacggcgggcccgtccgccgacgtcccgccgcccctctcgcctgccgcgtgatgcgcgcgatcccgattgggccggatggctgccgctcgcgtgtggcaccggacggacttccgtctcatggctcggcgactctcgcaggggagcgacgcaacccgtccgcgacggcgtgccgctcccctgcgattgttatgcgagcgatcgtggcccacgtccctctcccctgccggagagcgctcccagcgccccgggacttccccgccgaacggtcgtggcattgcccgccacgggacgtcaccgccctacccgcgcagcaccctctccaaggggcggcccttggccagctcgtcgacgagcttgtccagctgccggatcgcgcgcatggtggggtcctcgatgtcctccacccgcacgccgcagaccttgccggtcacccgcgaggcaagcgggttcatgcgcggcgcctcgtcaaagaacgtcttgtagttcacgtcgcgctccagctgcgcgcgaatccccgcctcgtcgtagccgcacagccagcggatgacctggtccacctctgccttcgtgcgacccttgcgctccgccttctgcaccagcagcgggtacacgcgcgagaacttcatggcaaagaccctctggttgtccatctctcccccaaggcagcggatgtcatcgctgcaattctaggcgagaggggcatggccacgtcgctgcagacccgtcccgttgtcccgacggagacgccgttagcgtcgcgggcagtggctaccgagcacgtgctgggatcatctctcccgcccccgtcgggcctgaacgacacgcacgtatccctcgtccccaaggagggcccggaagcaggctgccgtcgcacgcgcatcctccagggcgtcgtgcggggagaaggcaatgccgtagtggcgggcgacctcctccagcctcgtccatccgcgggggcttcgaccaatcctcatcggatgagccctcgcatactccctcatcacgtcgaaggtgacctgcggcgattgggtaatcactccctcccgcaggaggaacttgaggtcaaaccggaggttgaagcctacgaccacatgctcgtctgacagcaggcttgatacgacctcgttcagttcgtccgcggtcggggcgccgcggaccattgcaggcgagatgccattcaccctctgcgcctgcggccacgcctcatggcgcctcggccgcacgaggctgtgcagcaggcttcgcccgtcggcgtccacgattgcgagtgacaagagttcgtcgtcccactcgggatggaggcccgtggtctcggtgtcgagaatcactgcgtcggcaagccccatgcccgtcagcgcccggcagacagtgtcgatgtccatccgtcacccgccccccctcgttcgtcccttaggaatcgccccacttctcaaagccaggtcggtgtcccctgcctccgccagcaacatcttctccgacaggtaaatgaatctcgctcaaagattagcccctcatgcgcgaggaacgtcacttctcctgccatcgcctctccggtccacggtttgtttgcgcgcttccctgcgcggctgtggcggccgttttccgctggccgggcgtcaccgtggatggtctggcaggggtaacgggcacgaaaaagggccgcttcgaggggtggcccactcatgccacggcagatcgtccgtgcagtctatcgcttgcctctcccgaggagcgcgtcggcgaactcgtcggatacctccatgtcgtggcgctccaggttgtacgtcatctcctcggtccagctggcaccgttcttctcgtacatagcgtcgacaatgccagtctgcttgcctgtcgagtagtcgaccaggtaccccgcggcgatggcggtcggctcctcgccggtcatcgcccgcagcagggcctccttgtccggcctgcgcacgccgagcctcgggacgatgcctctcccgtagtcgcttgaattcgcgtatatcatcgcctatccccccctcggcgtgaactcgaccatgcttccgctcctgtgcctgccgacgtagagcgtgtcgttcggtgccgacaccgtcacgccgagcctgtccgcgagatcctaggcgatgcaacttcccttgctgtcaatcttacccgtcgagcaggcgagaaggcgcacgtcgccgccatcgtagtccttcctgccgcgaatcctcgtcccgcctcaccctcaccacggcacgcgtcccgtcattccatttgtcgaactcattctcgatgccccgccttatccccatgcgagaaccgccaaacaggcgaatctcgctatcgttgaaccagttcggagcatccaactcccagcattccgttccgctgtcacctattccttcatgcgcggcgaacggcatcgcagtaacgtcgtagcccctctgcttgagctcccacgccacgacacagcgctggcagttgttcgtccacttgtagccctcggcaaagtgcgggttgaccgcggcgaggctcttctcggtcgccatgaagttcggccccttgtacctgaactgcttcaggacaggctgttcctcagctggcttcttggcggacgggcgaagcttgccgagcacgcgtgacaggatgcccctctgctcgcttcgcgtgagtttgcggaagtcgccgccggtcttgtcctccttcgccagctcgcctgcgaagagactacgcgccttggtgttagagaggcccgcgcgctcgatggcactcctcttcggcggcgtgtccatgaactctccgaggctcctgtcgctaggctttggcctcttgaaatcgcgtccggccttccagtcctcgtagctgatccccagcttggactcgtcgcggtcctcgaagggtcgtagccgggcatggaggccaccagcgtgcagcggcagggatcatccccgcgtatgcggggagcactacgagcggagccaatatccgacgtattcctgaggatcatccccgcgtatgcggggagcacagcatcatggccttgtcgcggtcgattggctcgggatcatccccgcgtatgcggggagcaccactcgcccgtctgcgggtccttctgcctctcgggatcatccccgcgtatgcggggagcacgcgcgggagtcggacaccagcttcttccagtcgggatcatccccgcgtatgcggggagcacccctggtgcgcccacagcaacgccgcgaaggcgggatcatccccgcgtatgcggggagcaccggctgaggtgacgtcggatactttcgtaatctggggatcatccccgcgtatgcggggagcaccgaacttgacggaataaaactcgaccccaaggtggatcatccccgcgtatgcggggagcacgtcaaccagtccgcgaggaaggccaatggcacgggatcatccccgcgtatgcggggagcacctccatgtaatcaccccctatgcatagattgcgggatcatccccgcgtatgcggggagcacccgttcgccgagtaaatttgcacgttcgctccgggatcatccccgcgtatgcggggagcactggaactcgagaccgttgttgagcacgaccacgggatcatccccgcgtatgcggggagcactcgggcatggcgtcctgcatctgccgcgttacgggatcatccccgcgtatgcggggagcacccagcgcgcacgctgggcaggtcttcgcgctcgggatcatccccgcgtatgcggggagcacgcgtggacgaccgcaggccgtccgccatctcgggatcatccccgcgtatgcggggagcacagagcaggaatggccgtcacgacagatgaaatgggatcatccccgcgtatgcggggagcaccgcgctcgcctccgtagtcgattgagcgcacggggatcatccccgcgtatgcggggagcactgaagacgtacccatacccgaattcgcttggcgggatcatccccgcgtatgcggggagcacgccacgccctcggccacgtcgccgccgtacgagggatcatccccgcgtatgcggggagcactcagggatgaccgcgcgtgggtcactgacggcgggatcatccccgcgtatgcggggagcacgcttgaagtcagaccttttgagcaggttcctgaggatcatccccgcgtatgcggggagcacgtgatttccgcgctgcagctatgcgacgtgaagggatcatccccgcgtatgcggggagcacagctgcattacgctgaaattaggcatgtgtttaggatcatccccgcgtatgcggggagcacacggcggacttcttcgggtagccggtggtgtcgggatcatccccgcgtatgcggggagcaccatccgtgttaatggttacagcgcagacactcgggatcatccccgcgtatgcggggagcacgagaagaatctgcttgcccgactcgtaggccggggatcatccccgcgtatgcggggagcaccgtcgtattcttcttgtggcccttctcgtcgcgggatcatccccgcgtatgcggggagcacgccttggtcgtgacggtgccagaaaccttgacgggatcatccccgcgtatgcggggagcacagacaggaaggaagacaatggctgctacaaacgggatcatccccgcgtatgcggggagcaccctactttcggccttctacctgcggaaacgtcgggatcatccccgcgtatgcggggagcacaggaagtccaagaggcagaagacgccgcccgcgggatcatccccgcgtatgcggggagcacgaagccataagcagctccgattcactgaagaagggatcatccccgcgtatgcggggagcacgcagagtccctggaggccttctacgcaaggaggggatcatccccgcgtatgcggggagcacgcgccagcccgcagccgtgcgacgacctcctcaggatcatccccgcgtatgcggggagcacgtcatgtgcacgacgctcgggaccggttgtccgggatcatccccgcgtatgcggggagcaccatacaagacctcgcgggagaagcaattcaaagggatcatccccgcgtatgcggggagcacattgggccgatgatttccgcgattggcgcagcaggatcatccccgcgtatgcggggagcacaagaccacctgggagcatgcggttgactacccgggatcatccccgcgtatgcggggagcacgtggtggggaataatggccaccgccgttgtgcgggatcatccccgcgtatgcggggagcactttttattagggaggtttgccagtgccagaccgggatcatccccgcgtatgcggggagcactgcccgctcccttggcgtccttgacggcatccgggatcatccccgcgtatgcggggagcaccacgggctcgggaagttcccgtgcgagatggtgggatcatccccgcgtatgcggggagcacacgtccgcagtgcctccgtgcgccatgccccaggggatcatccccgcgtatgcggggagcacgcccaggcccaggaggctccgagcgtcgaggagggatcatccccgcgtatgcggggagcacttggttccctgaatcgagatggttccatcgtcgggatcatccccgcgtatgcggggagcactggcgggcatgaccttggtgaggtagtcggtggggatcatccccgcgtatgcggggagcaccgaggcccttgcgattcgccgcgaggacgtgcgggatcatccccgcgtatgcggggagcaccgaagtcggagccaagggaattcacgacggaggggatcatccccgcgtatgcggggagcacttacgggtgagaggtgttacgagtatgagcctgggatcatccccgcgtatgcggggagcaccgattctgtcttcggtggcggcgtcctcccaggggatcatccccgcgtatgcggggagcacctgcgcgacaacgtcgccatccatcactgggagggatcatccccgcgtatgcggggagcacgttcgtgtgatggcggaagatgggcgtattacgggatcatccccgcgtatgcggggagcacaccgacatggacgcgctgattggcgaccgcgagggatcatccccgcgtatgcggggagcacaccatctcgattgacgagaccacgggcgcggagggatcatccccgcgtatgcggggagcacaagagcgtgtgcatccgcatcccgcgcgaggtgggatcatccccgcgtatgcggggagcacatctcggtcacgccaaagacgagcgccttaatgggatcatccccgcgtatgcggggagcacaagaacgcctacgagaaaatcgactacagagagggatcatccccgcgtatgcggggagcaccgccaagacctgatacagatagtacttgtctggggatcatccccgcgtatgcggggagcacgccaaggcgatcttccgcgaatggtgggtgtcgggatcatccccgcgtatgcggggagcaccatggctccgtagacagctccgaagaacctgggggatcatccccgcgtatgcggggagcacctcttgacgaccacctgcttgcggaggatgtcgggatcatccccgcgtatgcggggagcacgcatcggagatgccattgatgaagccagtcacgggatcatccccgcgtatgcggggagcactttcgtgggctgtatcaggcatacaaggacacgggatcatccccgcgtatgcggggagcacatcgagcagcagctgaggacggcaaccaaggagggatcatccccgcgtatgcggggagcaccccgtgtccacctaccaggagaccgccaacaagggatcatccccgcgtatgcggggagcacgtgcgcatgtacgtcctccacgacgccctcaggggatcatccccgcgtatgcggggagcactacgggattacaggctcgatgcccttcaggaggggatcatccccgcgtatgcggggagcactgaatcagcgttgctaggttgctcgcggtcgtgggatcatccccgcgtatgcggggagcaccatacgagagtgttccagactgctccgttgtggggatcatccccgcgtatgcggggagcactcggcgcgggccagcatcttggcgtagggcgggggatcatccccgcgtatgcggggagcacgatacctcctgcacgtcatcctgctccgtgacgggatcatccccgcgtatgcggggagcactcgttctcgtcgttgtcaatgtcgattccctcgggatcatccccgcgtatgcggggagcactgggcgcgcgatagtcgttcccgtgcgtcgcggggatcatccccgcgtatgcggggagcacgaaagtcgctgcttctgctgctccaacttctcgggatcatccccgcgtatgcggggagcacgagacgaaaatcgcatccgcgcaggaaagcgcgggatcatccccgcgtatgcggggagcactacccgtcgtgcaggtcaagcccgtccacgaagggatcatccccgcgtatgcggggagcaccttggaagctgctggaagaacttgattacgttgggatcatccccgcgtatgcggggagcactcctccaaaacttgtcatttaatcacccccatgggatcatccccgcgtatgcggggagcacttgcctggaagctgctggaagaaccgaacgacgggatcatccccgcgtatgcggggagcactactacggcgacatgacgggccttgccaccaagggatcatccccgcgtatgcggggagcacctcgcgatgctggagtccgcgtgctcggtgcgaggatcatccccgcgtatgcggggagcacatccgttgttaccgtttccgaacatgacgactaggatcatccccgcgtatgcggggagcacacggccacaatcgtcctgctttgcatcaacgagggatcatccccgcgtatgcggggagcactcgcgcggggatgacccgtagttcgtttgcgggggatcatccccgcgtatgcggggagcacgacctcggagacgggcttacctaccgccctcggggatcatccccgcgtatgcggggagcaccagattggaggcatgatggagcaggagtttaagggatcatccccgcgtatgcggggagcacggtcgctgacctcggtggacagcgagttgtttgggatcatccccgcgtatgcggggagcactcgaactactcgtcctttgtggactatcgccagggatcatccccgcgtatgcggggagcacggtgcgcccttgaggtaccacgcttcgatggcgggatcatccccgcgtatgcggggagcaccaccagccgttgtctccccacgccctgttctggggatcatccccgcgtatgcggggagcacggcaacaagacggcgtggatgagcgcggatacgggatcatccccgcgtatgcggggagcacggcggctccaaggcgaagtacagcatagaggacggatcatccccgcgtatgcggggagcacatggagtccgacagctgcgtaatgctggacttgggatcatccccgcgtatgcggggagcactacaatgcggccatcgcgacgatagtcgtcatgggatcatccccgcgtatgcggggagcaccggctgatgacgcctactcgcgcaccctgcgagggatcatccccgcgtatgcggggagcacatccatctgtgttcattgtccacactgactgagggatcatccccgcgtatgcggggagcacgcccatgcgtgcgactcacgatgctcaggtaacggatcatccccgcgtatgcggggagcactcggagatcttggattccgtggtcgccatgttgggatcatccccgcgtatgcggggagcacgcatggccgattaggtccgagtagaccgtggtgggatcatccccgcgtatgcggggagcacagaccacggttggcggaaggccgtgcgcggtcgggatcatccccgcgtatgcggggagcacacttaacaaccaggagaatcatatcccatttcaaagaaagccattcggttttcaaggttcgcctcagaactagtttccgaactttctcgcctgccgatgcttcgatgcacggctccaccccttgggaggggagccgaatatcgtcgcatcctcggtgcccctcgggcgcctcacaagctctatcccctcgcagtcgattggctcccagtccggttgccacaccttgaaggcaaggtgctgctcgtttgggtacgagtacgccatcgtcgcccgcccagtcttgatgagcgcgagcacgcggtcccagagggcctccctcaccctcgccgagacgtcaccgacgaacaccccgggggatatctccatcagccagcgtgtcaggtcgccgcgcagcccagcaggacaggcggtgagcacgatgaccaccatcgccagtcacctcccctctccccttagccctctccatatgacttacctgctggaacctctcccaccttctcgtcccagagcccgacgtgatcgatggatgggtccaggcactccgcgtcctccgtctcgaggagaagcgacttgatgtcacccaccatcctcggcatgatctcgaggctgtagaccgcatctctcatcttccgcctggtctccgccccgacgtccacgggaaactccgccacggtctcgaacgccaccgggatggagatctctgccttgtacaggtcggcgacgtcgtacacgaaggagcgctcgtgacccgtgtgcacgaacccgagccccggggagcagcccatcgcaactattgccgcatgtgcgagcccatacatgcaggcatgcgccgcggagagggcctggttgatctcggtcccctcgtcgaagtcgtccgggttgtacgtcctcttgtcccagacaacaccggtcttctccgagcactccttgtaaaccttgcggatgcgagccccctcgcgtccgcgcagctgctgcatggtgagggcgctcacgtcctcgccggggaacctcatcgcgtacatccttcgcgccacggcgagcctcgacctggtgttggagacgagtttggcctgtcgctgcagcagcgcgctcgagtgggtgagcggactgccgaacgcgtacatgcgcacgccccgctcccccacccagatcacggaggcgccgctctcgcctatgacggtcatggcgtcatgggtgaccgtcgatccgggcccgagcatgagcacgctcagccttgcggacgggacgtagacggtcccctcctcgtccgtgaccgtgattgcgttgtcggagcggttgaccttgcagtgctcgaagtacaggaacgatatcctgtcttccacccgcaccagctccgtaacgtcagggggaggggctcccctccgactcgatgcgcccctagcagacccatttgaatcggacatggttgcccctctccttgaagagacttctgctgttcggccctagcaggcgggcatgatggtcaggaggccgcagccgaaccccttagccctcccaatcccgaaccccagggcatgcctgaaggcgtcagcgtcctcaacccgcagaatcccgtcatagaccgccgtgcagatcgtcacgtcgcttccctctcgcctcgagcgctccgtgcgcctctgcgagacgctgacttggacgaacccatcgtcgtccgcgaccagggagaagccgtggctccccgacctgtcctccagccacttgagctggtgctcgacggtgacgtgaccctgcaccttcccgatgaccttcgggttctttgaccgcctgccaaggtcagccctcacctttcgggcggggttcgccttgaggcggaaccgccagacctgcccgtcgccgacccgatcgaggaggggaccgtagttcttcgtctcccaaccggggtttgccggccatccgcactgctcgacgatgtgggagaagtcgggcctctccgggctcacgacgtacagccagacgccctcctcgctcctcggggactggtcgatgcgccagaggatccgcccctcctcgcactccctcgtggcgccaggaggaaacgatgcctcgacggctgcgtgcattcggtatggggagctcacgagcctgagcgcaccacgcctctccacgttcaatggaagtcgagagatgtacactccgtcctcctttccactagatgaaccccatggggtcgtgaccgccgggaaggatggctccgcctgcctgcggggaagcggctaccgcaggcgccgtgcctggcagcgagtcgacgggcaccctgaacctgacgatacgtctgctcgcatacctgcgacacacgtgcccgaagctgacggggagatccggctgctcgaaccccgcctccccctcccccgcatcgcagagggtctccagctcgacgcgtcccgagcgctcccggtaccagtctgccgcaatccagggatggcggcggagcgcgtctcgcacgcccgagtagtcctctgacagcccgaggcagaccggctcgtcgggagggcacgagcgcctccccaggaacagtggccacaccggggtcctgagggctcgttccagctcctccagcaggggctcgtcaccgccaagggccacgaggaacttagcgtcggagaggtaatagcggtatgagagcggcatcgcctttccaccatctgagggacgctccgtctggaagtcgcacaagacactcccgggctggtcggctcggacaccgaactcgagggttgccaggtcgcccaagtcatcctcgcgggagcggccgagcgcggacgccagcagtccgaccacaccgctcttggtcggttcctggcgggtgcccctgcggacgaagcgagaggagtcgccccacgactggagcggacccgagagcctcaggagcaggacgctcatgcctcctcaccctcggagagggatccgaggaccgcttccttgaccgcatcgtagagctgggggcagtcaacctgctgtccaaactcctcgagcgcctcgtcgccgccatcgatggcgcaccaccacgactttgcgggacgctgcccatacatgtccgccatcccgttgagctgcctggcaagcaggccctccgcctgggacgagatggactccccctccttcggcatgacggggctctcgaaggcgccgacgccattgatgggctgctcctccctcagggcgacgagcactgcggatggaagcgtcctgttcgcgaaggtgttctgcttccccgtgggcatggactccacgaaggcccggacgaacgcgcgtacgccctccgccgtggcggcgtcgtcgccaagctgctcgcgcagtgacgccacgttgaccgtcgcgtagcgatacagggtggacgagttgtaagccagcgtgtccagcatcgcggccccggcattgtcagacgagacacagtcgtccaccgccgtgaagtagtcgtactcctgcgtcaccttgttcaccgagatcgcatgggccacctgggcggatgcatccgtgttgaggtcgggggcgtcggcgagcatgcgaccgaagagggcaatgtcgagggcctgctgcccgtggaaggcggcggagaccttcttcttgaggtccttcgagggcttcgagaggtcttcgcccgcttcctgggcgtcgatggcgatgcgagcgagcttgtctatctctcgcttcccgatgaagatgaggtactgcgagacttgcgagcccttgtcggaacctgcgcgcttcgactcccccaccttcacgcccgtggtagaaaggacgcccatcgccagcctctcggcagagtccgagaggtcggggcgctgcaacttgatgctctccccgatcaggcctaccgcgtgcttggtcctgtacccaaggctctccgcatccacaaagtgggagaagttctccctcatcgcgtgcttccacgcctggctcgacacccgagcacgctggtacccgccatagaccgccgtcttcggagatccggtgtcgtccctattgatgttgctgggcggaacatcctgcaaaaggttgatgtcaagatacatgattacctcccactctcgttactggcgaacgcttgcggccccatcctccgaggccgctgacttgacgggtgcgtagtagtccctcgcccagttgaggaagaccccctcgcgagcggactcaaactgcaggaggaacaggtcccgggcaagagcgccgtagtcgagctggacgtccctcgccctcatctgcctcacgagcgcacgcacgcaggtctccacaccacggaagtcccccgacgcggcctcgatgctcgccatgcgcctcctgacccccggggctccactctcgtctcccctatctggatcaaacgttatgaggcggcatgccctgccgaagctacccgaggacccctcccccgccttcgggaagaccgccatcggatggtccttggactgctggtgaatcgaatagagcttgagcgaggccctgatgctgagaagtgccttgtcctccacaaacctccccatcccaaggtcggggaggtcggagaacacctcctcgccgacgaccatccatgaccctccgcctggtgtgtccagcttcctcaggcgtgccatcgtcgcccgcgcaggtgccaatccctgaaggtaggcgctctggagccttccgaccttggcgttgacgcaccggccaacctctctggaggcaacgctgatgccttgcatccccatcacatcccctcactcatagtcgctgacccaaccgcctttgaggagtccttctccttgtacaggaggctcagggtcttgttcagggacgctctgaaaatcgcgtcggcctttcccacggtcatccccctgtccgacttcttgtcctcgggcttctcgtagcgctcggcgaagagggacggtgcgcattcgcggaggtagcccccctccaggaagagcagcttatttctaatttccgcgcgccattcgatgcagtactcgtcgatgacggtgtcgccgtcgtccgggaagtgcgcgatcctgtccctgcagaggtggtcgatctccccgaaggcctgcacgcgaacgtaggatgacttgaccctagccttgtccttcgcgctcttgtctcccgacgccctctggacgtttcgcacgaacctgacgagcagctccaccgcctcgtccgcctgcgcaattaccttcaaggaactcaagcacgctcgcgaatcatgacgcaggagggcactgctgacgtccaggacgtcgtcgaccccgtcctcgaacacgctcgactgcgtcccgtagctcatcccctgggcgtggatggcgacgtacggtagggtctccctcggcaggatgtcctcctcctgaaggagctcgacccagcgcaccacgcccggacgacaatccttgcccccttcctccttggcgacgagcgcggaaaggccacgccatatggcgcgctcggaatcatgcaccctcggcatgagaggaacggagggaaggccgagcttcttctgctgcgcctcgctcttcctccaagcggtcatcggttcggcatcggtgccattgacgatggagggaatgtccccgtagcagctgaccacacccaccacgcgctgtccggtctcgtcgaagacgagcctcatccttctgctctgccacgtaaatgcactcacggggtcctctgggttgccagttgtcgcaggaacgaggtccgggatagtctcttccgtctcccacgagggaatgcccgcggcgttcccacagatgaggtgaccgttcttccgcttctcgtcgaagagcacccagttgagcatcagggtctggaagaggttctctccctccaggaaaactcctccctcggcacccagcagccccgtcccgaccgaacccttgggcgcatacaccttcccgctcttgacgtggctgttccccaccaccggtgtcttgattccggcgggggcataactctgctggaagatgagccagcggactccctcggcaagcgaaagatccgagatcgcccctctcgccctcatcgagaacaggaacttctccggcttcgggacatccgccaccagctcgtcgacaccgtccggttccttccccacatactcaagatcaggaacctgatagaaggggtgcgagggatcgtccagccagaagcgatcgctgaagtgctccaggtaccccctgatgcaatccatgtcgaacttgcccgcagtccagagactgtgccagagatcaagaacatccttcttgctcagcacgcccccatctgcgtccgaaggcgagtccgctcgatacagaatcgccagcagcagtcgcacaatgggaagctcctgcatcggaacgtccccctggatccttcggatgctcgctgccccgtcaaagacgtcgacaatcgagagctcccctctgcttccatccaggtagatgactggtatccaagggtcagttgcgacgctgaacgccactctcgcgtccgtctcgtccattcttcctccctccgattaacgcccgacgtatccaacccccgcaaatgcggggaacacacgaacccgtccacgaactacgggtcatcccccagaaaacttccatctcaaacctcaaacgggggatacgttcctcctttctctcaaggtttactctatatgaactagtttgtgtttgggttagtatagcgacgaatggtcgataaaccgtcgcgacgggtgtatcgaagctcatttccaaggacagtcgccccgaacgacccatcacccatctctctcatgggaagcagaagcctcccggcaagccaaggggactcctgccaggctccgacgtacctcccgcacttctcctcgagttcctctatgcactcgtcctcgagggagacaggacatgctgagagaggaagcctgacggcacattgggcgatgagccgcgccaatgccgggcggggctcctcgtacgttggaatctcctcccctgccccgactcccgaatacgacacccagggcaggagcgagatcccccctccgtcgcactccctcacgagaaggacctcgatagactcctgcgtgtctcgaacggcacgctggccacgatcctcgtcccctctcacctggttgtgggaagcaagggatgacagacgtgactgatcgcgaacgagctcatcgactttagagagcaggtacgtattcgccttattttccttttcatcctccttggcgctcctcgcctcgcaatccctctcgtacttctcacgccagcgctcggggatatgcgacgtgatttcttcaggagagtaggcggttctcacgaggcgggggatatcgttgggaagggagacttccgtcctcgaaccagcatcgacgagtccgagaactgcgagcgattccagaatcggagcttcctggtatacaaacgcgatgctcttggagacactggggacgccgtccatccactcctcgatgccacggatgaagcactctgccgagcggagcttctcgggacggctcgactccccctctcccctctggtgcctgtgcatccttcccaacctctgcatcagcaggtcaattggggcgacatcggtcaccagcacgtcgaaatcgatgtcgagcgactgctcgaggacctgagtgccaacgacgatggagagctcgggtcgcctgccattctcccgcgtcgcgtctcgcccaagccgagccctcagctccttttcgttctccatcctgtctaggtccatgaacctggagtggtcgagcgagacgacgtccctcccgaacgagcttgaaagcgccgctgcagcctcctgcgccctcgagaccgtatcgcagatgaccccagcgcaaccacctccggagagcctctcggagagaagcgacgccaacgtgtccagcccgtcgtcgatgagcgagagcgcaacgttcactccacgaccggacgcctcggcctcaagcgtcttcaccgttgtgccatcggtataggtgatcaggggataggcatccaatctcgcctcgggaacgagcggcgcatcacctcgctgcgtcggagacggaacgccagtgaacttcttcctaggctcagacaggtacgctgggacgaaccttcttttcggcggattggaagcgttcggttttgtaaggctctccgacgccttccaaccgcacaggtaccagtcggccatcttcctgcgaaggtcgcttgaaagcgtcgcggagaggagaatgacgggcgtatgccagtagccgagccattggaggaccctgaagaggtactggcgcatgtagaggtcgtaggcatggcactcgtcgatgatcacgatcttgcccgctattgagagctgcctgagcggcaggtgcctcatgtcgagcgctgccatcaggacctggtcaacggtgcagaccacgaagttcgagagcattcccttcttgcggccgaacatccagtccgacgcgacgacgcgctcttgaacggagagactcgcgacctcccccaaccgctcggcagacgccacggagttgaggctgccttccttactcgcatggacgatgccctggaacttctcgttgagctgcgcctttccgtgagcgaggtagatgctcttctcgggaatccccgggtcttgcggaaggcgctcgagccagtattcgaccctcgcgaacatcgcatccgtcgtcgccatggtgggaagcgcgatgcagacgcctgccgcgccggcacgaacggcaaggacctccgccgccgcaagggcgccctccgtcttcccctcgcccatcggggcttcgatggtgatcagacctggcatcctcgtctcgagcgcgacgcgcatcgcggcactctggactggacggggagatgcaccggcaggaagcgagaagcgcttggagaagaactcgtcgaatggcctcacctccggcatcggctccctccaggcgggggtgagggagacgtgatgccagccggcggattcgcggtcatcgaagtcgatttgcctctcccccgcatccatgagctggacgaggggatagaagtcctcgtcgctcgcaatccagtcgcacatggtgacgaggccagttaccaggcatgccgttgctgcggggagcgggacggaggatagcttccgcagatccgagtcggttagccccgagattgcgagacagaaacgaatcagctcctcctgaaccttgggccagtcgcccacgccgccatccgcgctgccaatcgcaaccctgttgctgacgtccatgtcgaagccgacaatgtcttggaagttcccgtggtgggcaccaacgacatcggcataggagagggcaacactcctcttccagccaatgtcttggaggaacttggcgagaaggtactcccccgcgacggggtgcgttggcttgcttctattcccaaggtcatgccgcacgggcagaccagcatgctcgaccatccacacgaggccaccaccgctggcaccgaagtgagggtgaatgcccttcgcctggaagatgggagtcgccttaccgatgtcatggacgctgccgaggaagatgcagacgcgtctcgcaagaccctggtccccacccagaggatgagaaattgccttcctcaggcactcggaaagccactcgtcccagagatgcgaaatgacagaggccgagtcggccatgtgaacgtagagcgggagccattcctcgccaaccccgtagtcagacttcccccagatcgcccgagcctgtctcgagaggcccttggcttcctctgccagcgacatcttgcccacccctttgagacgagaggctgcgacgcagcgctttatactcccgtttaggctcgctcataccccggacaaaaatgggtcctcctcgacgtgtggcgacaatttctctcccattggcgtttttttgtgtctcaatcgccgtgggtggcggagcttagctcgtttgaaacccaaaacgcatcgcccggaggcaaggtcgaaccccttgcccccgggcgtctcgtgcgattggttgtcgagcctcaaactacgccaacgcaggctcccccgcgccgacgggaacgtcgttcacgagcttgaacagctggtccctctccccattgaggaagtggacgatgttctggcacggaataacctgcacgtcgcgcatcgacgcggtcgaatagaacgccgagtgcggggtgatgatcacgttatccctccccaccagtggatgatttgctaggtcgggcgtctcgtcgtagaggacatcggcaccaaacgcccggatggtaccatcgtcgagtgccttgacgagcgccccctcgtccaccgcaagcccccttccgaggttgatgaggatcgggttccgccgcatctttgagaacgcatccgcatcgaagaagaaccggttgctgtccgtcaggcacatgtggttcacgatgatgtcggcactcgcgaacagctcgcccctgtcggttacgcgctccacgcccaggcgctcgaactcctcgtccgtgacgtaggggtcgtatgcgatgatcttcttaaccaggccggacgccttcctcgcagtgcacctcccaatcttcccaaagccgacgatgcccagcgtctggtcctgcatcctggggtactccggggcggcggcaaagtcccacacgtgctcgtcctcgatctgcctcgtatagaacttgaggtgcttgttgagcgcgaacatgtaggcgatggcgctctccgagacgtcccaggtgcagtactctcctaccgggcacacccccaccccgtgccgagtcgccgcgtccaggtccacgttgtcgtatcccgtagcgttaattgcaatgaccttgaggtttggcgcgcgctcaaacgactcctcgtccatcgggacaaacgccgtgagaagggcgtcagcatcggagagaagctctaggaactctcctctctcgttgtcgtcatacgggtggacaacgacctcaagcccgtctcctaggccccttttcagggtctcgacctcgagggagtggtcgggcatcatgctctccggatagtcgcagatgagtaccttcatggtgttttggctcccctcttgcggaagaggggcggcggcccagcagagtgccgtcgccccagatagccacttacgcgtttcgctgcagttcccgcgccatcccttattacggacgctcgatgggctgcgtcaggcagtgcgggccaccgccggcgtgcagaatctggtcaaagggcacgtcgatgacctcgaggcccaaggcgcgcattttgtcgttgatgtgcttgttcttctcgattgcaacgaccttgccgtcacctatgcactcgacgttgcagccatgcttgtacatgtcctcggaggcgacggggatgatctcgaagttgcggcgcttgagcatctggatgaagttgtagggcagctcgtccaggcaggcgagggcaacctgcggggcaacgatgttgaagaccatgtccaagtgcaggttgtagggagggcagggaacgcccaccacggtgtagccgtacttctggagctggtccctgaggttggcgacacccgcctcgtccgtgcggtcgaccatgccaaacgcgagcgtgtgctcgtcgaccatccagaagtcgcctccctcgaagcacccggcgttgcaacgcgcgatgatggggacgcccatctccttgagcttctgctcgtacgccacggcctccacctggcggacggggtggcggaagtggcccatgattgcgccctcgcgaaccatcgcgccgtagtcgcgggcaaaggtcatgacctggaactcgggctttgcctcgacctcaacgacctcgatgccgttgtcgcggtatgcctggacgagcgtctcccactcgcggaccatgacgtcgttcttctcggtgtcgcccttgcgcatccactccgaggtgatcacgttgatgccgttgaacgtgtagtacttgggcgagcagaccatgaccttcttgaggacgttcgtcgcgttggtgacgtagaccttctcatcggtagacatagatggcacatcccttctgttagtgttcaattgccgcatggggccgaccccatgcgattggggttgttgcggttgtagttgcagttgtctgactgggctcaaactggcgccgtcttcgtggggttaccccaggaagaccccgacgaccaggaaggcacagcaggtcacgaagaagatcccgaggatcgggaggatcctcctgacccagtccgcgtagctcatgtgggcggcggacgtgcaggtcatgaccacgactgaggcgggggtcaccatcttcgccatgccaagcgccatgcacatgatggtcaccatgagactggggttaacgccggcaaaccttgcgagcgacgccataatcgccatcgtcgccgcggccatgcccgtggaactggggatgaagcaggcaagaactaagtagaaggcaagggagacgatcacgaagaccacggggggcagggcggcaagggtcgtctctcccagatggagaatcgtgggggtgatgccgcccgcatccatgaccacctggatgccgcgcgccatggggaccacgaacgcggtgggaacaaggcctgccgcacccttcatgacgatgtcgacgatacggtcgatgtcatagcccatcacgaagccgatggcgatggtggcgacgaggacgagcatgctgagctcgttgaagtaccagctgccaaacggcgtgatgtcctgccccaggaccatcccgaggaccgggacgcccgcgaggaagtcgaggaagtcggagaagaacgtccagctctcgctgatcgaggtccaggggatgaacgcaaggaccatgattgcgaacaccgcgatgaacaggccgagcgaaaccttctggcagtggtcaagctcccccgcgccttgggcatccccgccgaactcgcggatgtcctcatccctccggaagtactggacggagagctcggggctgcgctgtaccctatccgcatagcggcagatgatcaggctcgccagtgcgatcagggtgacgagcagcagcgccctgagcaaaagcccgtctcagctggagattcccgcaatacccgaggccacgcccacggagaaggggttcacagtggatgccaggcagccgacctgcgtgccgatgaccacgatcatgatggctaccaccgtgtcgagccccagcgagaggatggcggggacgaacatcatgaagtagacgatgccctcctcgtaggcaccttcgaccgtcccgaagaacgccatgaccgcaaccaggatggtgatgaggagatgggcgttggaggcgttcttggcggttatccccttgagggcgaggctgatcgcccccgtgttgtccatcatctcgaggaagctgccaaagaacatgatggtgagcgagattgagattgccgcgctcgtggtctcggaccccaccatgccgatgatcggcgccagaaagacgtcccagatgccctggggattcgcctctaccacatggtaggtccccgcaatcgcctggccggcgtcgtccaggtcgtaggcgccaccgggaacgaaccaggtgaggaccgcgatggcgcagatcaccacgaagagaatcacataggtgttggggctctttcgcttctgtcccgactttgggacggagcccgcacccttggttgcctcagaagccatgtgaacctccttccgatggggctagacgtacggaacgtagaggtcgcccagcgtcgccgccatgaccgccttgatggtgtgcatgcggttctccgcctgttggaactggcgcgcgtgggaggagaagaacacgtcgtccgtgacctccatggcctcgatgccaaactcctccttgatcttggcggcgtagtctgtctcggcgttgtggaacgcgggcaggcagtgcaggaagatccagtcgtcgttcttgatgttgctaacgagctcggcgttgacctggtacgggctcatctggcgcacgcgctccgcgaacttggactcctcgcccatcgcagcccagacgttggtgtacacggcatctgcgtcgcgaaccgcgtcaacggggtcgttggtgacccggatcgtcgcaccgctctccgcggcgagctccatggcaagagagacgatcttcgggtcgggctccagctccttgggcgtggcattgacgtagttgacgccgagaattgccgaagtgatcatgagcgagttctggacgttgttcctcccctgtccgcaataggcgagcgtgatgccgtccagcgtcccaaagttctccttgatggtcatgaagtcggcaagcatttgcgtgggatgctcccggtcggtcaggccgttccagacgggcacgccggagtaggtggcgaggagctcgacgtgctcctgcttgaagccacggaactcgatgccatcgaacatgctgcccagcaccttcgcggtgtccaggaccgtctccttgttgcccaactggatgtcgttcttccccaggtattcggggtgggcaccaaggtcgattgccgccgtggtgaaggcagcgcgagttcgcgtggacgtcttctcgaagaggagggctatgttcttgccctcgaggtagtgatgggggacgttacgcctcttcaagtccttgagatgctccgcaaagccgatgagccacatgagctcgtcctttgagaagtccctggtggagaggaggtgcctcccctgaaataccgaacccgtcatcaaaagcccctctcaatctgtacttgcaaggcttgtcccgacggacgccgacagtctgacggcccctccagacggacaggttcgggaggggtgcgcgccgccccatccctgacgattcgaagtctacgggggaggcgggcagattcacatggctgttccgccaagccgagagaggggcgtttgtcagaaagtgaaaaccaacgcgtagctttgccagtcacggaaagggttcttgacaagtgtgaaaagcgcaagaaagggaagagggtcagagcgattcggccaggatgccaaccccatggtgttgggaatccctcgttcggtaccggtccaccaccgggatggtgacaggagcccacaacgccactctgccacgggatgccaatccatccgaaggctggcttatcgtgcggactcgtctagcctttcgatgccctctgccagctcgtcacgcccctgagcccccagggacatcaagctcgcgatgacaaggagtcgcctatctgtcagttcctcgtctcctacgagggctttgatcttcttgagccggtacctgatggtgtttggatgctggaacatggcctgcgccgtggcgccgacctctcccccgcacctcacaaacgccctgacggtttctgcgagttccgtcccgttcttctcgtcgtaggcgccgatgcgcgaccacatcgtcgccgcagcgcgggcaagtaaggcatcgtcgcgagccgcagcagagagggcatcctcgccaaggtcatcccagcgaacccagcgcctctccttcctcgctgcgaagtcgcaggcggccatcgcctcacggaggcagaggtccccacgggagacggggaggcattcgctcgacccgcacagcacgctgccactcaatgtgattgcctctctcacctcaccaaggacagggtcattctcgtcagcgcgagggacatcgacttcctgggacagggacaccgcgcagacgattctgcgctcgcttctgaccacggttgccgctgtcacctgcggaagtgactttgcaacacggtcaagggcacgttgcatggacgaaatggtcgccagaagcgagagcgagtctcccccgcgcggctctgcaacgacgaaccagacgcgaggccccggtgcgccaaagatcgagagtgcctgcgaacagacctcctcgtcacttctcggacgaaggaactgcctgatctgaggggtcttgtccaatacctcgctgtccttgcggatgaggtcgagagcctggtaggcaacctcctcgtgataggcgccgtcgtagaggaacaccggaacgccctcgcgagagctctcatccctaacggcatccgtgatgatcgggtcatacaccgtcttgatggcaacaccagcaacgtgacggtcaatcagggtgatgagcgacctctcggagagccgctcatccccactcgcaaagccaaggttcgtcaggatgagctcgcccgggaagtagtttgagtacccgttgaggtcgggagggcagtcgaggattcccacgttacggaccgaacggcgaccggctccctcgcacggggcgatgatgtgcacgtccttgaaggcgggaagcgccagcacatcagcaatagttaccatgcttgccctctcgccgatagcacgtagttaaggagacagtctacgcgcggggcagcttgccaaccccgatttcgtggcaggtttctcggcaagcggtcctaccaagtcgtgaactttgcgttgctcgggttccagtgaacgtcgcgaatgaagtcgctcagttcgtctgcgctccccttttcgaagagctccacgatcttcctgtgctcgtcattggccttcccgacgagcttctgcgcctcttccctgctcacctgcgcatagtcgtgccgtatgaagtgacgattgagctgggcaaagagctgatgcagccgctcgttcccgcatcggctgacatagtattcgtgaaacttcctctgcagctcgtcgtagttgttcagcattccctggccgagggccaagtccatcgactcgatgaggaaccgcagctccttgtaatccttctgcacgagaagtgggctcgcaagccgggccgcctggccatcaagcggaccgatgatctcgaatatctctcgcgcggaatcttcgtcgaatcccttgaccctaaaccccttgcgcggctcgttttcgagatagccgtcgctcgccagctggataagcgcctctcgcacgggggtatgcgacacgccgatggcgtcgcagaccgattgttcgctgatgcggtcgcccgccgacatctttccctgatttatgaggtccgcgatgtaatcgtagacgtggtccttgagggacttgtacttctccatggcgcaaactcccgaggtaacgacttagttacccacatgctaacggttcggccgccccatcgggacggccgaaccacaaacaagtatcgcaacagctacgccgcaggagtcatatgcgaacagggctcagatgattggcatgatgcccgagaagtgcaggtagagagaaaggatggcgaatgcgacaacgacaaccgctatcaccttgtcgcgaaccagcgggaaggcacccttcccacgccccttctcgccaaggtagtagaccaagatcgcaggggcaaacaggatcgtggtgatcatcacgccatggagcccacacgtccacacgaggaagatcgtgtagatgaacgacagcgttccgaagaacctcgccttgccgactgagggcgcgtactttccgtccaggtgttccttcttccagcctattaccatatagtacgcagcggagcagacgtacggaacgagaatcgtgttgaccgcgcacgtatagaagaactggtacgtgctgctcgcatatacggcgacgaggagaaagacctgcatgatcgcagagctgacgaggatggtcgtgatgggagcatcatgcgagttggtctttgcgaacgacttggggaagaccccctgagcggcggcttcataaggggtctctgccgcaatgatcacatagcccaggagggcgccggcaagcgagaggatgacgccgaggttcacgatcgctgccccgacgggcccgattgcgtagctgagcacccccgccatcgagggagtcgcaagctctgccatctgggcgcgcggcatgactcccaggctcagcatcgaaatgatgaagtagaggacgaaaacgcaggtaaagcctatcgcggtcgaacgtccaacatccttcacgtacttggcgcggccggagatgacaaccgcgccctcgatgcccgtgaatacccacacgagggcaatcatcgtagagacaacttgcgtgccaaggtcggggccacccggctcgccccagaagttgtccatgaagacgctggggttgaacttgcccaggaggatgatggagagcacgaacatggcaagggggacaagttttgccagcgtgacgatcacgttgatgcccgtggcctccttaacccctcgggagacgagcagcgtcagaagccagaggacgacggacgcgcagatcaccgataccaggttgttcccgtctccaaacacaggaaagaagaacccgagagacccaaagagcatgagcatgaagctcacgttggaaaggcaggcactgatccagtatccccatgccgagttgaagccgacgtagtccccaaagcccgccgcggcataggcgtagattccaccggtaagctctggccttgcctgggacaggccctgaaaggcctgcatgagtgcgaaaacgccgacgaagcagatgacccagctgatgattaccgcaccggtactcgccccgcctgccgccaagtcacccgcaagcgagaagatgcccgcgcaaatggtggcggtgatgaccatcatggtcagccggaacagcccgagcccattggggtcgatcacatcctcgtttgccatcttcgttccaggggcttgctccctatcgattgcagcttccatttcacacccctctcatagcgagggggcgcgagccgaagtagtctcgcgccccctccaaacaggcaaaccgtctagaagcgcagggagagacaggagagtccgccatcgatcttgcggtactccgaggtatcgaccaccagcgttttgtagccaaggtcctggaccgccttcaggacggtcggatatccctcggcgacgatcaccgtgtcgttgacccagatgcagttggcgccataggcctcctcctcgggaacgacgatcttgttgtagtctgcgaagtcgggcttatcgatgaactcccctgagacgagcatgttgttgttctcgatgtagttgacgccggtcttgaggtgaaggaccttctcaagcggcacctcactgacctcgaggccccatccattcaggatcttggtgaattgacggatgccttcctcgttagtacgggcagagcgcccaacgtagaagtggtcgccgaccatcatcacgtcgccaccctcaagggtgccaggaccctcgatgtgtgcgatgtgatcgtcgtcaaagaacctgcggacaatgggctcaatctcggtcttctctccgttcctggactttgctccgggattcgtgatcacggcgccgcagcgggtaatgactgcaggatcctcaacgaagcagctgtcgggatactcctcgagggcgggaagcaccgtgatgtccacatcgcacctgctgagggcatcgatgtaatcgttgtgctcctcgatggcacgcttgtagtccggctttcccagctctggcgcagacgtgattccgtccaacagagaatgtgcaggacggcgaacgataacgtgactgaacttcttcatgtgcttctccttctgatgctctcgccttacttgggcgcctcttcctgacgacaatcactatacattgtggattgtgcataatccataatttgtgccgaatggtagccatttggtcacgagcgcgacatatggcaaggtcagtcactggagatgcgctctctacatccccgctaccttgcacatcggtagcaatgcatttgcctctacctcgtatttagaacatgtgtacttattcttgagaagctgatggcgtgccgtcccctggaggcggctgttacactgaaaagacaacgcgactgacgagaggaggggctcatgcaggacgcaaaagatgtggcggcgtacattctgaccgagcgaggtcggctgacgggatggcaactccagaagcttctctattactgccaggcatggagcctcgcctttaacggagagaggctcttcccccaggagattctcgcgtgggatcacggtcccgtggtaccagaagtcttccaagaccacgcgggcgcttactcaatcgtgtccaccgacataataggggatgcctccaacgtcgacgttcgctattccgccctcattgacgcagtcgtggactcgtacggagaccttagcggagaagagcttgaggaaatctcccattccgaagacccatggcagaacgcatacgtcggcttcagctcgctacgctctcccgaaattacttgtgactcgatgaggaagtactactcctggctgctgacccgaagcgcagcggagcgtagggcacatcatgttccaaggttcacgtgcccaaacaaggtcagcgtctctgacgagacgttcgattggctcgcaagcatttcgtagtcaaccttgctggagcatgcattgggagagttggttgccgacatcgttgggctactcgaactcggagacaaggcagagtccctcgtctccgagttctcttgcacggaggaaagcctgaccagatggttccgtgaaagcgccttacgctggcagaagtctgacatgtgccgcgtgttcgtcggcctggacagcaatggatcgattgtcggcttctactccctgtccactgctacgatctgcaggacaggggtatctcgcagcagcacttccggcataggcagcagcgagtttcccgccgcactcattggaaggctcgccgttcgtgatgactccgtccacatgggtataggctcggttctgctcgaacacgccatcagtagctgtatctcgatttcagaggacattggcatcaagttcatagtcgtggacccaaaagatggggtatcggcttggtatgggcgctttggccttaggaactccccagatgggcgggatacaaggatgtatcttcccgtcaaagccgcgagggcacgtcttaactgatgcgggagtagccgtagtcgctctcgcatgaattatctaaccatgacaggaactcgctcgtatgagtgctcacgcggggcttccgctgccagtcggctgtcgcccgcgctgccagtgggaggggctacggcaaaggcgccacgcccctctccttcagtcgccatcagaatggattggtttcattgggctcaacctcccggcgcttccagaacgtctggcgccaggttatggcccatcgacgaatgtgttactcccctcacatagccctccgctcatcgaaagcacctgcggggtgtatgcagcctcaaatacactccttgatgaatttaaggtttcatttaggaggttaacgtgcgaaaaggaatcttggccggcatcgtgagcgtcgttgcggcggtacttgtatgcctcggtctctctgcctgcgccgacactaatgggaagtctggtgactcggccaaccaggaggtggtttcaaaggaggaggcaatgaaagtcatctccgcggggctggagaagcgctgggcgataaacgaccagtacgattcggcaacggaccaggacgccatcgttgagggactgaagaaggccatccaggccgagattgacaatgacagccaactcaagtccgcaaaatttgatgactcaaagctgcaggagacggtcctctcctacctcaactgcctcgacgactcgatgaaggaaatcaaggagcacggctacgacacccaggagtattacgatgcatggactgaggcgtataacagcagatcagcgcttttaaagaccatgaaggatgactatggtctaaccgtctccaagaattatgagtccaccctcgacgaactcgtcgcaaatgggaacgacgtccaggcaaacgacaaggccgagaaggctataaacgggctgttcgcgaacgtgaagttcgagcagacagacgacggatacggcaactacacctactccgcaacggtcaagaacacctctgacctgagctttgagaacgtcagcctcgtcctcggcctctacgattccgacggcgtgcgccaaggggagtcgtacgtaagcgcgaacacctgggcggcaggcgagaccgtgaagttcgagggctacggcaccatcaacgcggcacagattaaggtcgaaatcaactactacgaggtcgcgaagtagcgacgcgcgggcttaatgctccagggaacaacaggttagatgaaagtggccctccccgcccgggcgatcggggagggccatccgcttgtacgtatactgccaggtgcaggagaggcgagcagtgcatccacgggcggcaacaaccgtgtcgggcagagggtggcgcctctcccctatctaatggcctgagggatggagaccctactccgccgtctggcgccccgccatcaccatcggataacttgcgccgtctaacagccgcagcgggccatgttcttgagcctggacccacggacgacttcgaggtcatctggtcattagggtcaaagtaggcactccaccatccaagacgagcgacacaaaaatgaccccgaccccgcgcacatgcacgaaggtcggggcatctgttgccctatcccaaatcgccgacagagaccaaaggtcgcgaagcgtgacgacctacagcccgaacacggcgcacaccgcgatagagacaacgatgatgagcaggagaatccacgtcgcagaaaggcgcttcttccccagaagccaatacatgaggccgaacaatcccagctggggcaggcagggcatgatgtcgttcaggtagtccatgaacggctttgcaaagtcacccgatcccaccacgagcgggatgtcaatcgagacgtagctcgcggtcatcgcgccgatggcggcaagcccaacgatggaggcaacgtacgtgaccctctgcatcacaccgctcttctcggcatctgtgatgaacgaggcgccgttctcgtatccccacttgagcccgaagtagcgaagcaggaaccccggcacgttgaacacgaggaggaagaggagaggtccgagccagcttccctgctggcagaaccctatggcgatgcccgtcgcaatgattcgaagcgttccggggatcatcgagtcaccgattcccgccagcggccccataagcgaggtcttgatggcggcgatcgtggagccgtcgaagtcgtccctgttggcgtcctgctcctgcatggccgcgtcgatgcccatgagacacctggggggttatcgccatgaagtccagcccgcaatggtggagtttgacgatcggttccgcatcgtgcgagctgacagtacgcaatcggaaagccttgtctgcaagcgcagccatcccctactggaggtcagtcagagggttcgggacggaaagggagagctcctctacatcaaccagcaactcatcgtcaccgagaagtacgtatacgccgtgaggagctctcactaggcggctgccttgacgccattaggacttaccggcaaagccgcgtccatcatcgatttgcttagaagcagaatgggcctgacccgtcacggcgttaaccgcgacgggtcaggcttggtaccttcaggatatgggaaacgctacttgagggtcgcgtacatcacggccttgatggtgtgcatgcgattctcggcctcgtcaaacacgcgggactgcttcccctcgaacacggagtcctgcacctccatctccttcacgccaaagtgcttggcgatatcggcaccgatggtggtgttcgtgtcgtggaaggacggcaggcagtgcatgaagatcgcatcggggttggccttctccatgacccgctcggtgacctggaacggcttgagctgcttgatgcgcaggtcccagagctcctttggctgaccgagtccaacccagacatcggtgtagatgacgtccgcgccttcggtcgcccgatcgatatcctccgtcacctcaagcgtcgccccggtctcggcggctatcccctggcacttctcccagatccaggggcgataggtcctgttcccctccatctgaccctggggaccgcactgggtgaagtcgattcccagctttgcgcaaatcacggcaagcgagtcggccgtgtttccaacctgccccatgaacacgaccttacgccccttgaggtctggcccaaacgcctccctcattgtcatgatgtccgccagcgcctgcgttggatggaactcgttcgtgaggccgttccagacgacgacgcctgacttctcggcgagctcctccaccttctcctgctcgaagcctcggtactcgatgccgtcgaacatgcggccgaggacgcgagccgtgtcggcgatggactccttgtgaccgagctgcgacccagtgggatcgaggtaggtcactcccatgccgaggtcgtacgccccgacctcgaacgcgcagcgagtcctggtcgaggtcttctcgaagatgagggcgacgttcttgccctcgaggtagcggtggggcacaccggcgcgcttcatgttcttgaagtcacgggagaggtccagcaggtaggtaatctcctccggcgagtagtcgaacagcttgaggaagctgcgaccgcagatgttgacacccatgtgttcttcctttcgatagagcgtggacggggattcaggcgagcggcctaggtttctctgcgacccgtgccgtcgtgtccctgctagatttcgtcacggacgaatggcatgctcatgcagcgagggccgccgcgcccacgggagagctcttcggaggggatggtcacaagctcaacgcccgccttgtacagctcgtcgttcgtcacgacgttcctctcgtagacgcacgccacgccgggggcgagggcaagcgtgttggacccatcgttccactgctcgcgcgatgcctcgaccggatcaccgccgccgcactcaatcagctgaactgagctctggccagtcgctcgcgcgagcacgtttgcgaggctgtcgtcaatctcctcggtcatcacctggcccttgacagcccccttggtgagtcggaacacccgcatggagtcgtatatcccgggatagacggtgaacttgtcatagtcgacctgcgtgcacacggtgtcgagatgcatgtaggcgtacccatgcgggatgttgatcgcaaaaatctgctcgatctctgactcaccgggtccccagaagatgttgtgggcgagtgcatcaatcgccccagatgaggtgcgctccgagagtccgattgcaagcgtgtgggcattgatgttgagcacgtctcccccctcaatccaatagggaagatcatgcgagtaccagaggggggtctccctgtactcaggatgaaacttgaaaatcgcctcgtacagaatcacttcgcgatcacgctggaagtggaacatgtgatgaagcagcacaccgtgcccgacgctcgccatggggtctcgggtgaaatagctcgcggggaggggcagcagcactaggtcatccggcttcgtgacctttccatctgccagcagcatcggagagacccccttcgggagttccaagtctcgcaggtagaggcctcccatatacgtctgaacgagctcacttccgcctgaagccgactcgagtcgctctcgagtagcctgtcgcagaaccggaagggtgatgtgggactccgctatgactcgatcaatgaaccatgccttgacgctagggtctgagtcgattgcctgggcggcaagatcctccagatatacaacctcggttccacggtcgcgaagcttctgggcgaacgcgtcgtgctccctctgcgcatagtcgaggtagaagcagtcatggatccaaacgttatcgaagtcctccgccttgttgttcaccaagtcccttccgggccgatgcagaaggaccttcttcaaggcaccaatctccgagtggacactgatgggattatcgttcatttcgtttcaatacctttctcacctgtcggctttcgccgagcttctactatgcagggatgacgcctgaaatcgcggtgaaggcaatgcagagcactgtaatgaggagcatgaacttccagcaggtcttccaccactgtccaaggtcgatcttgcagactccgagtcccgccacgagaatcgcgctggtggggcagacgatgcacatgaggggctcggcaagtgatagcgccgtaaccgccgcctcaggattcaaccccatgagctctgtgagcggcccaaagatgggcatggtgagcgcggcgagaccagaggatgagggaacgaggatcgtgaggaatccctcgacgaggaacatcagagtggtgtagattcccgcggggacgccagccatgccgttcgcgaggaagttcaggatggtgtcgatgatcatcccgttgttcgcgataacgaggatgcccttcgcgaggccaacaacgatggcagagaaggcgaagtctgcaaggcccttaacgaactcctcggcaatctcgcgcgagctcatcccgtcgacgacgccggagaggatgccagccgcaaggaacactgcggagagctcgaccatgtaccagccctgcgtcacgaggccccagacgatgatgacgattgccgcggcaaaaatgccgagaacgaaccgctgacgccccgagaaactcacgtccagggcgccgtcagccgcctggaactccttgcacttctcgatgtcatcgtgatacgtgatggagctctcggggttggcgcgcaccttgcgagcgtaccttactacccagacgacggtgatggcggtgaggatgacccactcgatggtacgcagccagagctgtgggttaccctgaagtccaatgatgccctgcgcaatgaggacgctgaacgggttaaccgtggaacccacgtacccgatgcgcgcggacatgaacacgaccatgaacgcggtcatggagtcaaaccccatgctcatcatgatgggcatgaatatcgcgaagaacggaagcgtctcctcggccatgccgaacgtggacccaccgagcgagaacaggatcatcacgatggggatgatgaggatgtccttgtccttgaacctcttgatgacactactcatcccagcggtaatcgcaccagtcttcgtgatgatctggaacgatccgcccacgatcaggatgaatcccacgacctcgacagcgctctcgattccgaggagcggcgcctcgaacagctgggggattccctggcgaaggtccgttgtctcgccgtcagcctccgataccttcgggacctcttcgtatgtacccgcgacggtgacttcgcgtccgttgacctccttggtcttgtaggcgccagagggaatgacccacgtcagcaacgccatgatcgccatgagggcgaatatgatcacgtagacatggggtactctcattgccttcctcggcttcttctcctttttctcagcttccatgttcgcaacctttctcccgtggaatacgtgcgaataggctcctttgggacgagacaattctgcgagggcttgagcggccatccgtgcaaggcaggcctcggcgttgcactttgcaccatgagtgggaatctgatgatgtatgacgtcactttctagttaatccatattgatgtttcacgtcatttcccatgctcgatgcagagggcgatcctcctccacctacaatccagccttgagcagcatgggaggagaagacgtgagcggcatttccgtaccaaacgacatcggcaagcttcgcagggtgctggtgcatgcacccggcagggagagcgccgaacactctacgagctccttcgaccaagtgttcttcatccgggccgcgtttggcaagcgctcctttgacttcgaccgagcctgcgaggagcacgaagccctcgtttccgtgctccaggagcatggcgtcgaggtgctctccctcgaagaccttctcgcccaggcaatcgatggctccccagaagcacgccaggcattcatcaacggctatgttgacgagtgcggggtgcaggggatggagcttcgcggagcagttcgcaggtgtctggaggagaaggagaccggaacggagcttgtcaacaaggcgctcacgggggtcacgtacggggagaccgacctgggtggcaccgagtcccttgccgagtgccttggtgcctcctacgacgacgaagccgtcttggcaggcccgttcagcaccatgttctttacaaaggaccccatcgccacggttaatgatggcgcagtggcatgcaacatgtactggaacgaccgcgccagggagacgctcctctacaaaacggtgttctcgtttcaccctgccttcgcgggaacgaaaatctggctcagagacaggagctcgtatcacatcgagggcggtgacgtcgcgaaccttgggtcgggctcgctcatggttggcatttccgatcgaaccgaagccgccgcggttgacagcctggcgagagagctcctctggtccgagtcgggaatagatagggtgttcgccgtgcccgttcgctcccaacggcgccgcatccacctggacacgtacatctcgagggtggacgcagacaagttcgttgtcgaccccggctttgagcgcgacttccggtcatacgaaattgcaagggggcgaagggaaggcatcctgaccgtatcggaaagtgacgagtcgcttcggcagctcctctcccgcgcgaccaggataggccaatgcaccctaatctccccccaggacacgctcagctccgaatgggagatcgaggacagctccccctcggtgctctgcatcgagccgggggtgtgctgcgcccgagcgggtaacaacaatacgaacgaggcactcgccgccgcgggcgttgaggtcattgaggttaccctcgaggagctcacctatggatttggcggaccaaacagcctcgtcctcccactttggagagacgagtagcttcccatgggggtcggcaggaacataagaaggctcagggagttgaagcacgtctcgcaggcagagctcgccgaggcgctaggcgtctctaaggagacggtgagcagatgggagaatggcaggatcgcaatcaggaggcgccacatcgacaagatgtgcgagctctacggcgtacggtcggatgacatcacgagcgagtcgcacgggctggcttcggaaaccgtcaccgttcgcgactccaccgccgcgtctcggtccgatggcctccccgtatacaggatcgtaaacgggccaacgggaatgtcactcaaggagacactgccggcgcatgccccccgaacagtcgaggttcgtcatcccgactccgtcttcctcgtggttccaagcacggagatttgcaaggtatgcccaccgggcgacatcgtgttggtggacccctacgtaaagccctggaatggctgtatcgtcgcagcggtcatcgaccgagccaccattcttatcagacgctacgcaagcggaagcagcatgataatgctctccactcactcatacgtcgactcagcccctgacgtcgtgttggaccaacgtcgcatcagaatcctcggaaccgttgtctggcaccaggcgcagcgtgacgctgataccacgtaatgagccccgaggcatcgtctcaccagctcaaaacccccgcaattcccaaggacgaggtcgcgtgatgaaacatttcctcctggactcaaacgtcttcatcacgagcgaacacctgctctattcaggaacgtccggccgtcgccaatcaagccgaaaggccgcaccgagctcgcaggtccgcaatcccgcgctgtcgacaaaacgagggccccggccccgcgcatgcgcgcgagggtcgggaccctctgctgccagcgtgtagagcacggcgagccggaagccagtcgactctctcctagcagatccccagcaggccgagcgccaggccaatcaccatggtgcccacgatgagccacgtgacgttgatgttcttgcgcaggagcttgacgcagcccagggtgtacaggatgggcactagccccttgaagatggtgtcgaggtaggtctggacctgcaccgggtcgccgttgccggcgggaatcgcgatgatgcagttgaacttgacgaacgaagcggtcatcgcgccgatcatgagcaggccgaggatgccggcgagcttggtgatgaggtccatcaggccgccctcctcgagcttcgtgatgaagttcgagcccacgcggtagcccaggacggtcaggcaccagcggcacaggatcgatgggacgttgtagataatcaggaacaccagcggccccagaatcgttccggtctgggcgcacagcgccataccgaccgcagccgcgatgacgcgcaggacgccccagaagatggcgtcgccgataccggacatgggtcccatgagcgatgccttcacggcgtcgatcgactgggtgtcaaagtcggggtgctgggagttctcgcgctccatggccgccaccaggcccatgcagaaggttcccacgttcgacgtgatgttgtaccagctggagtggcgcaccatggcgtcggtcctgcgcttcttgtcgggatagaagcgctcgaacgccggggcgagggcccacaggaatccggacgcgcccgcctttgcgccgccaccgtacatggcgaagatgttgaaggagtggaggaagatgcccttgagcatcttgcggtcctcgcgggagaggtcctttgtcgagacgctgatcttctcggaggcagcatcctccgtggtggccatctcctgctgcggggcattgctctcgttttctgcactcatgcgaagaaatcctcctcttcaatctgatcctgggtctcggcctggacggcgccgccgcccgtgcgcattgcctggagcttcttcttcacgtcgagcaggtcgagctggcggtaggcctccacgaccacgatgaccgcacccagcgctgcgacgccgaccatgggcatgcccaggtacgagacgcagatgaagccgagcaggaagtagacggcgatcttgttgttccagagcatcctgatgagaagtgccatgccgacggcggggagaagccctgccgcggcgttgaagccgttggtgacgacggcggggatgacgttgaccaggttggcgacgggctcggcgccaaagtacacgcccaggaacgtcgggatggccatggcgccgttcatcacgagcgcacccccaaagtgaaccaagaagacgttcttggtctcgccggtgctcgcggcccagtcgatgaggggcgaccagaaggacatgagaacgttgaagatgagggagtagatgatgttggcgaagatggcgacggcggttgccagggtgattgcggcaccctgatccatgcccatgtgcgtcacgaagcagattgccatgaccgttccggtgaccggctccgcggaggtggcgccacccacgttgacgttgccgatgaagatggcctccatcgcggcgccgatgatgatgccggtggtgacgtcgccgaagatcaggccggcgatgaggcccacgcagatgggctggtcgatcatcggctggccaaacgtccattgcacgaagtagcagatgaacgcggcgagaaatgccatcagtgcaagttgcagcatgtgctcattctcctctcggtattcgaagcgacgggactacccgagctttgccagaaggtcggacaccttggtgcgggggtcggtggtccccacctggtgaatcacggggatgccaagctcgcacagcttgcgcgcggcctccaggtcctcggggttgaggttcacgcctgtggtcaggagcaccttctgcgcgtcgtccgagcggtcaaagcgaccggcgttggcaatgttcacgccctgaacgttgtccttgcagttggacgcgacctcgtaggcgtcggcgaccgtctgcgtgagcatgaagatcctcatgtccttgccgcgggggtcgttggcaaccttgatcgagtcctccaccgtgcgaatgagcagcttctgcccctgcgggcacgccatcttgagcgttgccgcctgggtcttgtcgtgcgcggcgtggtcgtttgccaccacgatccccttggtgttgagctccttgccccacagcagcgctacctgcccgtgaatcaagcggtcgtccaccctgatctggacaatcatgtcctctcctctcgactgcgccacccagtggcgcctatcccctgccggcaggtcctgccgacgttttcgcaccttccctatgcgaagaagtctccgtcggagccgtcgtccgcctcttcctcgtccacggcgacgcgttggatgagagacgcgccagtctccacgaccccgtccacgacctctggggtcaggggctcgtccgagagcaggcaacccagcaccgtgatgaggttcacgcccgtcacgtggatgacgccgtagcgctcgggatgcatctgcgtgaccttgttgcacacgctgccgccaaggaggtcggtgaagaccacggcctcgtcaccctcctgcacggagtcgaggaactcctgtatctgcggggtgaagtcggactcgtccaggtagcagtcgacggcggtgatcgcggagtcgtcgtgagtcaggatgccgactgcgctcttgatgccgctggcgacacggccatgcgacgcgatgagaaacttgcgcatcgtcgtccccccctagttcacgaagggctcggcgccgttggcgaagaccctcaccacgtgctcgaacgtgtgaaccaggctctcgtgcgcagcggtggtcatgtcgtgccagtacacgttggcagcagcatcgttggcagtcttctcgtcgatcaccttgcgcaccgcctcgcccgcgtacttcacgccgtaggtgtagtagttgatcttgcgcacgccggcgtcgatggagttgtggtactgctcgtccgtgaggcccgagccgccgtgcatgaccagtggcaccttcacacggtcgcggatgtcggtgagcacctggtagttgaggtgcggctctcccttgtacaggccgtggaccgtgccaaaggagcaggcgagaatgtccagccccgtgcgcgtgacaaagtcctgcgcctggtcggggtcggtgtagatgacgcccgcctcctccgcggttccgccctcgtcgcgctggccggcagcgtaggagcccatcgagcccagctcgcactccaggcccgcatcgtactccgcgcacatctgggcaacatagctcgagagttccacgttcctctcgtatggcagcgcggagccgtcgaacatgacgccggtgaagcccaggtcgagcgcctccctggcgtacgcgaggtcgccgcagtggtccaggttgaagcaaatcatcgcgctggagcgctccgcgaggctggtgacgatgggggcgacgcacttcagcgggatcagcgactcgtgcgcctgggcgtgctggatgatgatcggatagtgcgtctcctccgcgacctcgatggccgcgcggatcgcctccaggctcgccgagttcacggcggcaatggccatgttcttctgctccgcgatctggcagatgtcacgcatgcttacgagcatcggatctcccttccgcctccgacggacgctcgcccgccggcgttctacctgctttctaggtgagaggaacgtgggcgcgcttctcgcgtaatcgcttgctcgcgtttctcgatttgcatctaatcatttctaagcgtttataatcgtttattttcgctcaatggtaccaatatgggcttaagcgtatatttgcgttcatttgctttcgtttgggtagtacagtcacatcaaatggggcgaagcggggctgaccagccccgcacgtcacgccacagggcagtcgcaaggattgaggaaccgtgaacacacagagtcccagccagcgcctcttcctagaggagcgccagcagagaatccagcaaatggtggaggagtcctcgaccatcaccatcgcccagattgtggacacgtttggggtgtcggcagccaccgcccgcaaggacctccgcgagctggaggcgcagggcaaggtgagacgcacccacggcggtgcgatgagcgtggagcccaaccagcacgagctgcgcgcggcaacctcggtggccgtagcgcacgaggagaaggtgcggattgggcgggccgctgcccagctggtggaggacggggacaccttcatcgtgcaggcgggaacgaccaacctggagttcgttcgggccctcaagggcaagcacgggctcacgatcatcaccaacgacacggtgatctcgaccgaggcagactcccttctccccgacagctcggtcatccagcttggcgggcgcatccgcgagggcttccactacaccgaggggatcgtccccacgcgggaggtctcgcagctgatggtacctaccgtatacctgtgcaccaacgcgttctcgtttgagcagggcttcagcacgcaccggcttgagcaggcggagtggctcagccagctgatggcacacaccaagcgtcacgtgattctgctcgactcaacaaagatgggcgtgagcgcggcggtgcaccacaacgacctgacggacttcgacgtgctggtgaccgacgagggcgttccgcgggacatgcgcgcgaggttcgcggaggaggcgcccggcttacgcgtcatctacgcgtgagtgggcgacacatccacaggcggcagcaaccgtgtcgggcaggggatggagtctttcccctgccgcaggcaggggaaatgaagccggggtaccgccatcggtcgtcctgccttcaccatcgggtgacgtatgctgcctagcagccgcagcgagccatgtcctcgagccgagactccacggacgacctcgagaccatccgctttgacccgtcccgccaggactcgagcttccccgacttgcacagttgggcgacccgcgcccggcttaccccgagctcccgcgcggcatccgccgccgtcatcgccgggatgtccgacagatcacgcgagacggcgatcgcgatgacccttccgccatggcgtgcggggtgtccaaacgaaatggggggcatctctcccccgctcatgagtctgtcgtcgacctccatcgtcagccagtccgcggcgctctcgacggcgtcggtcaggtcctcgccaaacgtgccctccgcgtcaaacgtgagcggctcggcgatgatgttgccggacgcggactcccagaactcaaattcgcagacgtacaccatgtaaagtcatccaatccaataatgtgaggggaggtgaaggctcatggagacagacttacctgagcccagcctgtcgcaggatcctcttggcagcctcgccatcaatctccttgtgtcgccttaccatgacagttatcttgccgcgcttgaacttgtcgtggttcgatccgtggaacatcgtgaacccggcttcctcgagaatcctcaccagctcgcgtctctgcatcccgcatcttctcgccttctcgattgccctatcttaccacttgctaatagtgttgtacgtccatatttaacatgtgctaagatctatgcggtaaagtcggacctatgagacgggatgcgccaaagcatcccgccctcctccgtgcatcacttcatgtgcatcgccaggccttgtcatcaaccttgcccggcatcgccttctcaatatcatttttttatattttcggaacgaccagtgcaaggcctcccggcgcgtgtcttgcgcgaggcgcgcggaggagacgcccgacctgtcgcccgcgcatttccccttccccaccattggaacaaggtagaatcggtgtgccgaacgtctcagcccagaccaaaggaccccgatggacgccttcgcgatctacctgcttgcaatcaacgtcgtaacgttcctgctgttcaccatcgactacgtcatcgcggtgcgcaaccgcgacccggacacgggccttatggacgggcgcctgctcagtctgttcgcggttgcgggaggggccatcgggatgcttgcggcgctccttctctgggcgcggaagattgccaagtacaacatcgcctggtggttcacggcgtttgtgtgcctcatcgtctggggtatggtctgtgcggcaaagtgggacctcgtcgacattgacgctggaaggctcctcggcggctggaacacgcagaggctcgccgtcctcggagtctaccttgccgcgatcaatctcgcaaccttctccgcattctgcctggacgagcactacgcggaagcccagcagtggcgcatacgagaatcaacgctgatgggcctctcgcttatgggcggagccctcggcggaatcctcgcaatgcgcctggttcgccacaagaccaaaaagtggtacttcgcactggggcttccgacgttcctggtgctgcacgtggtcgccgtcgcatacgcccacatggcaggcgtcctgtagcaaggcgagaggcacggcgaccgtggcggcggcccacccccacggcttcaagcccttcgcgtcgagcatgccgcccctcccctgccggcaacgatcgcaaagggccgtttctctccgcccaaggagctgagccgtgggaagctggccccaccccccaacgccatccataatcccctgaggcaacttctcatcgttcattctttgcacatgaagctcatttttgcttctattcgcaaaatactgcttttcgcgcaacatttctcactctattatgaagtcgagagacatcacagcctgtatcgcaatcggttccaccaggaggtgtaccaccgtgctcatcaacttcacgttctccaacttcaagagctaccgtgacgcccagcagttctccatgcagaggccgaccaacgcccagaagcacgaggacggcgactgggcactgaaggagtactccaccgtcgcaggcgtctacggcgggaacgcctcgggcaagtccgcctttatcgacgccttccaagctgtcacggacttcgtctgcaacgggctcaaccccaatctcgacctcagccgggagctccagcccttcagactcgaccccgattcgcgcaactgcccgacgcagttcctcgtcgacttcctcggaacggacgacacccgctatctctacgagctcagtgttcacagcagcgtggtcgagttcgagtccctgcgctactacagcggcagtcgcacgagccgcatcttcgagcgcgagcttgatggcgatgcctacacgttcaggtacggacgcacgttcacgggcgcaaagaagaacttcgagcggatggtccgcccggaggttccctacctcacggtcctctacgccaccaacgtccccattgtcggacccgcatacgagttcttctgcaaccgcgtcggcttctataggaccgatctgtacgacagcgagctcgagtacctgaaaaagggactccagaaaggaactccgaccgcaaaggcgctagctagcctcatggcaagcagcgacctcggtatctccgtcgtccagccgagggacccactcgaggagctgcaggaatcgagccagcaaccgggagacccacgcgagggcggctacgaggacctcgcgtctggagtgctcgccctgcttcagccggacctcacgaaggaggagcgtcgccggcaggcacagggcatcgccaagatgccgcccatgccacgatacgagctctccttcacccaccgggggaagaacgggttcgaggaaaccttcaacgagacggaggagtcgagtggcacgcgagccatcctcgcgttcttctccctggcactcagactgctgagcgtgaggtcggtcggtttcatcgacgagatcgactcgagccttcacccaagctacgtccaggagctcgtcgaactcttcaaggatcctcgcacgaacccgcaccagtcacaattgatattcacgacccacgacgtctcgctcatcacgaagacgggtgccgacaaacgcgttctcgaccaggaccagatttggctcgtggaaaagggcgcggatggcgcctcgaccctttacccggtcacctccctcccctcccgctgggacgagaactttgggaggaactacctgcacggtgtttatggggcagtcccccgaccggggttccacgaggcgtttgccgacgcggaggaggacctgcacgaagcccaggcagctgctacagaggcgaaccttggcggtgagaactagtggcgtccaagcgtagccatcttgggaggggacgtccaaaaggagtctctcgcccgaggaagaagcggcatctaatagtgacaaacggcgaggtgacggagtgtcaatacttcgatgggcttgaggaagagcttgggggcgtggtgtttacggtacgctcgttccgagcagacccagcggcactcgccaaaagagcaagagacctgaagcgaagcgaggagaggggcagcacctcgggtggtaggagtggaaccgacggctttcagcacgtcttcgtcgtgacggacgtggaccgattcacgcccgcacagcttcaggaggcgagacgcatctgcagggaatccggaatggagctggtcatctccaacccatgtttcgaggtctggctcatcgaccacctcatgcgttgtcccgactccttcgtcaccgccagggacgtggagcgaaaggcgacagatctggggatcgtcgggggcagtcgaaacaagcacgttaactaccaggtattggagggaaggtgcaccgaggcgtataccaacgcccgagcccacaactcatctgacaggggacgcatgcgaacgcggctcgacgacctgcattttggtccctggacagacatgcccgacctcatcgaccgaatcgcagggcacaagagagtgtagccagcacgcaagctgactttgcgacggcctcctgacccatgctcgttaggtcgggaggccgttctcgttcttttgaggatgacgatctcggcctggagcaactccaggtagcgtgcgcagataacgactaggagaggtgtccgtcgacgccaccgcccaaggccgagctccgggccgcccctccaccatcccgctcgtgggtggagatcgccctgacctgaccgtcgcccacgaggagcgcgtcggcctggttgaaggcgaagtcgaggtcgtcgagctggccctcgtaggcgtccgcggcacgcgcgacctcgttcgcgaggagcagccgttcccgggcggcggccctcctgcccgcaaggtcctcctcggcagccctcgccatgcgcgccgggctcagcctgccaacctgtctgccaacctcgtggagcgccccgtccacggggttgcgggcctcgtacccgtcgtcctccgcctccgcggggatcagcggccgcccgccgatcctggagatgcgcccgagaagctcctcctccacgggccccatcaccgcctcgtgctcgccgtcgaggcgcctcgccatcctacgggcgccctcgatcctctcccccgagtagtcggactctatgcccatcgagacgcgctccgccatccccatgagcccgtacgcgcaggcggcgcgggcctccagggacgcgagctcgtcaatcctcccgcgaatcgccccctcgtccgtcgccctcctgtccccggcaagctcctcgcccaagccgcggatggcagagagctggtagttccaggcctcgttcgcgtcgtggcgggcgcggtcagccatcaggagggcacgcgagcgcctctcgggcgtggcgagaaactcccgctgcctctcgccgagcatgcgcaggtcgtcgaacgccgtcttgagcgccgcgtcgcgctcgagctccatctccctcaggacctcccccacgccctcctgcaaggccgtgagctgcccgttgatccggttcatgtacgccatgcccacggcgacggcgcctgcctgcaaaacgaggttcgccgcccccaccggggtgagccccgcctgcctgattcctgccatcgcgttgaacctgccgtcctctccaaaactcgagagcaggttccagccgtcgcccccgcgcacgcagaggtcagcccagccgaccccctccggaaacttgaccacggccatgccatactcctgggcggcctgtcccacgttggcggcgagaggcacgaggccatcgatggcatcgccggcaacccccgggatggggatggtgacggagcggcagtgcccgccctcgatgcgcgcgagctcgtcgggacccgcccacgacaccgcgacctcgcccaaatcgctcgcggcagcgaggtccgtcccatcgtcccgtccatcgccgggagaggccggctcgctcccctccccgtcgtcgtggcgcctgcttctccaccagctcgcgatcgacatggcacacccctcgggtcagacgttggtggggccattatcccacccgctctggtggggacgctcagctgaggactgattcgacgcctctcgtgcgagcggcttcacgagggagagaagtgcccccgactctctccacacatctcccgctggcatgcggggcaccacagctgaaaggacgcgaacgtgacagcagcggaactcagacgggcgagaccccggagggtggccactatagtttcgagtcggccgcgcttccttgggtttcccaaggcatctaaacaaatggactcgcactcaccgtcccccggcgcatcaaagggcaaacgattcgccgaagaagcaaaggagttcggcaccaccaaccccggtaagtagcagcggggctgggactgccaagacgcccatgcgataatggcagcccaagggagaaacggaggagatccttgaacgagcaagaagaatccacctgcaagcgcctgctggacaagtcgcaggaggccttcctgctcgccatagaactctacaaccgtcccacaatccgctaccacgcggagggctgttgcttcttcctctgcaacgcctgggagcttatgctcaaggccaacatcataaagcgcgacggcggcaaggccgtctactaccctggtggtaatcgcacgctctccctttcggactgcctcaagcgcgtcttcaccaacgagaacgacccgctgcgccgcaacatggacgtggtgatggagttccgcaacacgagcacgcacttcgtcaccgacgagtacgagctcttctacggcccggtgctccaacaggccgtgcacgactacgaggaaaagctgcgcgagctccatggcgtcgagatcagcgaccgcatccccgagaactatctcgccctcacggtgcgtcgcgacgtgctcgacctcgactccataaaagcgcgctacccgcgcgaggtggtcgagaagatgctccaactgggctcatcagtagcagccagccgtcctggcgcacagggcatcacctacgtcacagagctgcgtctcaccaagaagaagggcgcgggcttccccgtgcgcatcgccaacgaggcggacgccgccgtgagcatcgtgaagtccctcaccgacccggtgggcaagtacacctaccgcacgaaaaaggcggtggagttcattcggcacaaactcgacaaggagggtatcacgctgctcgtcaagggcgagccccgggagttcaacaacttccacttccaggtgttcgcgagcttctacaacatgaagggcgacgagcgctatagctacgacctctcgctcggcggcgagaaccccagctggtgctactcacagcaggccgtggacctcatgctgcatgagatacggcgggatccggaccacgtcatcgactcgatgcgagcagagctaacgaggaggaacgggggcgaataggccccatagacagcagaaaagccgaccccaggagcaagggaattctaagcccggaggcctacccccattcggggacccagctttaatccactcaagtcggctttactgtatccctatcttaccctgttccggagcctttgcagacccacgaaccgccgacatggaagaaacgttgtcgatactgccgtatgccgcaagttggttacctgtgctgcccttgatcggagaggagcggggcatcggggatagccggggaacggggggctgacggagggccgcaagccccacctacgcgttgccgcctcggtcctcgaggccacaggcaccaaggccgcttacgtagggaagcgcgggaggtctgaggagtactgcacagcgctcgccaccgaccctcatcaggcagcgcggccccaagacgcgcatcgctcgcgacgccagaattgactgacaacgcaatcaggccaagtccagtgcaagattcacgcacgggaaccgacagtcagggaaaagtcacccctctctcttccttatcctgaaaggagggagagggctagcgtggggccgtatactaaacgacgccatagctttcgaaatctaaggaggtcggaaccatggatgtaaaagaagccgtgagaactgccgcgcactacgtggcagagctcgagggcctcactgggagcgagcgtgaggacacgccagaagaacagattctgcgcgacatccgattcgccgtggaaggtacccgctacgacgagcagagcaagcgttggagcatcgacgtcgggtttgcccgcccctgggaccaggcgacgtcctcccctcttgcgggcctcgctggctcgatgagggacaaccgcaccttcaagaccgtgaccatcgatgacgcaacgggcagggtcctcgactatggcgcgagcaggtaggagaatacccacgcgcgtcctcctcgacgcgaacatactggtgatcctggcatacggcgccgttgaccgcagctccttgggctcaaggcgcagggtgcgcgaatacatgcccaaagactttgacttagtcaccgatttggtaggacgcttcaggcaagccgtcgtcactcccaacgtggtaacagagtgttccgacctcttccacgatgcggacgatggacgcgagaaggcatggctcaaggcgttcctgcagtcagacgaggtggttcgcgtggaggagtacgtccccagccggaaggcagcggacctcactcagtatgaataccttggggttgcggactgttcgctgctatcgcttgtgaacgacaatactgcgcttctcacgacagatgccaagctctactacgaggcagcccggattaacccacgctgcatgaacttcaatcactacaggaatttcaactagcgggacaagaaatctagatggtcctgtcatgcgctaactgctggttttcgccatcctcacctttcgtgactccaatttgcgccccttagatactagggctacttctttctggcatcgcaaatcactgtggagcggacatcagtaggatgcactggatagctgcttcgggttgcttcggactcactctaaattcccgtgagcgcaacgccagccctcttgtcggtacaatggatcctgtggatagcgctcgtccgtcctcgcctcattagcggcccctgactcgtagccccaccgatgcgggggaactacccgtcaggggcttttgtttgcagatgagaacagcgggaggtccgaggagtactgcatggcgctcgccaccggcctcatcaggcggcgcggccccgcaacgcgcgctgagataaacgagaccgtttacccggcccttcctacagacctcaccgaggagcagcgatacgacaaggtgggcaacctcctgcgcaagatgaggagagaaggagccgtctccttcgaccgcacatcgtctcgctggcgtctcgcgtaaaccctgttcaatctacgcaggtttacgcggcgttttacacgagaaaagtagcctgggatcgagtctccgcaggtcaataggctatatggtcgtgttcggtttacgcgggctaatgcgggcgcatggggaccgaacgcagctttccgtttcacggcatgccttgtcgaacaccccctgagcgcgcagaacatggcctggtccccaaggaggcaatcgtcccgggaacgccacatgcaacggaacctagcgccacgtcacctcgcctggcgcgagatgaggaggtccgggactgtcacgagcatggccgagccgtcgtcggactcggtcaggacaaacgccatgaggccgccctcgtgcaccgggtacgctccatcgggctcgttgaggagcacgcccgccagcgcgtcctcccccgcaatgccctccagcctgaaccacacgccctccgacggcaggccctcagaggcgagcaccgcgaggacgtcgtccgggtactcgtgactgcggaacgcgtctacccgctcgacgccgtgcgccgccaagacgccctccgagggggcgcaggccttctcggcccgctcgatctgctcggaatagcgctcctcgagcgccctcacgtcatccgggaacaggacgcacgactcgggcgggatgcttccggaacggaggaccacggactgattctgggcaacgggaaacgacgcatcatggaagactacgcctccttcgagagaggcaggcgcaagcgcgaagagggatagcccctgcgcgtggtcgacatacgcgtacgcgaggaccgcgtcggcaccgccggggacgacgatgcccgtcttatcgaacccctccaacatcgggcacgcgacaatgagaagcctcccgacaatgtccctgaacccgaggccgacgaacgtgacggccatggtccccccaatgctggtgctggtcctgttacgtgcattgtctcatctcaagggaggcgtaccacgggtcaggtcgccaccggaatgtaggcgtcgtcagcgatcggcaagtgagacaggctacatatttagggacaacgaaccgtttggcgaaccgtcggcggattcagctgttagctgtaaacttcaagcgatttctaggtatcatcctctcaagaggttttattgctcaataagcatggttatcaacaggctctttccatttaatagcttaaggagatcccatggacgagtcaaagagcaaggacaggaccttgaaggaccttgtcttcgaggaggtcgctgaggaagatttctttgctgcttatacgggtggatgttccggagggcgctccgactgctgcacaagagtttgcactaggaacggcgctgtcgcttctgaggaagagtggggaaagttccttgccgtagagggtggggtcattcaatactagtcattgcacttggaacagcttgtatcctgagccgcaccccatttctcggcgtgcggctttctcatgattggttaacatgaatattcccgtgattcaaatcgaactagccgagcaaggtaccgtcgaagtcgataccgaatctccctacgtgtacggagtcgaggaggcggggagaatcttccgctcctcgctctcccgcatgaacatcgaagtggtcgggcttctgtgcctcgacagcacgcacagggtcgtcaactactcgaccgtatccatgggggctgtcgaccgagtcaccccatcggtctcccagatactgaagactgcccttctttcgaacgcctccttcatcgtcgtcgcacataaccacccaaacggaacctgtaagattaccgagcccgacatcaccctaacgaagaagatcggcaacgccgcgagggtcatggacatcgggctcgtagattcccttgtcgtgtgcccgtcaggcgaggtcgcctcaatccgcgaggcaataggaggctgcgatgaacgttagcgactcagcggtcttcaagatcaaggactccgtggaccttttcctcaccgatgacgagtacgtcaccgcctactacatgaactcccgcaagagacgggagtttcacgtcagccttgatacagtcaggctcctcgagagcattgatggccacagctcagtgggagacatcaaaagcctcatgctcgaagcgaactcggttagtccagagtccaccgagaggacgcttgagtcactccaagcgctcaagatcatcaccgaggtgcccagggaggacgtcctatccccatcagactccgagaggttttccaggcagatcaactacttagcggagttcttcgaaaacgaggcggaggggcagcgcgcgcagaacagaatcgcatctactcgaatagcaatcttaggttgcggagcagtgggagggaacatcgcacttgagctcgccatggcgggtgtcaggagactcgtgctctttgactacgacaccgtgtccgagtcagacgtcagcaggcacctcttcttcagaagcggcgacgtgggcatgtcgaaggttgactccctcgcggaacaggtccatgaaattgatccgaaggtccacgtcgagaccatccaggcggcattgagaccccaggatgacatagaaagtctgatcgagagctgcgacttcatcgtgaacaccatggacgagccgtacatcggatacacctcggcaaagatttcccgcgcctgcgtcaagcacaacaagccccattacatcgccggcgggttcgatgcgcatctcgccagcacgggcgagctaatactcccccacatcaccccctgcgccgagtgctatgcacgatactttaagaagagcctcaagggttggaagccatctcaccatcccgtggaggatcgttccctggaaatcggggggctctcccccatgtccctgttctcctcctcgtttgcggcgttggagatcctaaaattcctgtctggaatagtggacatggaaaagagttacaagccacgtggcgaatggctcttcgacggcatgacgctgagttatctggacgtcaagcgggacccccaatgccccgtttgcggagagagggcggtgctatgagcacgaacccaaagctcagtcccagcgtctccgttgttcctctcggtaacgggatcatcgagttcttcatgacgaacacaagaaggcaggtgcgtctcaagactcaggacgatgccattctgaagatagtcaacgggctcgacgggtccaagactgccgaagagattgcccatgcgcaggggtacacaccgtcgtcggtgaagtcgctcctcgcctacctctctcagcatggcattttggacaatgcagaaccgaaggaggacttcgaatcttacgatgacttccggcgggtcatctccttcctccaggattactcgacctcccacgaacacttgatccaaatgtggaaacggctccgagacagcagagtagtcgtcgtagggcttggcggcgtggggtcatgggtcgcgtgcaccctcatccagactggcgtgaggcatatcgtcctaatggatccggataccgtagatctgtcgaacctccacagacagttcggctacaggaaaatcgacttgggacgtccaaaggtcgatgccctctccgaacgactccgcctctacaggggtgatcttgacgtcacatccatatgtcgcccgctcgatgaacacgcccttgaggatgcgctcggagacgagcgcatcgacctcgtggtgaactgcgccgacaagccaacggtcgaccagacgtcaacctgggttggggagttctgcatgccaaggggtatcccgcacatcgtgggaggagggtacaacctacacctctcgctcatcggccaaacggtcatcccagggaagacggcttgcgtgagatgctttgagaagcagcttgaagtggataaccaaattgacggtacccgcgtcaaaaaactccaggtagccaacaggaaagtggggagcatcggtccactctgcgccctaaacgctagcatggtgtcgatggaggcaatcaaggttctgacgggatgcacggagcctgcaaatgttaatcgtcgcggtgagtttgacattacgacaatggacgtgagctacaggaggttcgacaagctccctgactgcgaatggtgcggaccgcatggcaagtactattcgggctagacgatatgtaacgagttggtctcgagggagttcggctacgagcccggtgaagtgtgactgcgagaactaagaaaaatgtgctttgtatcaaacgaagtgactacatgccgattcttctcacgccctgcttagtccatcgattattcatgtctggtgtagacgataaaattgaatcatcttttcaacgtactacaggagacaacaatggatgatttttcgattgaggtcggcctcacgtgcccagcttgcggctgcacagaattcgaatcggagagccttgaaaagacgaagactacaccgatgactggtcattcacctgtgcgcactgtggcaggaccttctctcgcaaggaactcatagaagcgaatgctgagtctatcgacgctaccgttgacgatatgcgggacgaaatagtcgaagcagcagcgagagagctgaagaaagcattccgggggtggaagatctaatgagtgctgagctttcacttgtcgccacatgggcgcctatcgttatctctgttgtgagccttatccttactgggtatttctccatcatgagctaccgcctcgataaaagcgacaaattgcaaactgcagaacttcgccgaattcagaaacaactaagcgagttgcagctacaaaaagctcaggaggatgcagctgtgaaaacatcctcaaaagtcgaagcgcgccatgtgttggtcggactcaagaatcatcacattcgtgttgcgaacgtcggaggcacggttgtgacggacgtgactaccacgtgcgacgacggtccctatttctatagacgggacaaggaaccattcgagcgtctggaacctggggaaagcttcgaccaggaatcgcgtcgaatttgttggtgtaagcgcatgaacgggtgaggcctccccggcatgagaagggccatcgtcctagaatctgaaatcgcgacaaatcggactcgtggaaaggaagatggcccaatggagagtgtagcagaggagccgctcacggtggcgctggtatcgacggagatgcccaggttcgctgatggcacgatcaacatgcaggagctgctgaggcagctcgccgagagcatcgcgaacgagatctgagcgccgaggccgaccagctgtgcgacgagacggggacgagccggaacggctaccgcggcaggaagctcatcgcctgcgtggggacgctggacctcagaatcccgaagacttcagagtcaaaggagtgattggaattgaaaaccaggatttccctgctgctctttggcttgccgagccggatgggaactttgagcgtgacggagcagtaggcgtagcgagcttcgacacaaaaaagggcgtagacctcgacgtaccaatcggctcgatctctccagatgacatccctagcatcctcggcggagaacatcgtgattttactcgactgttcggcctcggtcagaactttgatcacattacgctggttgataccttcggcaacgttagcacaagctatccgggctttacccgcgagaactggcgcgcgcagtgggcaatagtctcacgagagcaattcttcgaggaggatccactgatcgatcatgcaaccgttattgtggacgggctattcgagtggtgccgacagaaccccgtgaaggtgtttgcgaactacgaagacagcagatggcacgacatccagatttcatcctcttgtgaggcactgagggatattcctctctacgagagtgagaatctggccgtctccatgagcccagtggtcacagtaggcggtggtgaacttcccctgaagacccagtcgctcacgagcgactaccacctctctttaaagttcgcaaacgacctgccaacgctctacgaagcaattcacgagcacatcatccccttccgagacctcctcgcggtcctcatgggctttcgcgctgaaattcactcgatctccctctcgggaccaagactcaaaaagccaatcaaagtctacattccactcgttgaggcacaccatgactcccttcctaagcacacgtttcagcagatgcccctcacgtatcccaaggtaagcggcagactccagtcgatgaccgagaaatggctctcgcttcctgacgatgcccagcgcgccgccagcatcttgctcggtttcctagccaacgaacatggcccctacctagagtccaagttcatcgcagccgccagcgccctcgaggctatctcgcgcgtcggccacaagaccgcagaagtcgaaccggaggagttcgagcgacgtctttcagtcgtggacaaaagtgtcacggagaagaagacccgcaactgggcaatgactcacctcgctcattcaaactccgtcgctgcgggcgttctcgcaaaccagatgctgggagaactcgacccttacagctccttcattgtccctgatcttaagcgtttcaaacgggaccatcgtaatgctaggaacgcctacgtccaccagagcgacaacgtcagcaacggcacggcactccatgaccaggaacttcaagaccacacggaggcagtcctcttcctcgtctggggcaagctgctgaacctgttgggcatcccctcgcaggaactcatcgacgctctaaaggactcttcattccgctggaacgacctccatcgtgctcagcaaatgtacgaaatcaaactggaaaataaagagcctgtgtaagcaccggggagagtttagccgcattcagtcaggtgatgatcgccaatcccagccagccgattctggccaatgcgctggaagccggttgcctaacttaagttgctgctaaactcctctgggctgtatcccactgaccttcgtcgcctgcggcaccgcctcgaccgaataggtgagtctgctggacgagtagccgtaccggacagcggcccacccacctgggtagcgtcgagaaagttggtgtaagcccgagggcgagtgccgggctcgtcccgaccgagcgagcaggtcgtcgctaggatccgaagcctcgtctgtatcctatgccgcctccatcctgtccgcaagctcgaggctcgccttgatcgcctgctccgccacgagcccgggctcctcgctgcgctcctcgttcggcggctcgggcttgggcctgtcctcgtagagctcggagatcttctcctccgagaagtagcgcgaccccgaccactcctcgtcccgctcgcacaacaccgcccccacaaggcgggtcggcgacgcctccgaggggaacacctgcaccaccctcgacccgcgcctggtctccctgttggttctcttgtgttttgtcaagtcgcgatgagcagaatggtcatcaatttatgagcagcctgccagcacgtgctgagcaggctttctgagcacctccctcactgcataagcgcatgcctcacgcggtatgattcgcccctgaactgcaggagcctgccgtggtgcacgacgcggtcgatgactgccgccgccatctggtcatcgccgaacaccgatccccacctggagaactcgaggttggtcgttagaagccacggactccgttccgtaggcttccgagactaccggaagagcaccctgcgccatcggcgtcgagcggcaggacgcccagctcgctatgacaagcgctcgcccccgatctgggcgactcaccggtcggcctgcctcgtcgcgcgcatcgtcccgaggccatcacgagggagagcggtgaagaaccttgaggccttcccccgcaggcgagcacgcacagcgcctctgccatgtgggtctgccctgcccacatcgcccatgagcacgagtcctcatggcctccacggacacgacgagcgagaggaggtcgtccctgccgaccttccggccatcctatcttgcccttcccattcgtactccgtcgaggttctgtggctggggaagcgcgcagcgcctcagcagtcgcgccgcttgagtcgcccttgctctcgcaattcggccttcgagtgtaggaggccgccctgctctcgcattcggcttcgatgtaggcagcgaggtactcgacctgcctgggagtccccttcccggcccattccaggagcaccgatcttgtgagggagcacttcctgcccgcggcgacgatcctctccgccagcacgtccgccgccgccatcttagatcgcctccctcgagaggaagccgtcgtagacggtcaggtcggggcctgcgccctctccggggaggcctgccgccatgcgcctggcgagcatgtcgcaggacgcctcgtcgggaatcctcccgctcgcgaacatgcgctcctcggccgcgcaggcagcctcgaagcccgatgactccgcagccctgccgagaccgcgcagggcctgcctcctcctgccttgttagccggtcgatggcatccaccagcgcctgcggcatgtcgtcccttatggtcgactccccgaaggcgcgcggcctcgcgacgagcgcgggtatgagggagacggggttcctgacgcgctcgccttccccgaagctgcgggagagcgtggcgacatgccttccgcgcgtcggcgagcagctccacggtgcgtgcgcgcatccctaccaggagcatgcggtcgtgccatgcggggccggcgcagtagaggttgccgtcggcgcgcacatatccgagcttgtcggacttcgccctggtccatctcacggcgtcgaagggagtgccgggcagcgccagcatgccagcgaggtcctcctggaatgcctctgcggcaggccttccctccctgttccgcgcctgcgcgtttatcctgtcgcagcctgccctgagcatgccattgagctcgtccagcgacgatgcctcgggcactggcacgaggaggttgcgtcgcaggaacccgacggcattctccaccgtcccttctcgttcccggaatatgggttgcagtagcggctctcgcagcggtaatgggcccggaactgcgagaagagctcggattcgcgtgaccctgccggacagcatctgccccgcctcggtggcattgtcgagcacgagcaggcgcggcgcgcgcccgatccactcgaagatggaccgcagtcccagcagaagacctctgccctctcgcatggcagggcgatgcagaagcgggagttggaatgcggcaggacgaccacaaggcttcagcgggacggcgagccctgcgatggacgcgacgaagttgccgaagtcggcctgggccgtgcctggggcccacacgagctcgaggaagccgtccctcggcccctggagccgtccttcttccaggctgcgacatacttccgcgaccgacggtaggagccggatatcccttctcggcgaccgccctgtcgaagatcctcctggccgtatggcgctgcttcctcgggacggcgagatcgccttccagtatcgcgtgatccacctggctatcccgtcggtcgcgggatgcgccctcctcgggcatcggcggcttcggcgacatgtcctcgggtccgcgtacttggcgacgtgttccggctgagatggagctcccgggcgatcgggccctcggcactcatccctgtcatccgtctgatatcctcttgctcgtctagggacacggtcatgctcccttcctccttctggggggggggctggccgtgcccctgacgcgccgggacacggccattcctctgccaatctgcctgattcttcctgatcaccatgcgcaatttccggtgaccatctgcgtcacttcttagtgaacatcaacacctctcctgcacgttgttcgtgcgcgtcctcttccggtgcgactgcgggaggtcgaggtaggccagcgcgtccggctcggcctcctcgaggacgcgcgcggccttcgggcagcactcctcgagcatctcgcatgcaaggtggtgcatggccctgacctggtcggcgtccttggcgcgggagatcggcgcgactatcctgtacactcgcctgccgagctgccggctcccggcctcccgcgcgcggtcgcgcatgaggtggacgacgcagcgctgccaggccgcgccctggaagacctcccgtatggcccttctcagcccctcgtgggcgtcgggcgtgacgagccggacgcccgagacgcccctttgcctgacggcatccgggagggagggccaggagtcgtagctctcggtgtcgacgaccgacgcgcccaggacgcgcctccacccgtgctcgtcgcagccgatggccgtcaccaccgcggtggacgccacgcggccctccctcccgcgcctcgcgtaggtcgcgtcgagccggaggtaggggacgcggaccccggagagctcccgcgagagcagctcctccacgtcggcgtccaggtccctcgctatcgcgctgacctggtccttcgacagcctgtctatgcccatcttccgggccaccctctggaccttacgcgtgctggtgcccgcggcgcacgtctcggcaactgcggcgacgagcgccctgcccaccctctggtggagggtaaggacgtcctcggggaaggagctgccctgcctgagcttcgggaccccgggcgtgggcgtccccacgcaggtcaggggcctgcgccccccgtggccgttcctgccgttgccctcgccgcacatctggtcggcctcggcgcccacggtctcgctcgcgacgctctccgcgagctgccgcagcagctcccgcgtgtcggtcgtgccgtcctggaacctcggcatggccgcgccgtccagggtcgccgcgggcggcgcatctgacaggcttcgcattgcggccgtcgtccccttcctaggaatccgatctgtcgcgatctcggattccaggacgatggccgcttcttctcggccgacggtcaagcccgacggtcccttcgcttacaccaacatttacgacgtgatcggccgagcgcgaggggacgctcgacaggctgctcgccgacgtggccaaggcgaggctcctggtcctggacgagttcggctacgttcccttcgacgtggacggtgcgaggctgccctgccaggtgatatccgagagctacgagaggaggagcgtcatactcgccaccaacgtcgagtccggcaggtggggcaccgtcttcgcggacgacaggctcgcggcggcgatcgtcgaccgcgtcgcgcgccacggcaggctcgtggagttcgggggcccgagccacaggctggaggagagcctgatgctcgggaagtcgggaaggtagggaggcgccggcgggcccgtgacgaaacccgaaatactttcgtgcacggacccgaaagaaatccgtgctcaaaaccgaaagtcaggcttgactaaacacaacctacgtgcagatagggggccgccacacgtgccttgaccgcggtcatcgactggtacagccgctacgtcgtgtcgcggcgcccatcggacaccatgcgggcgagcgaggtcgtcgcccgcgccaggggtgcgttcggggcccacggaacccctcggtcatgaacggcgaccagggcagcgtcttcggctcggaggagtacgcctcgccgctctcctccgagcacgtcacgcagagcatggacggcagggccaggtggagggacaacgtcctcatggagaggtggtccggaacctgaggtcggagtgcccggggaacgcggagtacgagacgccagcgcagctcgagagcataatccggaagttcgtcgacgactacaacggcagcaggccgcaccagtcgctgggctacgagacgccggcctcgtgatgcttcaacggaatagcggaggccgcgtaggctaggatgcaagggtagcggtggacagggattcggaagaagcgaggcccgcctgtctcaaactctctgccacttcaatgccacaccagacaaccacctatgacacgcggggaaatatccctatccactaatgtaagaatactcagctccaatgggctcccaagacggcttctcctcacatgaaaacttaacaattgctatcaacccatcagcaaaggttacctgttcgataaaacagtcttggctcttcagggcgtcacagtaatgattgacctccttaatatcggcatgctcgatgaccaactcgtaatgattgggaagggcaaccttggatgcggacatccccgatctaaagacgctccgaattgtgtgcgcatcaatccaggaagcaaagtgcgaagacagccattctgtctctagggcaaatagagtacccgaagcaatgatcgtcttgggaagcaggtcgtaaaggtttcgctcctcgaattgccttacctggcaaaacacccaatcggcatctaggagcctcgtgccacaataatcgccgtataagtttccaaaagttccttctagagtatccgcaagcgacaagtaatcatattcataccagccacgaccaacgatcaggtagtttccagagcaacattctgccgactttgcaaatgtctccagatatctatcccacatcttttcgacatactttaccgccagaagaacactttctttatcggagagcggatcatcactttgttgttgcattatccctgtcgtttttgcaactccaagcgagcaggcaatcctttcgaagaatcgccaagcctctggcctattggagtcttcaatcgccataatggtaaaaaatatagtacgcagaagagggtcttgcgtgtaccgttttgtcagcaggtccccgaatctccgctcgtaaccaaatagttgtttctcgctcgtatcggctaatacaccatcggaataaccagcagaggcgtcctcgtatgctcctgttgaggctattgagctcctgtaatttctgaaagccctaatgatgtcgacgcgatatcgatggcgcgtagcaagagtgacaaccatttgaacggcgacgtagaagattgccagctccatttcaaacgcgaagttcgattggtcaaggacatcgatgccgaacgagagataccctccgacaacaaagcgctctagcaacgatgccagggcaacagaacaagatacttcgatgagaaatgcaagaggatgaatgagactctttcttgtcagcagctttgcaattcccaatattgcccaataaaaaagtgaaggtaaccaacgctgagttggaacgtcaaaaccaagctggctaagcaaggcttcacagacgaggacaaggattgagctgcaaagcgcaggagagagaatcctatatataacattcatctttcccgtcacatcatcgtactcgctttccaatccatactcacgaatggcaacgggacccaagaagcttaccgccgggacagtaattactgcaataaagaggtacagcaagacccaccctatgcttacatcgcccaagtcctgctcctctatccgctatgttcctgaatgcgatacctcaatcctacgcaagatgcttctattggtgtcaagcgccgtcggcggggtcttccgcatccatcgggaagccatcgtccacccactttctgtaacggagcgcgaggtctctaaactggtggtggccaagctcgaggtcgcaagccagagggtcgaggccgtgacccccagcgccttcgcggtccttctggagacgatcagcgccgatcatggcctcctcagcgcgggtgcccgttccctcggcgggcaagtccgtcgggattcgtcaggagccggtaacctcgcgcagcgattttttttttgtaagcgcttcgaggcagcggagtattaatcggtcaggaggagcccaaatcggcccttcgccttccacacgtaggcgatgtgttcctgggtcggtgcgagagcctgtcatcgcaagagtaacatgcagggccctgttagcccgccgcctgtccgacgccgcggttgagcaagatggcgcatgaccttgcctgtggagggcctctataggcgatggcgctagagggcggcgaaacgagggctccgaggcacatctcgagggtttgcggccggcggccatcgcgagcgccgcggccgagagagcgcacgcacccgttacatcgcggcgagcgccgggtttccctttctgacggcgtcggtagatcgccattgaggagcccgccgggcggacgagcgctgggcgacccaggccttccccagagccagtagagcagagaccatggcgccctctcgacgagggcaggccgagccattcgtttcctcaccagcaacgcgcagcgcgaatgattgccggtctagtcccgagcaggctctgactgtgagaattggcgggtggcctattaggtcgtcaggggcctcctcctcacggttgccagggcgatctgtggcgagcgaagttgaagacacctcacaggccctcctggcgccgtagagggccctcaccctcgacccagccgttcctgggacttcgggacccaggtcatcgcccgagtggagagagaacctgctggcggccctgaggcgcggtccgccgcgtcgtccttggcgcgcgcagctgcggcctcctcggctctcgtcgggaccacgaactccctgtagcagcggacgccctcggaggcattcctcgcgagcccgccccgaaggtgcccgtgcactcgacgccggccgcacgagcgttccgagcgcgcgtgcgctcgcgatgagcatcgcgttatcacctccggggtggggaactcgccgggagaagagtcggccccgaggcggtcgaaacgctcagccagttcgtgtaggcgtgcgtgtgagatccggcccacacggcgggtaccgaggggacagcgccgccatctgatcctccatgcccatcacgtccaatccgtctcggcaccgggtatgattcgacatgcccgcggccgccggacaggggtcgatgggtgagcgcgccctccgcaagagccgccgcgcccaggcttctctcaggtcacggcaagccgctggggcacgcggcgcggggagggatatataaggaggaggacagcccccggacgggacgtcaatcaattgtggggtcaccacgccgcgccggaacgaaccatagaccagggacgaacggctcgtcgccccagggcctcttcggattatcggaggacgttgttggtcctcagcctcttccagtgcgaagctgggaagtcgaggtatgccagggcgtctgcctccgcctcctcccagatgtctgccgccttggggcagcactccctcagcatgtccgcggcgacgtggtacagtgcgcgcacggcggctgcgcccttggcgcggaagacaggggccacgatcctcgcgaccctcctggcaagcgtgcgcgagcccgatgcggcgcggatgcagtcgcgcatgaggtgcacggcgcatctctgccaggcagccccctggaagacctcctggacggccctcttcagcccctcgtgggcatcggagacgacgaggacggtccccgtgatgccgcgggccctgagcccctgcaggaaggcgagccaggaatcataggactcggtgtccacgaccgagattcccagcacatgcctccagccgcgggagtcgcagcctatcgccgtgacgatggccgtggaggcgacgtgtccgtccctgcggcacttcacgtaggtcgcatcgagccagatgtagggcatctccgcgtccccgaggggccttccgagcagctcctccacatccgcatcgagggactgggctatggagctcacctggtccttcgagagcctgtccacgcccagcttctccgcgatcctctgcaccttcctggtgctcgtccccgtggaatacatctcggccaccgccgccacgagggcgcggtctgcgcgctggtagcgctcgatcacgtcctcggggaagaagcttccgcgcctgagcttggggatcctgagcgtcagggtcccgacgcaggtcagcagcttcctctccctgtagccattcctgctgttgccggaagatgcgcagagctcgtccgcctccgcgctcatgatctcgttcacgacgctctctgccagctgcctgagcagctcctgcatgttgatggttccgtcggcgaacctcggcatcgcgccggcggcagccgcggccggcgccatctctgctatgctttccattgggccattgtcctttccacgaatccgttattccgcgatttcagattctaggacgatggcctttctcatgccgggaacggctcacccgttcatgcgcttacaccaacaaaaacgacgcgatcgaggaataggcatatagaagtagcgataagggcgataccttgatgcaggggccgtgactaccagctatgccacgaccccttgtcttctttccgcgtcaacgcaatatatgttttcctgctaactacaaaagtttgcgttcgctcttggtaatgtcatcgttccgctcgcgcgactcacacgggaaccgacgttctcaaatgtcgacgcacggcattcaacaaagtacttgcctattattacgaacaatatgttaaaccgttctcacccaggcgaggaaaagcaggatggcgtccgaagaatcgatagtctctttgcctgcaactcactcgaatatctctccaaaatcgagcttgataacatcatggtgaggcacgcgctcgtcctctgggggaagctgtcgccagtcaccatagacttgagtgagatacttttcccaattatggaaaacaggatattcctctccttcgaactcggcggtttccaaaggaagcacatcttcaaccgacaaagttggaaaggacgaatagtaatggaagcacgtaaggacagaatcctcccgtgggtcctgggaatcagctaatccgtcgagctttcgacaataccaatttttatcgtgaatcattagggggaggcgcacaatactgcggacggccttcttgacaagactagcatcatgcctagttctcggaacaacacggagcaacattagccgatgccatttcctccattcggctttcttccggtcaatgttatcagctgtcccgtcaatccagtcgaagggaaagatatcgacccagatgccatcgtctcccctatcattgagcgtcgcattctcgatgaaggtggtgcctcgacgcctcaccttgcagaaagaatatcttatgtcatcaccttggggcgtttcgagcgaataatcccgtccaaggagttctggcgcgagacgaaggaacttctcgtagtcgggtcgaatcatcccaatatcgatatcgtcatcccatgggataaagccgtgatggcgctcagcgccaagtagtgttccgctatctagaaaaaaatcgatgttattctctctacacacgcgagaaatctcatcaaggatatcgagctcaaccgttattaaacgctcggtctgactttgattcaatatcatatactagctccgttaataactaacaggcatcacttagtaaaagctaatgaaccagtatgagcgatggagggggcttctattgcgcaaattgcgttaatcgcttcaattggaaagacttttttatttttcccggtaccccagctacgagaacgtccgaagggacgtcttcaatcaccattgcccttgccgcaatgactgaccctttgccaactatgagatcgccgacaaaggttgattgcgcgcaaacccatgaaccgtcaccgattgcttgtgagtagatctctccgttacccgcacgtctttcgtgagacccgacagagtgaccaccagttaggaaagtgacctgtggagcaacatcaacattatcaccaataacaacagagccattgccttcgaccgtaaaatctcgtccaatccaacagcctcgaccaatctgcaaagaagcaactgtacccaagtgaagaggccctacgatgcaagacccctcaccaacgattacccctccccaacgcaaaagacctctcttaataccaaacgcatgtgtgccgcgcagcaacgtgttggttagtccaagcgctattattctccgaatcttttcaactattggtcccactatttttatcctctcttaggtaggtggttcataataagtgactggtatccgcgtacttctattttttcagactcgtttagcatcatatgccaagaaaagaccagatagacagaggtacaggctaggaactccacggcgaatacgccccagctactagcggtaataaaaacgcgaaatgcatagcccatagccaacatgatgagcgccggagcgaaccatccaatatatgtgtcccgaaagaagctgcgtagtttgaatcttaaccgtctcacgtagatgacaaacatgccgaacgttctgatgaagtatgcgatacaaatggcaagcgacgcaccaaccgcaccaaggcttgccgagagagggatgccaagtatgacgtttgcaatcgccatggcaatataagcgaccgccttatccataacgcatccttttgcaataattgctgtatcggccaccatggtaggaagctcaattaattcgggtaaaactaataaaagtgtgcaaatgtagagtgttgagtatcgatcgcccacccaacaggaaacaaactcaggacctattgcggcaaatcctacaacgataccaccagtaataagaagctgaatcctaccgacccgcaccgcaaatctttggagaccatccttggagttctcagaatgcactatcctcgttaccttgggcataaacataccgttaagagcattcgcaacactccaaacatagccttcaagcgatgaagcgagtccgaagaccgagatttcccacgaagtggagaccgcagcgataatcgatggcataatgctaaaaataaggcgcgcgcaaatttgaattacgagtacccaaactgaaaatccgagcacttcgcgagcaagggctgcgttacgcttcccgaagggagaaagtcttatccgtccatcacttttgatgagcagatatttgatgagagaaaacacaagaccaacgcccgcgttcacgatgacaagcgcatagaccccccatccgagtagcagcgccactatgataaggcctaccgtgaataccttctgaagcaggttgcttagattaagggcaatgaattgttcatttgcggtcaaaaccccattgaaggaggcgcagggaagcgatattacgctgtacagtgccacgattatgtaaagcactttgaaaacgaagagctgtttaggtccgagattcccgtagatggcgtcgatgttgagatagacgccaaagagtacgacgaaaatagccgcgctaatgatcaagtacagcctaagtgcgacccccataaactcgtttgctttgtcgagtctgccttcggcgtagtcccttgataggaatcgagaaacggcatctccaagcccaaagtcgagtaagaagaagttcacgacagatatcgcaagagtatagagaccgtacatgtcgctaccgatggaagaaatcatccaaggtgtgtacagtaaacccgccagcgtgttaaaggccacagcagcataggagatgacggcccccacccttatttgactatgcttcgccactttcatcctcatcttagaattcaattcaagtaaagaacctttatcgttactagtagcggttactctattttttttcgaaatgccggggtgtttcttctgcgctcatgtggacatacgaatctttgcaaaactcgcctctgaagttgacgctgttgtcccatcaacattccttgatatcgaagggcatctggagcgtcccccatgcagaatgattgtctggcggattcttccacatgaatggcgagtggattcccaccggttcaacggttgatgacggaaatgccaaattcgcacctgttcacctgacgatctaatcaaccagagccttaagacaatcttcatataacaaatttgacccccaagccattcttgacggcttctgggaaaccggcccgtggtatcactttcagccagatggtcaacaattgcgccacgcatatggtggttttcaatatgtgaatgatttaaatggatgcattgcaaaggaaatagactcctcttcttcatcacgattttgattcatcctctggcccctccgtgaatgggaatagatattcaaactgtttgtcggccgttgtgataccaaccgtcgctaatgatcgtcgctcggctacagggcccactggcgaaggaaaggtcatcaccctgatcacgcaatgactcagcgagctcaatgattctacctgcagccactgcgggcccccactcccttgacatagagcgtccagcattgatgccgagggctgctgcgaaatcagaattatcaattaaatactcaattttctcaacaaggtcgaggcccgaggcatcaagatcatcgtaaagcagcccattaacaccgtcctcaataaggaacggtgctgaccctatggaagcactcgctacgactgcgcagcctgcctccattgcctcattaacggtggctccccacccctccttgcgtgatgaagtagtaatgtatatgttcgcactacacattaacttttttgtttcttcgccagataacataccagcaagtgtaacgacatccgaaaggcaatgctctcgtacaaaactcttacacttatccattagaggtccatccccagccatcgtgaggtgaaaagccttatggtcttgcttaagtttgctagccaattgaagaggctcaagaggtcgcttccattgtatgagccttccggcccatacaatggaagcgaccccgtcatgagatttatttgagcgacgcacagggtctactttcgggaagtaactccatttgaagcacttttcgtcaggccacccaaaaagggaaagatcatagctcgcataagcgctggcacacaaaacataaaggggcttatctttgtattgcgtaaactgcagtctcgtccttataaccttaggcagaacaaatcgccaccaaagcccacgttttaacaacctttccgtagcgcgaaaactaagaagatttctctccaggcgggcctctacatactgctccttgccgcacatgtcaccgaaaatgacaatgtcatcttctatagcatgaagcaaggcatccgccttcagctgatcacattcatattcacgaagaacaaaaggataagagtcatttaaatcggttctcccggcattccctccatgggataaagcgacaaaagtgaactccacgtctttaatattgcaaaaagcctgacaaagtggaagcacatgcgcattaaggtagttagaaaagaaggtgagtttagtcatatagcctcttcaataaaggttccttatcacaatccatacgcacaatagaatggatgttaatttcttaaaacattgattccttacgctttttgcaaattaatggaattagttgtatctcatccaggtatccgctgagcatccaaaagataaaggaacagctaccgggacctatcggaggcaaaccctcaaaaattgattctatcaggtaaaagaatgttaaagaaaatacaatccaaatgaaaggctctatgccctctttggagattattccaatcatcccgagatttttcattgatctcatgacgagaagtccaacaatgaacacacttccaataatcccaacatttgccaaggaattaagatagtaattatcgacgtaataattaccaacaccaatagcaggacttccttcgaacactgaaagagcctcagaccaataaacacctcgtccactcgacatggtgttcagggatgtaccagcatatttatctatgaaaaacacatgatttatatatgacaaagcagtcggtgagagggtaaggaggattagcgataagactatgatcgcaaatgcgaatctctctgttagaccagcattgacgtagccgctccctaccgttgccaatagtcccagaagggctggggacgatcgatcatctggcgcctcgtatgctcgtagaagccgcaggcgctctggccggaaagcgtctgactccgtctgcgtccgagcgccttgcctcccgagcccaaaggaaccttagaggtagtggtctcagccacttggtggatacgctgaattggggcaaggaagatgcgcatctctctggtgcatctcgcgttgaccggccaaggctcgccgtccttcttcaggcgcgtgtccgtgcctcactgctcgttgatgccgaggcgggaatcacgcgctttgttctcccgaatggcgtcggtcgccacccaggtgccaggaccgagaccctgatgcgtctctcagggcctcatccttcggccttcccctgtcggccacgccagagcccgtctccggcatcattgctccgcagatgacgcaggcaccttgaggctggagatgccgcgtgcattggacggcgccgccgtgactgcggggcttccccggatctggcagcactacccttccctgtgttcccgtgagggactcgacgaggaggcgccgtactacctggccagagaccgaacgtccggtcctggaggcgagagcggcctccatagctcgcagagcctcatgcgcatgaccaggaggtcctgaggcacacatggcacgctcttcgcgcactgcctcagcctggcccgaagcgcgcttccacgaagagcgcccaggccgtggcatcgagcttggaggcggcgggcaggcccctgctcctggacggacgtcctcccgcaccccttgcagagccagcgctgggagccgccggcattgtgccctttcctgatgaaggaggaagagccgcaccgggggcatgatctgggcgtcgcgccatctgcctcttgccaggctcgcggcggccgtcgccttcgtggcgcagatgagctcgcgcttatcccgagggagagcccctccatctcatggagtatgatgtccagcatcccgtccccgtctcttcgatgctgatgtttggcgacattcatcctagggcggggacgggacattattacgtcaacgctggtctaacggagagatgcgaatttacgcttgccgctgacacatagaaccaccatcgttccaactatgcatcctaataatgccgtacggcattgtaccgcagcgattacgaacacaaggtaagcatacacggcccacctgagtaaatcgccaccctttgtcctcgctttaattgcggccgcacaaattgcaccaacaccagcaacttggccaaagctattcttctggggaaaaaagtaaacctcactatttaaccacgtagtgaagctagggatatagtttataagaacccaagtcgaatagataactgtaacggtaacgtaaacaaaaagaattgacctaagttcgttattcccaagaccgtaggctgcaaacaccatgccgacaatatagagaagagccgtcttgagaacggcaatgaaatgacctcttatatagcctggttctccagtaaccaaataacatacacaacaataaaaagcaaaagcaagaagtccaattgcaaatatcagtgagaagccacgaaatattattttcgatcccgagttattcaagcagaatgccgcgacgatgacccatccaattccataaaaaaaagtgagattaacatttgatatctgagatagcacggtaatagtagtcgcaatcgacgcaaggataacaagcacggacggcgagtgcgacgaaaagtcattttcagccttgttgccattcaaaaaattgcctttattctggcttcgaaattgcatcaaacagcatccccaaacgactctgaaaaattggcgattaggtccaatgcatctgaatactctgatacgactttcgagtcacttcgcataattgtctctgaacatccaccggtgtcataagtaattactggtgtcccacaggcttccgcttccaagttaacggttggaaagttgtcctccttggtggggttgaaaaacacattggcagtgctatatattccagcaagcatccgaggggaatccgtccgcgcaagaccaataatgccatcaggtaataatcgaatctgtttcttactcaatcccacgagcacaattgcaaaacgcttctgatcgagggctcctgccaggcgcataaagtcagaaagtcctttccgctcagtccaggggtttgctacccccaataccataaagcgattcccgatgtcatacatcttgcgaaagtcactcgatgttggcttgaatactgtcttatcaattgtgttgtgtcgcacattgacaggatagttcttgaggaagctctgcctcacgagatcagctagccagtatgaaggtgtgatgattttcaagcgctctcgaggaatactcgtaaaggcacagcgcttgtggtcaaagctccatctgcatgagctagagccggcaattgtcttgggatacatgccgagctgcgggcacttctcgcagtacgcgcaatgagtcttccattgtgtgcacttcgcatacgtaaaatgtgcgcaatggccagtgaacgcccagcagtcgtgcagagtccactcaactctcacttcctgatgactagcaagccacgagaagagcatctctacgttaacgtagtacccgtgcaagttatgcagatgtaccacatctggtttcagctcatcaagctttacgagaagacgccttgtggctgtctttgagtggaaggctgcccgtccgtcgaggcgtgtctgcaaagcgtctaggtacacctcggaatccgtggaaaagcggtactcatgtatggcgtcctcggcagcgcgcccacgtccccaaaatacatgtgagtcctcaccagcagctagcagttcatgatgctccttcatcatgatcccaccggttgacccattcgggaatgtgtttatgtgagcccaagtcgccacgttagcccttcctccacaccatcttgtccacaatccccgtatagctttggataatcttcacgaccttggttgagacggtctcgtcggcatagtcggggacgggcgcctgggggtgagaaccctcggcgtcaaggcccacggccactcgcacggcctgaagaagaccttcctcggagattccggccaacgtaaagcagcccttgtccagagcctcggggcgctcggtcgaagttcgaatgcaaaccgctgggaacggatgccctatggatgcaaagaagctcgcctcctcgggaagcgtcccggaatcggagacaacacagaaggcattcatctgcaagtggttatagtcatgaaagcccatcggttcgtgcatgcgtacgcgtgagtcgagctcgaagccagtcttctccagacgctttcggctcctggggtgacagctatagagtatgggcatgtcataagtctcagccagtccattaatggcattgaacaggctgtagaagttctcatcagtatcgatgttctcctcgcggtgggcgctgagcagaatgtatcgcttcgactctaacccgaggcgatcgagcacgtcggaagcctcgatcttctccaagtttgcgtgcaggacttcagccatggggcttcccgtcacataggtacgctctggcggtagaccggtatctttcaggtaacgccttgcgtgctcggagtacgccatgttcacgtcggaaatcacgtccacaatgcgacggtttgtctcctcaggcaggcactcatccttacagcggtttcccgcctccatgtgaaagataggaatgtgcagccgcttggcagaaattgcagagaggcagctgttggtgtccccaaggaccagcagggcgtcaggtccagtcgcacgcatgagcttgtagctcgccgagatgatgtttcccacagtctcgcccaagtctgatcccaccgcatccatatagacttcagggtcatggagcgaaaggtcgcggaagaaaatgccgttcaacgtgtagtcatagttctgccccgtatgcgccaggatcacatcgaagaagcgacgacacttcttgatcacctcggagagccgaattatctcaggacgggtgcccacgactatcagtagcttcagccggccatcacccttgaacttgatgtcggaatagtcagttttcatcgccattccgctacacctcctcgtggaacgtgtcaggtgcttcagagtcgaagacctcattacaccaaatcacggtcacaagctcatccgtttccgagagattcttgatgctatgtgccgtacccgggggcatctcgatgacacgcatatcggaacctgaaacctcatactcgtccacggggtatggcttaccctcgaagtccagccctactcggcggatacgcacgagagcatggccgctcaccacgagaaacttctcccatttgctcatgtgccaatgctcgcccttggtaatgccgggcttgctcacattgattgagacctgcccacgctctggcgtatgcaggaactccgtgaacgagcctcgctcatccacgttaggcttgaggtcgtaggctaagctgcccagctcatagtagctgagaaacgttgagtaaagcttcttggagaaactgccctccgtgaaatcgggaacatcgagcatcacgcggctgtcgcgaaaggactctaggagcgccacgatctcgccaagcgtcttcttgtccgtcggagtcgcatggcagaaaccatcggaatcaggctccatgttccccagcatgcattccaacacgcaggagaccaaatcgtcgatataaagaagctcaagctctgtagtggggtcgttgacgtgaaactcgcgaccgtttgcgatggcgtcacagaaggtcgcaaccgccgagttgtagcgcggacggcaccacttgccgtagagattggggaaccggaagatgtatgccttggtcccgtgcgcctctgcatatcgacgcagcatattctcggcatcaagcttcgactgcccgtacgaggaaccctcgtaccgccccgttagactcgcctgtgcggaactcgacagcaggacaggcgctgcgttatgggcccactcgaggcgtgcaagcacgtcctcaagggaacccgaattacctgaaaagtcaccatcttttggacggttcacacctgcaaggtgcactacaaactctgcctgctcacaaaataccttgagttcgtcggccgtcgtgtcgcaatcacactccataacctcgagcggaagcagtgaccggtatctctttcgacggtctttgccgtctcgaatgttcttgagcgcttcgcagaggttactccccacgaatcccttggcgccagtaacgagtacccgcattactgcaccgcctcgttctcgcgtccttcaagcgccagctgcacatactcggcagtctcgatctttttgattgtgccaggcacgtccaggcgctcggcattgtcggaggtgtaggcctcgtctgcctgcgtcacaacatcgccctcgacaacgaacttgtcgtagttaaggtcgcgcgtatctgccgctacccggaagtagtgccccatgtccgtggcacgcagccgctcctcgcgggtcatgagggtctcgtagagcttctcgccgtgacgggtgccgatgaccttggtgccagtccgaccgaaaacctcctggacagcttcggccaggtcaccaatcgtagaggcgggagccttctggatgaagaggtcgccgggattcgcgtgctcgaacgcgaactgcacaagatccactgcctcatcaagattcatgaggaagcgcgtcatgtggggatccgtcaccgtcacgggctcactctctcgaatctgcttgatgaagaggggaatcacgctgccgcggctgcacatcacgttgccatagcgcgtgcagcagattgtggtgcccgactgggccccgtagcgggcgttcgcatagatgaccgactccatcattgccttggacttgcccatagcattgatggggtaggcggccttatcagtggagaggcacaccacgcgtttcacgccagcatccatcgcagcgtgaaggacgttatccgtaccaataacgttggtcctaacggcttccatggggaagaactcgcaggagggaacctgcttgagagcagccgcatggaagatgtagtccacccctccgcgcatcgcgtcgcgaacgctctgtgggttcctcacatcaccgatgaagaaccgcaccttcccaaaatcgccaggatacttgtcctgaagccggtgacgcatgtcatcctgcttcttctcgtcacgagagaagatgcgaatctctccgatgtcgctctttagaaagtgcttcaacacggtgttgccaaagctccccgtaccacccgtaatcatgagggtcttaccctgaaacgcgctcatatctctcacaatctgtccctctctccttgggtcatatcctgcagaatctgttccaagcgctcaaagaacttcgagcgggaaaattgttcttggtaaagtacgcgcgaacggtcacccatcccccgtcgcgagtcttccgtcatcgcggcgaagcggtccatcgccgtcgcgagcccttcggcatcctccgcaccacaagcaatgccacagccttcctgttcgactatttttgcaacggacccgtctgatgaacatatcactggctttcccgccgcaatgtaactctggaacttacgcgggatggtatagacaggcacaagagagccgttcgtgttcctcgcaagggttagcagcattgcatcggattccgcatagagtccaggcatcttttcgaatggcaaccgtccgaggaatacgagattcgatgcgcccagctcactcgcgagcgcccggcactcttccaaacgagaaccggatccaacaatctgcacacggacgcgtgggtttttgacaagcgaagaagctctcacgatagtctgcaccgcttggtttccaccaatattcccagcgaacgtgaaggtgacttcatcaccacgctgcgccgaaggtaggatagacataccttcaaatacatcttctgcgtattgcggcaaccatgtaacatccagcccaccgaggccaagctcatctctaaaataatctgcaaaaaatcccctcttgcagtgagttggtgttttgggttcccgtcattccatctagtagaattgccgcgagggcccaaccatcacacgagagcgcgatggtgggcggcggcgctctcgtgatgtggtagtccctggcgccgtcgccgaccaacgcggcgaggactaccacacccattgcacgagagatggcaactgcgccctcgcggcgtccacccgcccctggacaggtggccgacatcctccctgtcgcccggccaggcgctcgtgatgggatggcagaggagagcagtactgctggctcccacaggctcggggtgcgactccgacccgcgcgtttcctcaccagccctgcgagcgccgactcgtgtccccgagtccggtccgggaggatgcgatgttacggccatcgaccggggttgccctgtgttgccttgcgcttgcctgcggcgcgctcgactgcctttcgaccactcacccctgcgacggggacgatcttcgaggacgcaagctccccgttacgccgtgggtgtagttcctgcctcgcgatcaaatgtcccttcggagcctcgcggcatcgcgagcgcgcacagtcaggtcgcccccaacccgtcataccagctcgccaagctgttcatgggttctgacggctccagacccgtgtgctctcgggccgcgtgcaggcgacgagataatgtaccccgctgtcccgctgccgacagggacccccctgctggcggggcggagggccggcggctactactcgcgagaacaacacgagtgtcatcgcgatcgcgctgcgaggagggagcacgtctcggcggtccttttcccgtcctgagggctggcaagccgagcgctcgggctcgccaagtctggcgtacttgcccgcacctgtcccgcggccccgcctcgtctcgtccacgacaggggagaactcgcacaaacgtcctggtgcgtgagctcggccgcttcgtgagcgagaaccttatgacttcgcgccgagatcaagcggctctcctcgacgaggaaacccgctgtggaaggtcaaccgcctctgcttcctgctcaggctcttcctcgacggccacacgggcttcgaccgcgccaacttcccccgggtggctcgacctcttctcggtgatgatgaaccccccccgaggacaggctggagaaggtctcgctggtgctctgcgtgccctcgacgaagccccgcgctggtgctcgaccgggcaatggcctccccgaaaacgcttcgatacagggacttctaccgacaaacgccaagctcagacgggtagcaggtcaatggaacaccaactcactgcaagaggggattttctgcaaatttaggagaagtaactgcaatcttgtccgcacgagagtaaatcgtgcgcgagacattccgcatcgcacggtatgctaagccctcgcggtcaaaaccaccagtgagcaggtcttcaggccacagatcatagacatagacaagacaagggataccctgactccttgctaaccttagggcgggcagggccatctgaataggagaaaactggaagcaaattacgcagtcgtagcgtccacgcgatgccgccccagtaagccagctgtccaatggaaatgaaagatagttgagcacacgtcgaactttattaataccatgcaagtctcgcccgcgggcaacaaccggtacgcgaatcactcgtacctggttcacaatctcatcgcgatgttgaccgcgcttgtattcattcggaatctcgccctcgggatagttcggtagcccagttagtacggtgacttcgtgaccgcatctcgctagctcctcgcagatttcattggtattgaagggctctggccaatagttctggcacactgcgagaatcctcatagaacatccttcgttagcgacccactcaatttgcaaaacatatctttcgccataaattaatccatcgcgaacataatccaagaaaaacgagcttctatcacggctggaaagtaaatccaatttcaagtacatgagaatcttgggctgtttaaaactcatacacgcatcaaacaacccaaatacagtgagctccacaccatgtattggattatgaaattacgctaggcccaaacctcactttccgctcctgttcttgccgaacattgcgccgaaggtcccgaagaagcactttgcatccattggaaacccagcgttgcggacgtagtccagttcaatcttctggcgctcgcccgactcgaaggttgcgtcattacgcttggaagcctgccagagaccagtgatgccccctgggacgctgcagagcaaagccgcgtcgccaccgaagtgctcgagctcgtcgtaggagatggggcggggaccgatgacggaaatctgccccaggagcacgttcacgaattgggggagctcatcgatgctgcagctcctgatcacacgacccagtttggtgatgcgaggatcgttgtccaccttgcgctcccgcttccacacagccaactgctcgggggtgaagtacttctccacgttgtcggagtcagcgaccatggagcggaacttgtaaatcctgaagggcttaccccaacgtccgaccctcacctggctatagatgggagagccctttgtgtcgatgacgatggcaatcgagagcagtgcacaggggatgagcagcacgacgcagacggcaccagagaagacgatgtcgaatgcccgtttgacgaacctatagcccaagcccctgttgtccaggctcttgcacagttgctcgaactcttttgtgcctggctcaggcataaccacgtgtgcggatgcggactcccaggcagtgttgtcttgtaaccccgactcagccgcgtccgccgtggccgttgcttgctgcgttaccatttccacgaaccccccccccaggcatattttggggagggcctctcttcccacggcagcagcgcagactgtcccccagcccacggtacccacaggatcggacccatcattgcgtgttattgtttgcgtgctcttcccagcaccctgatgagtctacctttcaagcatcccaagaacaaccggggggatggcatctactttcgcttcccacaaagcggctgaaaaagaacactcagtccctattttgttctattttcgcaggtaggagccgtacttatgcatggcctttgcaaggagttggtaatgctccgggcagtgcgcgtcgcttgcgatgtagctgtagaggccctgcttgagcatcttgatggcggggcgcttctcggcccccagcctgccgccggcgatgaagtcggcggacgcctggagctcgcagcccatgtccacgagctcctgcgccagcgacacgtccctctggatggccatgtagcgctcggggtgggcgatgatcacctggtagcccatgccctggagctcgaagatggtgcgctcgtagtcgccgaagcggctggggctggcacccaccgacagctcgaggaggaaggtgggctcgttgtcgaacgccagggactgggcccactgcatgcccagctccatgagcttctcgtagttgacctcgaagcccatcttgacggggaacccctccgccgcgtcctcgaactcgtagaacgcgtaccacatggccttgaagtcgaagtacggcttgcggcagtgcggggtgcacaccatggacgtgacgcctgcggcctttgcggcgtcgagcatgcggagcgactcgtccaggtctgccgccccgtcgtcgacgccgggaaggatgtggcagtggaggtccctcatgccgggctacgcctcgtcgtcgtaggacttggggatgtagacgccgccctgggctgcctgcttggagcccctcctcccctgctgggcctgtgcggccgcggggcgggcgggacgtgcgggaacggcgttggcgacgcggccggcggcctcgcgggaggcgcgcgccatgttgaggaacgcagaggtgtcgtcgggcttctgggatgtggctgccttctgcgggcgcgcggggcgctcgggcgggtttggtgcttccgcgggctcggggcgacgggcggggcgctcggggcgagccgggcgctgctcgggggccgcgacctggagcttggggccctcggccttgtcctcgtccttgtagtagcggtagtagtagtcgttgtgcttggtctcgcagcagttcatgatcacaccggcgaggttgcagttggagtggcgaagctgctcggccgcctcgaccacctcggccttgcgcacgaaatgctcgcgcaccaccatgtacacggcgtcgacctgggcgcccagcacggcggcgtccacgaaggtgccgacgggaggggtgtcgaacaggacgtagtcgtagctctcccttgcctcgcgcacgaagtgggcgaagtggcgggagccgaggacgtcggacgggttggggatgtggggctcggcgtccaggaagtagaagccgcgcacctgggtcttgaccacggcgtctgcgaggggcacctggccggagatgacggagtagatgccgttgcgcccgtgcacgccgagcgagttggccatggagcggcggcggaggtcgcactccacgagcagcacactcttgccggaggtggcgattgccatggccaggttgcgtgtgacgaaggtcttgccctcgctgggcacggacgacgtgatcgcgatggtgcggatggggttgtcgacccccatgaagcggatgttggcgaggagggtctttgccgcgttgccgacggagcgctgggcgtcctcggtctggttgcccctgttgttgaagattgccattgcctacatcctctccagctgggggaagtgaccgaccacgggcacgttgagcagctgctcgacgtcctcggagctcttgacgcgggtgtccatcatgtcctggaccaccacgatgacgatggcggcgaagaggcccgcgagcaggccgaccgcgatgtagaggggacgcttggggccggacggggcctcgggggtggacgcctggtcgatcacgttgacggactgggtgccgatgacggactcggtgacgctctggaggtcgctcgcgtacgcgttggcgatgtcggccgcgcgcttggcgtccttgccggtgacggcgatcgtgaggacgcgcgtggtggtggcgctggtgacctcgacgtcgtagccggagaggctgctcatgccgagctgcttgctgacgtcctgcttgactcggtcggactcggcgatggtcgccacgtcctgggtcatcatctgggcggcggagaggtcgctgtactgggagttggagctggtgccctccgcggtgtcgttgcgcgacaggacgtacatggtggtggacgccgtgtactcgttgggcatgaggaacgccgcgattgcgacgaccactcccgtgacgatggggaggagcagcacgaagcggaggtgcttcctcagcaggctgaacagttcggctagggtcatcgggcgagcccttcctgtatgtgtgtgcgtgtcctgacggttgccctttgcgggcgcgacgggtatggccatgggcatgccgtcgcaaacgcacctcaatatagcccaaagttggcatctacgtgcaattgccacagctttgtgcgaggggggacatcggcttgggccgtaggggtcgggcggggcggtcaggatgagtcagcgcggcgcgccagaggttcgggcatgggacggccccgccgtcgggatgacgacggggccgcttctcgtgccctgctgcggagtggcgctacgccagcgcgcggcgcagctcctgccgcgcgccctcgctggtgagggcgagcacgttgtccccctcgcagaggccggtgtcgccgttggggacgatgatgtcgcccgcgcggtcgatggcgatgatgaccgtctggtcgggaagcgagaggtcgctcacgcgacggcccacggcacccgagccggggcgcacctccacctgcaccagcgcgtggtcgtcctttcccagccgcatgatggtgaagacgtcctccatgtcgaggccctcctgcaccgagcgcgcgatgaggtccgcctggttgatccccacgtccacgcccatggactcgttgaacatccacgagttcttggggttgttgacgcgtgcgacgacgcgcggcacctggtactcgaccttggcgagggtcgagaccacgaggttgacctcgtcgctgccggtggcggcgatcacgacgtccgcgctcatgaccccggcacgctcgagcacctcggggctggtgccgttccccacgatgacgcgctggtcgggcaggctcgcctggaacttctccgccaccttgcgacggttatcgaccacgacgacggacgagccgtcgcccttgaggatgggcgcaaggtacgacccggtcttgccgcctcccacgatgatgatctgcatcactgcctcctactcgctcttgccgagcatgtgggcgaacttccccgctgcgctcgacgcgaccgcggcgtagaccacgtcaccgtggccgagcaccgttccctgggtggggatgaacgtctcgctgttgtgcgagaccgcgacgaccttgacctcgcccacggcggagatgtccctcacgggatggccctcgagcagggcgggcacatccgcccgaacgatctggacctcccccgtgcccacctggaacacgctctcctgctggttgtaggtgaggagctcgcaggcgcggcgcacgccccagtcggtggtcgagatggtctggatgcccaggcggcggtaggtctctgccttggtgacgtcgtacatgcgcgcgatcacgcgcggcacccggtacgcgtcacgggcgatgcgggcgatgatgatgttggcctcgtccgacgtggtgcacgagacgaccgcgcttgcccggtcgatgcccgcctttgcgagcacgtcgcggtcgaagccgactccggtgaccttcctgccggtgtatccctcacccagctcctccaggcgctcggggtcctggtccacggcgcagacgctgtggccctggcggtcgagcttcctcgccaggcccgtgcccatgcggccaaggccgatgacgataacgttcatggcgtcctacctttcacttgcggcgtcagccctgacgccattgcggtcgtagtgcccgtgcctgcgcacgattgccttgcgcccctcctccagaaggaggacggcgggcgggagcagcgccaggaacaggtagtcctgtgcggtgagcgggcaggtgtggaacacgccctggaggggcgggagcagcgtgatgagcacgatgagcgccacctcgaacagtatccccttgtcgacctgcctgttggagagcaggcccacggagaacaccgacgagacctccgtgcggcagttcatgacctcgccgatctgcgagaagacgatggcggcgagcgccatggtggtggagcgcacgtagacggggtccaggtcggcgcccacgccgaacatcctggcgccgggcgcccagcccgccgcagcctgcgcgaagaagaacgcgccgagcgacgagagcgccccgagcaggccgtaccacaggaaggccttgcgcatcacccgcgcgttgagcagattctcgttggggtcgcgcggcgggcggctcatgacgtccgcctcgggcggctcggatcccaggccgagggcgggcagcatgtcggtgcccaggtcgatggtcaggatctgcatggtggtgaggggcaggggcacggcgcctccggagagcaggtacaccgcggagggcacggcctcgggcacgttggagttgaggatgtagagcatgaacttgcggatgttggcgtagaccgcgcgcccctcctccaccgcgctcacgatggaggcgaagttgtcgtcggtgaggatcatgtccgcggcctccttggccacgtcggtccccgtgatgcccatggcgacgccgatgtctgccttcttgagcgcgggcgagtcgttgacgccgtcgcccgttacggcgacgacctcccccatcgcctggaggttctcgaccacgcggagcttctgctctggcgccatgcgggcgaacacgatctcgcctttgagcgcgcggcgcagctcctcgtcggaggtccgctcgagctcgggcccggagaacacgcgcgggtggctgcccctcacgatgccgatcttgcgggcgatggagacggcggtcaggccgtagtcgcccgtgatcatgaccacgcggatgccggcccggcggcactcctccaccgccgcggcgacctcgggcctcggggggtcctgcatgacctcgagccccacgaaggtgaggtctcgctcgatcgtctgcgggtcgtactcgctcacggaggcgggcacgccctcctcgtcgcggtgaatcggacggtaggcgagcgcgagcacgcgcaggccgtcctcggcgtagccgtcgttggcgttcatgatgcggctgcggagcgagtcgctcatggggacgacctcgccgttcacgcgcaccttggtggagaggcgcacgacctcgttgggtgcgcccttcacgaaggccacccgggtggcgccgtcgagcgggcgctcgagctggtggatggtggacatgcgcttgcggcggctctcgaagggcagctcgcggacgcgggggatgcggcgctgctcctcctgcaggtcgaggccgcccttctgggcggagaccagcaggcaggcctcggtggggtcgcccagcacggtgtagcggccgccctccttctccggcgcgatcagacgcgcgttggagcacagggcggagcccgtgaggaggatgcggaggtcatcgtcgtcggcggcctggtagctgcgaccgtcggcgcgaatctctcccttgggggcgtagcccacccccgtgacctcgtactcccttgcgggggtccacaggtggttgacggtcatctcgttctgcgtgagggtgcccgtcttgtcggtgcagatgacgctcgtggagcccaacgcctcgacggaggagagcgacttcaccagcgcgttgcgcttgctcatgcgctgcacggccatggcgagcgacagcgtgacggtgggcagcagcccctcgggaatgaatgcgacgaccatgccgagggcgaagatgaacgacgccgccaggccattgtgcacgaaggcgacgtccagcgcgaagaacgcgacgcccatgcacagcgcgaacaccgtgatctgcttggtgaggtggtcgagctgcctctggagcgggctctccttctcctccatgttctgagtcaggctggcgatcttgccgaactcggtggacatgccgatgtttgtgaccaccacgcgaccgttgccctcggacaccgaggtgccctcgaacaccaggttgggggtctccgcgtgggtcaggccctcctccagcacggcgtcggaggtcttgcgcacggggttggactcgcccgtgagcgtggactggtccacctgcaggccattggcacggaccacgcggccgtcagccgagaccttgtcgccctcctcgagcagcatcacgtcgccggggaccaggtcctcgaccaggatcttctgctcgctcccgtcgcggatgacgctgacgtacgaggggagcatcttcttaagcgcctcggtcgccttgtcggcctggtgctcctgccagtagctgaagcagccgttgatgacgttgacgagccacacggccacgcccagctcgggcatccccgccgcgaaggcgatgatgccggcgacccacagcaggatcgccatgaggtgcgtgaagttcgacaggaacaccagcacctgcgacttcttcttcgcggactggatgacgttctttccgtagcgcccctgacgcgcggacgcctcgccggcggtgaggcccgcctgtgccgtccccatcgccgagaagaccttatcgggcgtcagccgggctatcccctcgatcggcgaggacgtcgccccttctgaggcttccaacgaaggccctcctttcgtctatcgccgccccaccattgcggttgggcggcgcccactggcggcagccaccgcctttcgaaggaaaggctatccgctttcaaaccgttcgaacgcgacggcacgggggtggcacgatttggcatacgcccagcataagagggtcattagtgaggaataaggatggcataaaagtcgcaggtgagggggttgggtgacatttgtgcggtccttcgcccggcgcgcgcggctcaccgtcgccgccgcgatgggggctggccggggggaggacgttgggccggggcttgcgcaccgccgcggcaggaccccgggccggggcacgcggtcagacacgagccgcgcggcacccaacctgggggaggcggcacattggcacccggcgggacgggtgcggggaggcgggggtcagcccctctcccccacctcgagcatgcggtagcccacgcccacgtgggtctggatgtagcgggggtgggcggtgtcggcctcgatcttcttgcggagcgaccccatggtcacgcggagcgacgcgagctcggcgccggactggtcgccccacacctcgcggaggatcagctggtgggtgagcaccttgccgacgttgtgggagagcagacacagcaggcggtactccgtgggggtgaggtggacctcgctcccggcgagcgtgaccacgcccgcgtcgtagtcgatgcgcaggtcgccgtcctcgaagcgcgaccgcgccggcgcctggcgaggggacgagaccgcttcgccgaggtagctcaggtggcggagcgtcgccctgacgcgcgcgaggagctcgccgaccgagaagggcttggtgacgtagtcgtccgcgcctgcatccagcgccgcgatcttgtccgagtcctcggagcgggcgctcaccacgatgatgggggtcttggaccagccacgtatggcgcggacgacctcgacgccgtccatgtcggggaggccgaggtccaggagcacgacgtcaggggagttggtggcggcgctcgcgatggcctcgcgaccggtggaggcgcacaggtgccggtacccgttggcgtcgagggcggtcgagacgaggttgcggacctcggggtcgtcctcaacgaccagcagggtgggcgcggcggcaggagcgggggcgtcgggtcggccggtgccggcgggacggacggcaggcgcggcggcggtgcccctctcccccaggctatccccttggctcatcgccatcacctcccggaagctcgcacgcggggaggcggaaccagaacgcgctgccgtgcggctggcgcgccccgacgccgatggtccccccgtgcgccgtcacgatcgacctgcagagcgagagcccgaggccgaagcccctcccggcgtcggcgcgctcgcgaccgacagtatagaacgagtcgaacacgcgctcgcggtcggcggcggggatgccgggcccatcgtcgcacacgttcgtgaccacggagtccccctcgcggcgcagggagatgacaatcgaggagccgtcgggcgtgtgcttgacggcattgttcaccaggttgaccaccacctgcaccatgaggctggcatccacccttacgaggcacacgccgcgggacggctccaccgtgagccggtggcgggcgacacgcgggtcgatgtgacgcagggcctcctccacgacgtcgtccatgagctcgaggtcgaggttggggcggacgccgccgctctggagccgcgtgatggcgaggaggttctggacggtcgcgaccagccacgtggcgtcgtcgcgaatccccctcagcaggcggtcgcgctcgctgggagcgagccggtcgccactcgagaggagtacgtcggcgctgccgctgatcgaggtgagcggggtgcggatgtcgtgcgagatgcctcgcaggaggtccgcgcgcagctgctcgttgcgggcgcgcagctcggcacgttgacgctcgcgggtggcccgctcgcgaccgagcgcgaggcccgtctcgcctaggaccgccatggcgacgtcgcgctggccgggggtgaggtcgtggtcccccacgacgatccccatgacgccgtcggggtggtggggatcgccgacgggggcgtacaggccggaggcggccgagaagccgtccgtgcccctgccggcggggacgccgttctccagcgcgcgcatggcgacggggagctcgagggggacgtccggcgggaggctcgcctgggtcgggtgcgctggggcagggaccggagcccgtggcgcgaccgcggtgggatgggcgcctcccgaacccatgcggtccccgccacagccggatggtccgggcttctcccctaccgtctcctcgcccgcggccgggctgaaaaagcgaacaggagttaggcccccgtcggtcgcctcgtaccacacgacatcccggccgagcagcgccgcgagttgcctgccggcggcatccacgatctggtccgcggaggcgcagtcctggagcaggtggtcggtctggaggaggaacgccatgaggcgggagttctcctgggccaggtgcgcgtggtggcgcaggctcatggcgagggtgctcgagagcagggcgacgatgcccatgaccgcgaacgcgccggggtactgcgggccccacgcgtggagggagaggcgggggtcgatgaagaggtagttgaagagcaggaccgaggcagcggtcgcgatgacgcagtggaggcggcgcgtggtgaccaaggcgaccacctggacggagagcacgtagatgataacgatgggagcctcgcccatgtcgagggagtcgaaccagaacccgaggagggtcgcggcgaggagcgaggcgagtgtgagagcggcctcgagcgcggtgcggtgcgcggtggggacctcgggccaggcggcgaggatggagaacgcgcgggtggagagcgaggggcgcccgcccccgctcgacggaggtgcgctcggtttgccgcgttccccactgacgttggcgtccatgcccccaccccatcacaggccctggcgcgggcggcgcggcggaggaaggaccgccggtcatgccgcgcctcgcgtcatgccacatcgcggccgcgctttcagtggcacatgatactcccgaccgccttgtgtgggcgggggcgggagggatggaatggcaaggacgcgggcgtgggggcgcctggcgaggaccggatgcggggtgcggcgacttgggtgctgaggaaagtcgagttgtggcaatccgaggggagcgccagaagcccaaccgccgggaaattgcgacctttggcagagaatgggcgcctccgaccgccaatactcccctttcctcagcggatttggctttcagattgccataactcgcatttcctcagcaccccgaccgcttgggagcctgattcgactcgcgtgcactagggagcggtggctcggcgccccacgggacttgggaccctactcccccacgtagcggaggatgtagttccacgggaagtcgtagacggcctgggtctcgatctcgtgcccggtctggtcccccgacctgccggtgatgccgccgttctcgctctcgcgggcggcgaccatcatgccctctccgatgtagatgccggtgtggtgcgttgagttgaggaggatgtcgcccctgagcaggccaagctgatcatgcgagaccttgaccaccttgaagccgctcaggttgcccaccatgttgcccgtgtacgttgccccgcccgtcgagatccccgccgcacgcagcgccgagatcaccaggctcgagcagtcgtagttgggtccccagcggtcgtactggtcgtagccgtggctgttgtcggcggcaatgccgagcgcccagttgacgtaggagtccacgcggcgggtccgggcgttggagtactcggcgagcctgccgtcgttgtcggcctggtaccagcggttgttgcagtggagctggcggtcgcgcgcgacgtagccaaggcccttgtaggtgtagtgggcccagccgtcggtggagtagccctcccgggcgtaggagtagccggcgggatcgcggtagaggtagtagcgctgcaggccagagccgtagtcgtcgacaatccagcccgagcgcctctcgacctcgccgttggagcgggcgagggcgatcctgccgtcgcccaggttggtgacggcatcgaggaccgccccgctttgcgtggcgtaggcgtagtagccggcgccctcgtcgggcgtgaccatgcgggacttggcgatggtcgcgttggaccccacccagtagcggttgagtgagccccacgagcggcagaccagccagaagccctgaatggcgttggcggagcgggtgctggcgtaccagccgatgccctcggacctccagccggcgtgggcgagcgcctggtcctcgtagccgttctgggtgaagttgtgggcgccggacttggcgttggggttgtactggcggtagacgggcagggcgtcgttggcgtccgaataccagccgatgccctcgtacctccagccgaccttgaccagcaagtccttctcagcggcgctggtggtgtagtggtggtcccccgcgttgaggttgtagagccggtacacgggggtgccggagcttgcgggcgcgacccagccgatgccctcccagcgccagccggcctcggcgacgcgcttggcctcgccgagacttgcggtgtagaagtgctcgcccgtattggggttgtagaggcggtacatgttctggaccgcgggggcgggggtggtggctgcggcgggattggggtcggcagcgcggggcgcggggtccgcggcgggcgtgtcggtggcagcggggtccgcggcgggcgcggggtccgcggttgggtcggagggagcgacggtggatgaggggtcggttggggcggcgggcgtcgttgagttggagtcggcgctgggggccgtgggtgtcgccgggtccgaggtcgacggggtggcgggctcggtggagctcgcggcgggatccgtgggggccaccgggtccgggtcggatggcgtcgcgtccgggctcgtggagctgacatcacccgcgggggtcgccggggcgtcgacggcgggggccggggactggtcggagccagcggatggggttttggcgttggtggcggcgtccctctcccccgccgctgacgcgggctggtcgggggctgcagcctgggcggccgttgcgtcctgcgctggggccgcagtcgtggctttgggggcgtcctccgcgagcgcgagctgcggcgatgcgaccgctaccagtgagaatgcgagtccggcgctgatagcggcgcacctgtggccgagctttcccgacatgtgagtaccctcctgaatgcgaaccaagaagcgttcccatggtagtggttcgctcgtgggcgcgacgggaacgtgccaggttttggcacgagttgttcacagggtgtcccacgggggtcgtcgggtgaccgggcggaggctggaggtggcacgccggtggagcctcggggaagcgttgcgcggcacggacgtccacgctacgctcgacgcagtccgcgagcgagggggagcgcatgggtcggaatgctgggaacgtcggggccgatggaaggggtcgcggggaggtgcttctcgccctgttcgactttgacgggaccctctgcgacacggagatcctggggattgggctggaccggccggtgtacgcgtcgtttggtatcaaccccacggaggaggagatgcgctcgctgtgcgggacggatggcgaggagtcgatcccggcgctgttcgagcggtacggaatggatgtgtcggcggacgagttctatgcgcgtcgggagcccagcgacgtgatctacgagcggatgcccctggagccgatgcccggcgcgcgcgagctgctgggtcggctggcggcgcgccggatcgcgtgcggcgtggtttcgacgacccggcacgacctggtggagacggcgctgcggcggattggccttgcggggagctttgcctttgtggtcgggggcgacgacgtgagcgcgcacaagcccggccccatgccgtacctgcgaggcatcgagcttggggcgcacgagctggggattggcgcggacgggctggcggcgcggaccgtggtggtggaggactctccgtccggcgttgcctcggggctcgcggcggggtgctacgtgtacgggttcacggggaactcgacgccgcaggacgttggggcggcggacgaggtggtctcgtcgctggagctggtgctggcgtaggtgatcgcgggcgccggcgcgctggggcaggcgctccggggggcgccgcccggaatggctgctgaggaatctcgagttgtggcagccgcgacggggtcccggggggcattcgggacgacacctgcttaggaatctcgagttgtggcaatcgcggggctaattccgctgaggaaatgcgacctttggcaatgagggggcacccgggaccccggacaaaatcccggacctcgggagggtccaggaaggagtccggatgtacacgagggaggagcgcgaggggatcctctgggagttccaccggagcggcctgatcgccaccttgcgcgttgtcggggggccctcgccttggcgacatcgagcgggtgacgtggccctcctcgcacgccgaggcccagtgtccgtcatgtaaaacgcccagccgtcggggtggaccaccagcgggcgcgcctcggtcgccccacggcccccaccaggtccccgagcatgcccaccatgagctccttgtccgggtgctcagcgagacctccagcagaacgggctcccgtcgaaagcagcgatcgcgggcgagaggtaggcttgtagccgtcgagggcgaactcggtgacgtcggtggaagcagagcaggccgggtcgccgcgcggaagtcgtgcgtgccgtcctccccgagcggcaggttgtcggcctcggggcgagttcgccgcggtagctgttgtatgggggcgggcctcctgcgcatctggccgccttcctcgcgacgaggccctcctcccgcatgatggccctcacgaccttctcggaggcgatgaccgcgtcccctcgtcgcctccgcgaggtcgcgccacgagacgggctcgccctcgccggccttcaggtcgcgggtgacgcttcggagaccgaaggtccgccggcggcctcgagggacgcgcgggacgcgcgcccctgagggcctccttcgggtcggtgcgggagagcctggccgcctggccgaggtaggtgctcttgggtatggagagggtctcgcagacgtcagcgagcctgaccgcgggctcgcctccctggcgccctgcccgcgaggtacctctccccgtggtcaaagagccaggggcgggtgcttttaggacccaacacacgcagggcctcggcgagctttacctcgtcatcctcgcccgctccgcggggttcctccggcaggtcggcgccccagtcgcgccagtccgtcgccccgcgtgcctctcgatgtccgccaaggtcgcccccgtccgctcgcccccgtcccacgacgggaaggctaccacgccgcgcccactcgcggcgggctcgtggggccgccggctcggtgcgtgcagtgcatgcggccggcccggccgggcatctcccgggcgacgagctcgccggcggcctccgcccgcagccagtccgcgaggacttccgtgggggaacatcggaagctccct

SEQ ID NO: 414 - DNA, 7241 bp, Unknown
  Metagenome-assembled genome
cgatggtcctcgaccgggcgatgaccgtcccgatttcgctgccctacagggagtactacgagagaagtgccagctcggaggactagcagctcagaagtttaccaactttctgcaagagaggatttttgccaacaaatccgcgcaatccgtttccgccgtaacagggatacggatgatcctcatccatggtttcgacgattccgacgaggatgcttacgaccgttttgaaatcagcaaattgcgcgtcgaccatccggacgaacccgagggctgggagaacgtcctcacactgaacgccgacttcgaggcggtgtccgtcgagacaggagggctctccgaggaggagaaggacatcgacctcctgctttcagattggtttctcgccctgccgtgccccttcaacgcgggcgacgtcgtgattgacacaacggcccccggagccgccccgttcgtcttcgatcgtctcaagttctgggactcgaaggagatggccgcgcatggagtcaacttcgattcgaggcgggcggaaagtctcgatgccggcatcgcgagacagaacgagcgtagctcctgggattgctcgtatatggtggcgatgggttacgagctcgctgcggagtcgcagaaccccattagtgaccatggctgcgcctactatgacccgtatggtgcttgcaacaattaccttgatctcgagcactacgaaggtgagttgcgaggtgagcgtgtgcttctcgccaccatctctgagcacctcaagggtagacttggcatcgaggagttcctgaacttctcacaggccattagtctcgacgcgcacgcaaggaaactaaaagacgacttcgaccgcgactacctcgaggaagtccacggcctctatgggggcaagacaagtggtcggcatcggtacacggaggagaccacgcgatgacgcacgaagaagaggttgccacgataggcaagctcatccagttggaagaactcatcgagagcaggcagagcgagatcagccgcctcgaaagcgagacctacgaacagagtaggaactcaatgcggaagccgacgagaccttccgagccaaagctccgcaagccttcggagcccatgaggcaagaggtcaagcgggaatatcctgacgccgagagcaggtccaaaaagccggcgggatgcctccctgtcatcgtggcctggttcgcgagttgcttcgccgtatggttgctgaggatggcctttagccttgaggacaacctcttcttcaccctcttgcccgtgccaatcacggctggcatagacatcttcctgaatgaccggaggaagaaggacggaaagcgcatcgaggaatccaaagagttccaggacgaaatcgcggaactcgacaggcagtacgacgccaagcaggcggagtacgacgcccaatatgacgaggcggtcaagcagtacgagcgggccaagaaggacgcacagacacagtatgagatggaccgaaaagccttcgccaaagatttggctaattacgagttgatgctcgcgcagtacaacgaggacaagcggaagtggggggaactgcgcgatctagctgtcgtggcgctgaggaagacgatgggcaacactcacgatgagctcgaggcgctctatgactcgagcgggctcgtcccgcgtcagttcaggaacctggacgcacttcatgccatctacgagaccatctcgacttccaatttcgacgtgaaggcggccatcagcctctatcagcaggacaggcagcggaagcttgacgagcgacgaagacaaatcgagcagcagcgcctccgggagctgcaggcagcaaacgaggaggctgcttggcaggccgcgaggcagaacgacctgttggaggaacagaacaacatcgcgcgccgtactcgccgcgacatggatatcgccaacgccgcggcgatggcgcagaggcgcgcgcagcgcaaacaggacgagcgcatcgcaaaggaggaaaggcagcgcgaggagaagcgggagatggaccagaagatgaaggaatggcatgaagaatcggcgtatcggcagatgcgccagaaggtcatcgacgagaaccaagaacgcctgcgcaggggcgagccgcaacttccagtgcctccgtggcgcccctagctaacacaaaagtcttaaaggtgcagccgaccgtggcaacattaggggtgttaccccattcgctgcgccgcagtcgtatacgtggcgtgcagctcctcgcgtagcgcctccggcttgatcacctcgatgctgacggcgttgagcagagcgaatctcctgagcccctcgacgttcgtgcggagcgtgactctgtaggtgccaggcgtgccgcgtttcgctgtggtctcgcgcgtcacataaacgttttccttgccgaagtggtctatgacgtccgagaccgtgcagcggggactctccgtgaggacgaactctgcatgtgccgagtggcccggcataaggtcggggttttcgcgcaggtgcttccgaacgttgaacctgtcattcctaccgtcggcacctgggaggtggagtgtgtcgagaccgttcagcctatcccgctcctcgccaagaatctcgacggccttcatgcggtcgagacggtacatgtcgacatggacctcatgggctttcatggagtccaagacgtcctggaggtgggagataaaacgttcggcattgttgtcgtgaagtattgcgttcgtggttgctagcaggtagaagtcaccgtcgctcgtgcctattcctaaggggcttacggttatgatgcgctcgtcgatccgtagcttcttatccgccccataggatgcgtagttgaaagagacctttttctcggcggcgatggcctcgctgagaaggtcgatgttcaggaacagctcgttgtagtccattgtccccttgtcgctttgtataaggtagctccgcatctcgtgatgcatgctgccgcgcgaaagtgattcgagcctctcgaccatgcttcccttgacggaagacgggatatgcctggagaagatgacgaggtataccagcacccgaagctcggagtcctcgaagagcggctcgtgttcgatccagaagtcggtcttgacgccgtcggttccctcacgtgcctcctccgtgcaacgcaacccttcgacgctgcccatgagcagctcgagccgtcggtgcagggtcttccggtccacctcgatgccgtagcggtctgcgagccgctgcctgatctcctcctgagtgagaggtttctcctccgtggtgtcatagaggatgtcgagaatgcaaacgtccttcaggctcttcggtatcgcaacgccctcgcgaatatgcaccatgactgccgtcctcttataacctcttgcccgagccagagcatctgcctaatgatgggtcagaaaagccccattagattcttataatactgatgtaattggtgattgagaaagggagcggggagtagagcggtgagtctttatagtcccagcctatgtgatggtattgaaagccctgaggagtttctagccatctacggggcgatatatgactatctgaatcgcaatcaagcactcgagagtaagattgacgccctgttacagatgggcatgccccaagctgacacggacgaattcacggaatctatagctgagatcatctactggaaggtcggaggcacccaccctgtggacctgtcccgcccaagtgaaggagactggaagatacgctaccaatacggagagatagatgtcaatgaggtcgctgacaaagccagaaaaatcgtcagtgtgcccgaggacgacgccctcctaagaaactccctcttgggctttgcctccgtacggcatatggggcccgtttactccataactatcgctcacttcctatctcaaggacggttgcccatctacgacaagtttgctcaaatcgccatgctttcgatttgcggtcaagggttggccggtagaaaagcttcagattgctactatagtgatcgatacatcaatcattactccccggcatcctcctcagcaattgacaccatagttaaacgctactcggcctatgtgagccttgctcaaagggtgtatggattgcttgaaaagggcggcgttactgatggccgctttagccgtagggtcgacaaggcactttgggcctacggacatcttttcagtgagtccaaggctacctccgggaagctaaggattgagtagcggtacgcacacaaagaattagcgcggcgctctggcaattccaatgtgggttacttgcgaaatatagacgtttaattagattaggtcggtatcaatggcaacaaggttcgtgtacaagactatcgacgtagccccgtttatccagcagatgcccgtcgagttcgaatggtacggaggcttctcacttgcgcagaagcgtcgctgcatcgcttcgcttcatcgggcatatgcctccaatcatccaggtgacaggctactggaaatctcgtccaagagccccgatgggttcggggtctccctgagcgcgttcaacctcacgctggagctgggtagcaaagtggtccccgtggaatgtgcgttccaaggaagcaaggtcttcgaggagggtggcccctatgaagatctcctcgaggtgagccccaaggacgccaagcgcgaccccaggctgcgcgagagcggcatgctagtggcattcgagctcgctggggaacgttaccccctcgagccgaaggacgccttctacaactggctttggataagcgccctgtgccaacacgaggatctagccagaggcgcgctggcgtacgatgccttcacggacatagagttcaacccgcagaggtccatcaactgccaggcgatcgccgctgcgttatatgtgagcctcgcccgtgcggtaaagctggaggaagcgctccgaggcttcagaagcttcaggaaaattggctacggagttagccgttgggaaaccgacgccaagcgaaatgggccacaggcatgtacgagcagatgacggagagaagcgacatcctcgcggcttgggagcatctatatgatgacgagtgtaggcatcttgatgtggccgcgttcaaacgcctggtctttgacacatactggtacttcaggaagtcaaaagactacaactccgtgcctcgtgatgatcttcctatctaccgttacatcgcttgggttgtgatggcagtggatgccttcccgcagacctgcaaggaatacgagttcctttgctgtaacgagttcgcggctggccttctccaggcgattgaggatggcttccagcgtcgataccacaaggtcgtcctctgcctcgggctcacgtaccacgtgccggcgggtggcgacgcgggcgaggctaacatgtccagctatgacaagtacgacagagccttccgtagggaactcatctgctacatgcgcgagcaaatcgagcaggaggaggactcgtgcgacgacaatgtcttgagcgagcaggaggagcttcgtacgatagcgtcgaccaagggagcctagtcccggctgatagtcctccatggatggtcggggtagaactctttgggatatgtgctctcgtactcctcgcaaagggacttgcagtcgtttctcgattccaagtagcgcaggagcccgtgcgcctcgtcgaagcgtagtctgcccttgaggaatgcagatatgacatctgcccactggtcttgcggctcaagcctgtcggtagcgtattcaatgttcagataatcatggccggcgtgtcccagccataactcaccatcatccatgccatagcccgaccatgcaaggtcagatgtgtcggtgacgtacagttcctttcgcaaattgagggtggcgtagccgagagcggtgcacgctaaggcgcacggcccctccggacggtatgatttcgctcgccaaaacaagtcatacgaatggacggaggggccatgcggccaccaatcttaacgcttgacgaggacgccctcaaagacgagatgagggacctcgccagggggacggtcgaggaggccatcaacgggatcctcggtgcgcgggccgacgagctcgtggacgcggggcgctgcgagcgcaccggcgagcggcaggcctacgggagtgggcactacggccgcgggccgctcacgcaggcgggcaagatggaggtcggcgtgccgaagctcgggggcgtgcgcttcaccaccgaggtgaccgagcgccacaggaggcgcgagagctcggtcgaggaggcgctcgtggagatgcacctgctcggcgcgtcgacgcggaacatcgaggacgtcaccaggatcccctgggacgaggggctctccgctggtgcggcctccagcctcagccagggggcgttcaagagggtgggcgcctgggtgtgttttgtcaagtcgcaatgagcagaatggtcatcaatttatgagcagcctgccagcacgtgctgagcaggctttctgagcacctccctcactgcatgagcgcatgcctcacgcggtatgattcgcccctgaactgcaggagcctgccgtggtgcacgacgcggtcgatgactgccgccgccatctggtcatcgccgaacaccgatccccacctggagaactcgagttgggcgtgaagaccacggactgccgttcgtaggctttccgatacgacctggagcgcagcctggcgtccatcgcgtcgatcggcatggtccgccgctcgtctaatgacagtcagcctcggccctgccgatctggtcgccgctttcccggtgagccggctcgtcgggcgccgttcctgagcgcactcactaggaccgaggcgtaaaaccattgcaggcccttgcaccctggcagcgagcacgcaccacgcgcctctgccatgttggggtcttgcctcgtgcccccatcgccatgagcaccgaggtcctcatggctcctccaggaacgaagcgagagagctgtccctgccgaagccttccggccagccctatctgctcccattcgtatccgtacgaaggtctgggctgtgtaggcgctgcagcgccttcgcagttcgcgcgcttttggagcgcgccctgctctcgcattcgcttcaggtaggcagcgaggtactccgcctgccatgggagcccccctacccggaccccatttccagtagcaccgatcttgtgagggagcacatcctcctgccgcgcgacgtcctctccgccgcacctccgccgtccgccatctcagatcg

SEQ ID NO: 415 - DNA, 88559 bp, Unknown
  Metagenome-assembled genome
ctggccgggcgtcagggaggaccgtcggcaccgtcccagggcgtggtacgccgagggcgcgtgccatctctcgtgcatgtgtggtagtcctcgcccgcgttgggtcgcgacggcgccaggactaccacatcacgagagcgccgccgcccaccatcgcgctctcgtgtgatggttgggccctcgcggcaattctactagatggaatgacgggaacccaaaacaccaactcactgcaagaggggattttgtcgagtaatggcaatctgaaagtcgattccgctgaggaaaacggagtattggcagcccgggaccccgttccggcgtctcaaccccacctttcccgtcgcttagcgtgcattcgaacgccccgattgccaatactcgcatttcctcagcacccagtctcccgcgcgctcccaagcgcgcccccggcacccgattgcacgccattcccttctccgataccgactaaaccgatagccaggtgctaccgttggtgcgtcagccctcgattacaagagaaggagtccccatggcccacgacaagagcggcatcggcaccacctgcgtgcagggcggatacgttcccggcaacggcgagccgcggcaggtgcccatcgtccagtccacgacgttcaagtacgacacctccgacgcgatgggccgcctcttcgacttggaggactccggctacttctacacccgcctgcagaaccccaccaacgacgccgtggcggcgaagatcgcccagctcgagggtggtaccgcgggcatgctcaccagctccggccaagcggccaacttcttcgcgtgcttcaacatcgccgaggcgggcagccacatcgtggcgagctcggccatctacggcggcacgttcaacctgctcgcgcacaccatggccaagatgggggtcgagaccaccttcgtgtcccccctgtgctcggacgaggagctcgaggccgcgttccgccccaacaccaaggcggtctttggcgagacgatcgccaaccccgcacttgccgtcttcgacatcgagcgcttcgcccgggcggcgcacgcgcacggcgtcccgctgatcgtggacaacacgttccccacgcccgtgaactgccgtcccatcgagtggggtgcggacatcgtcacgcactcaacgaccaagtacatggacggccacgcggtgcacgtgggcggcgcaatcgtggactcgggcaacttcgactggatggcgcacgcggacaagttccccggcctcacgacgcccgacgagtcgtaccacggcatcgtgtacgcgcagaagtttggcaacgccggcgcgttcatcaccaaggcgaccagccagctcatgcgtgacttcggctccatccagagcccgcagaacgcgttctacctcaacatgggcctggagagcctgcacgtgcgcatgccgcgacactgcgccaacggtcaggcggcggcggagttcctgaacgcgcaccccaaggtcgcgagcgtccgctaccccggcctgccgggcgaccggtaccacgagctggcggagaagtacctgcccaacgggagctgcggcgtcgtgagctttgacgtggcgggcggtcgcgccgcggccgagaggttcatggcggcgctcaggatctgcaacatcgagacgcacgtggcagactcgcacacctgctgcctgcaccccgcgagctccacgcaccggcagatgacggacgaggagctggtggcggcgggcatcagcccgtcgatggtccgcctgtcgtgcggcctggaggacgcggacgacatcatcgccgacctggaccaggcgctggcgatgctgtagcgcggcgggtcgcgcgcggcttgcgccagcatgggggagaggcgcgtcccatccggcttgcgacgccgtcgcgccggggtcgcgcgcgactgggcccaaggggaggggcggcgtggcagggacgccgtccctctcgcccgcgacatccgcccgcaacggtagaattgccccgaggaacggacccataccagagagaggaagcgtgtctcccatggcagacgaagagatggcagcgcaggcggcggactcgcaggaggcccccgtggcagcggcggccgagggcgtggcggaggaggccccgcaggctgaccccaacgcccccacgatcgagcccatcgccgacgagatcgactttgacacgttctcgaagtcggacatgcgcgtgtgcaagatcctggagtgcaccgcggtcaagaagagcaagaagctgctgcagttcacgctggacgacggctcgggcaccaaccggaccatcctctcgggcatccacatgtactacgagcccgaggagctggtgggcaagaccgtgctggcgatcgtgaacatccccccgcgcaagatgatgggcatcgactcgtgcggcatgctgctctcggcggtgtacgaggtcgccggcgaggagcacctgcacctggtgatgctggacgacgccatccctgcgggcgccaagctgtactagcggcgtggggtcgggcggctgcggcgtgggcggcggcctctcgacccgtgcttcccatgcgaacgaaggcggagcccgtcggggacgacaacccggcgggcttcacatgttgtgactgcgttccgtcagacgtgcgacaggaacggtacgctcctcttcccaaaagacacaatatgctgtatgcggctcttctggagacacaacaagtggacataaatgctactaatctgatagcatatcagcccaagccggacctccggtccgcaccacgaagccatccgccgcgcgcactgatatgagaggttgattgtcaagaggcaagaccgcccgggccccggatttcccccggcgcctgtgcggtcagtccttgtcgcccctccggcgacggccgcgtctctggcatggtcccaaggacgcgcgttcgcgagtctgacatccgcgcgttggctagcgcattccgactcatccggctgggggttgccgcccgtctagtcacgcccgtggcacgcgggtgcggggcgtagtgcgttcgcgggtctctccacgggccgtcgtcgcggccggcgccggaggggcggggccgctacgaggccgggcccgccagggcctgggcctcggagcctatcgcccagacgaagcccgcgagctcgcgcgcgacggcggtcgcgcacacgcagccgggcttgcccctgcccctgagtcgggcgaacctggcgtgcagccgctcgttgcacctcccgcaggcccccgcgatggacgcggtgggcgccgcgtccctccacctcgcctccgaggcgggcgagagcggcctctcgtggtgccaggcggcctcgacgaggagcctcctcgcgtgggcgttgcccgccctcgtgatcgccccgcggctcaccgactcgcccgacgaggactcggagggcaccagccccacgtaggacatgagggagcgggcgtcccggaacctcgagaggtcgcccagctcggcgtcgagggcgaaggcggtgagggtggacaccccccgtatcccggagagcgcggcgaccacgggggcgtgctcgggggccgccgccctcctcgcgatctcggcgtcgacgcgcctcctgcgctcctcggcctgggcgaccgcctccaggagctcggagagcacgaagcgctcctccggctcggggagccctatcgagcgcagccactgcctgtgctcccgcgtccaggtggtgcgcccggggtagacgagccccttcctgaggaggagcttcgacagctggtggcgcgcccgcatgaggtcgcccctgacctgctcgcggagcctcgagaggtcgcggtcggcctcctcggccggggtcggacaccagcactcgacgacgttgcccacggcgagcatgcgggccaggaagtcggcgtcgcggcggtcggtcttgaccctgtcgcccgacggccggagcatcttggtgacggccccgaccacggtggggagcccgagggcgtcgagctcgcgcttgagggcgaagcccgtgggcccgctctcgtagaccgcgcggcagggccggggcaggccggcggcccaggcggccaccgccctcgcgtcgcccccggggaaggaggccctcaccacctcgcccgtctcgtggacgagcgccgatgcggttatcgagcgtgcgtgtacatcgagaccgatgctggtagagtagagcatggctgggacctcccgttggtttgtggtacgcctccgaacttccgacggctcagagactaacccacgtcgccccccggggccatggcatcagcgagagggaccccagccgtccctcatatcgtctagcggcgtcgcctaccagaacggggaccacatgcaggtaatcaagcgagacggtcgcgccgaggactatgacggcagaaagatcgtccgggccatgggccgggcgctcgaggaggtcggcgaccccgcgggacaggacgatgcggccctccaggcgctgctggcgcaggtggaggacacccgtcgccaggtcggggcaaccgaggtcgagcagatccaggacctggtggaacgcaccctcatgcaggcgggccactttgacgcggcgaaggcatacatcctgtaccgccaccgtcgcgccgagctgaggtcggcccgccgcgccatctgcaccctcgttaccggggtgtccctgggggagacgcccgcgcccacgttggagagccccctctccgcgggcggggacgttgccaccacgcaggccacgcccctctcgcccgagcgcaccgcggcggcaacggagggcacggaggcagcccgtcggctggacgaggcgcttgcccgcatcacgcgcgacttctcgcaggagacctacccgcttgcctcgctcgcggcaaagttccaggggttcgcgaagccctcgatgccggcggacgagcgggcggacgccctggtgcgtgccgccgtcgagctgaccacgcccgaggcgccggactgggagcgcgtggcgggtcgtctcctctcgctcgtggcggggctgcggctctcgcggcaggagggggaccgtggcatcggcggcttctacgacaagctgcgctacctcacggaccagggcctgtatggtgcctacatcctccagggctacacacggcaggagatagaccaggcggccgagtggatcgacccccgccgggacgacctcctggactatccggggctcgaccttctcctcaagcgctacgtggtgtgcagccacgaccacattccgctggagtccccgcaggagatgttcatgggcatcgcgctgcaccttgccctgagggagaggcgcgagtcgcgcatgggctgggtgcggagcttctatgacatgctcagcaggctcgaggtcaccatggccacccccacgctctccaatgcgcgcaagccgcaccaccagctctccagctgcttcatcgacaccgtgcccgacagcctcgagggcatctaccgcagcgtggacaactttgcgatggtgtccaagtttggcggcggcatgggcatgtacctgggcaaggtccgcgccaagggagggagcatccggggctttgagggggcggcgggcggcgtggtccgctggatccgcgtgataaacgacactgccgtcgccgtggaccagctgggggtccgcgcgggcgcggttgccgtctaccttgacgcctggcaccgcgacctgcccgagtttctgcagctccgcaccaacaacggagacgaccgcatgaaggcgcacgacgtctttcctgcggtgtgctacccggacctcttctggcgcatggccgaggaggaccttgaccagccgtggcacctcatgtgcccgcacgacatccttacggtgaggggctactccctggaggactactttggcgacgagtgggagaggcgctaccgcgagtgcgtcgtcgacccccgcatccccaagcgcaccgtcaccgtaaaggacgtcgtgcgcctggtgctgcgcagcgcggtggagacgggcacgcccttcgccttcatgcgagacaccgtcaaccgcgcaaaccccaacccccacgccggggtgatctactgctccaacctctgcaccgagatcgcccagaacaccagcgaggtcacgagcgtctcgcaggaggtcgtgaccagggacggggacacggtggtggtcaccaccacgaggccgggcgacttcgtggtgtgcaacctcgccagcctctcgctggggcgccttcccgtggaggacgacgcgcgtctcgcccgcaccgtgaggaccgccgtgcgcgcgctggacaacgtgatcgacctcaacttctacgcgctgccctacgccaaggtcaccaaccggcgctaccggtccatcgggctgggcgtctcggggtaccaccacatgctcgccaagcgcggcatccggtgggagggggaggagcatctgcgctttgccgacgacgtgttcgagcgcatcaaccgccacgccatcgaggcgtcgtgcgacctcgcccgcgagcgcggggcatacgagaggttcgagggctcggactggcagacgggcgcctacttcgagaagcgcggctacgtctcgccggagtggagggagctggccggccgcgtggcgagtcagggcatgcgcaacgcgtaccttctcgccatagcacccaccagctcgacctcgatcatcgccggcaccacggcggggcttgacccggtcatgcgcaagttcttcctggaggagaagaagggatccatgctgcccagggtcgcgccggagctctcgcccaagacctggtggtactacaagccggcccacctgatcgaccagacctggagcatgagggccgcgggtgtgcgccagcggcacattgaccaggcgcagtccgtgaacctctacatcaccaacgagtacaccatgcggcaggtgctcaacctctacctcgaggcgtggcgcgacggcgtcaagaccgtctactacgtgcgcagcaagtcgcttgaggtggaggagtgcgagagctgctcgagctagtgccagccgccagccgcggtggcgcaccgcccgccgtgggacaaccgctcgcggtcgtggccgcacggcccgtctcgaccgcctgccaataggagggaagaccatgcaagcacagaccgaggggcgtctctcgcccaaggcgctctttaacccggagggcgagaccgacgtgcgcaagcggcgcctgatcgggggcaacaccaccaacctcaacgacttcaacaacctcaagtacgcctgggtctcggactggtaccgccaggccatgaacaacttctggatcccggaggagatcagcctctcgcaggacgtgaaggactacccgcgcctgctgcccgcggagcgcgccgcctacgacaagatcctctcgttcctggtgttcctggactcgctccagactgcgaacctgcccaacgtgggggagtacatcaccgccaacgaggtcaacctctgcctgcacatccagaccttccaggagtgcgtgcactcgcagagctactcgtacatgctcgacaccatctgcagccccgagcagcgaaacgacatcctgtaccagtggcggaccgacgagcggctgctcgcccgcaacacgttcatcggcaacctctacaacgagttccaggagcgtcgcgacgcccaggcgctcctgcgcgtcatgatggccaacttcatcctggagggggtgtacttctactccggcttcatgttcttctacaacctggcgcgcaacggaaagatgcccggcagcgcgcaggagatccgctacatcaaccgcgacgagaacacgcacctgtggctgttccgcaacatgattttggagctgcagcgcgaggagccccagctgttctcgtcccaggcggtggacgagctgagggagatgctcctggagggggtccggcaggaggtcgcgtggggtcgctacgtcataggggacgacatcccgggactcacgagccagcaggtgagcgactacatccactacctgggaaaccttcgctgggcgtcgctcggctttgggcagctgtacccggaccacgcggaggagccaccagacatggcctgggtggcgcaatacagcgacgccaacatggtgaagaccgacttcttcgaggcgcgctccacggcatacgccaagtcaaccgccctcgtggacgacctgtaggggcatttgcccgtggcgcattgggtcccggggcgacggcgcgcgacgcgcgtgccacgtccctctccccacgaggatttgacacgcccgccggcgatggcaagaatgggcgggaacctcacctgagaggcataccccttcgacgatgggagcagcgatggttgtcaccgatacgctcacgataggatcggccaaggcggagggcctcatggtgccccagcttgcgggcgagggtcacgcgtccctgatcgtgattcgctgcgccaaggggttcctgatgtgcggctacctcagcctggagaaggcggagcagctgggcgacgccgcggtgcgtgtggcgggcggcagctttgaggaggtcctggccaacaaggtcacgggcgtcagccccaaggcggcggagctcggcgtcacgcccgacatgaccggtgcccaggcggccgaggtgctcaaccgctagcgcttgggccggatggttgggcgtcgcatgcccgcggcgcccccctggcccgacttgctgcgccgccgttggcatgaacgtcttgtccgcctggcggggaagtcccggctgggcgcgccggtcgaggtgccgcgggggcgctgacgcgcgagagcttggggcttgtggcggcggaactctgctcgtgctgaggaattgcgacttgtggcaatcccaaggggtcccgaacccgcttggcgctccgagggtgctgagaaaactcgacctgtggcaatcgggacctctcgggggaccccggatcgctgagaaaactcgacctttggcagccgagaggggcccatccattgccaccactcggttttcctcagcggaaacgcccctccgattgccacaactcgctttttctcagcagccgagagagccaatctgacatcagtacggcgaacgggacccttatttcctctcggggtcccgttgttattcgaacttagctcctcataccgtcgtaatgggtccacattcgcaacaccttgactcttccctcgtaatgggctccgtttgaggtgaatggctcttggcagaccagatagacgagcctgtgctggatattgatcctcctggagcaatagccgctgaggtttcccacaagggcctcgtagcgtggcggcttggcaaaggggtccgccctcaatagctcaatcaacgcttttgcctttgtgtcgaggtgagctgctttgagatatttcgcgtcttttcttgcctggcttgagaactcgatataccacattgcctctaccaatcgagttcggattcaggcgcaaattcactatcgggttcggaggcactgctcttgatggattcgaccattccgggaatgctgttcaaatacaaggtctcttcgattgccgcccaatcatcctcgcctataagcacggcgcttcttccattcgagttggtgattgtaatgggggttgattcgtcgttgacccggtcgattgtcctatataggtcgtttctgaatgcggtggcactcatgctggtcatagggggctccaatcctctaaaacgtacgcttttacgtacgtattattcccggtcctgccggtttgtacacaagtagagcctgaaatgtagaggatgccgcccctccgcacctggtgacccgcgtcgcagcgacccgtcaccaggtggtcctgtgctcgtcggtcaccgccagggtcgagcgatcgaccaggtagaaccccacgagctgggtgtcactctccccatggggatagaccttctgcagcaccagctcctcggtcgccgttcccaggctcgcgtagagctcgcccttcgcgtttcgcccaaaggccagggcgtccgtcttggggacgatcccctggtcgtcgaggtagcgggcaatggcgagcatctggttctgcgtgccgagcggatcgtccgaggacgcactcgatgaatctcccatatctcctccggatgctgccgtcccattgtccccgtcgtccgacgaatcgatgggggagggggactcaatgccgtccccgtcggagggatcgccggtcgagagggccgcgtcactctcgtcgccagccgacccagtggccgcggagtcgcccgagcccgaagcccccgtctgccctccccgcgccgtgtcgtatgcttgggccagttcccagggctccatgaggaacgggtcggacgcgcggtagtaggcggttcgggactcgtcggggtcgaagcccgcccagtcgacggccaggtagtcgtaggtccgctggccaagcggccacggagctccgtgagccccggagtccgatcctcccgcgaccgtcccgcccgccagtgcatccggcacgccggtcctcaggacgcgctccgtcccgtcgtagccaaacgccgcggacaggagcgtgccgcatgcagccacaagggcgagcgtcaccacggcgactccgcccaggatggattgcacccgtgtggtcgtcgtggcaaggcggtcccgacgtccccggcgaaacagccagacggcggccatgaccgccaggacaagcgcgaacaccgcggcaagcggcgacgcgaccgtggcgtaggggatgcgcagcgaccagcccgaccccgagttgatccccaggtcgagcccgtagtagaagaggcagtgcgcgagcatcagcgacacggccgccaccaccaggggatgcgcatgccgggagagagaaatgccgtcgactgcggcttgggcctcgtcccgccggccgtcggcggcgcctgggtcgcggggagaggggtctgcctggcccccagcggtgccgccctcgaggcgatcgacccagccctccacgagctgttcgctgggaaatcccctgtcggccgtcgcggcgatgccggagtaccgaacgagccagtcgcgggcggacggcttgtccggacggctcggctcgctcgggacttgctgccggccgtcgtccgacggcgtgggcgtcgcggcgtcgtcgctcgcggaaggctggcgtcggctggcgggcggttgtatggggtccgtaacggcgtcgtcgcgccgcgaggccgacgggattccgtcgcgggcgggggcgtcgtccctctcgcctgcctccgtcgatgcagctgcgagcgcgttgaggaggtagaagagcttgagctgctcgggcgagaggagctgcgtgtccacccgcccgagggcgttgatggcgaggtcgggacgcgagcgcagcacgtcgatgcgggcgatggacagcaatacctgcgacgatgcacgtttgttgcgtttgcccagccagcggtacgcgtacagcgtgtagtcgtgtcgcgcgtcgggcgggagggtgcgcgagcgtcgcccgaaggcgagcagcgtggcctgtcggaggccaagggcgacggcgaccacggcggcgtacgtcccgaagatcgcggcaatcccgatgccctcgatcacccccagcagccagacacaagcgatcgccaccgtggtgacggtgagcatgcgcaacagccagatcgccgcccgcaggcgcctggcgacggagaggcctctccggtcccaggggtagtccggcggtaggggagacgagaggtcgtagatgctcgcccgcgggtccatgcgcgtcctttcggctggcgggaaggttcccctcgattgtattgcggggcttcgggccgtaccttgcccacggggccctggacgcctctcacctggggcgggttgatggttccgtcacctcaacaggcacgctgaacgtgccatcgtgccaggtgcagcggtagacggcgcagtttccgatgaacctggaccagtagctcccgcgcgaggcgggcgtcaggtactcgaggatgcccttcatcaggatcgcgtgcgtggagacgaggacgcaggtacccggggcgagaacgacgtcctccatgaagtcgccggcgcgcgccgccacggctgggagctgctccatcccgtccggcgccgggttgtgcgcgaagtccgagaagaacgtgacgacctccggcgcgggctcccgcaggtccatcccctcgtaggggccgtagtccatctcgaggagacggtcgtccgtctcgaccgggacgcccccgcccgatacgatgcctgcggtctcgaccgcgcggcggagcgggctcgagtagaccctgtcaaacgcgaccgagctccccttaaggagcccgcgaacccgcatggcctgctcgcgcccctgctcgttgagaggcacgtcccttctcccctggagctcgtgcctcctgttggcgtcggtctggccgtgcctgacgatgtagatgtccacgctgcctcctggtgtcaaatctaccattggggagcggctcggcggggtgttcatgggcatcgtggagaaggccaacggctttccaggtggcgagggggcggccgggggatctgtcgcgtcggagatgcggcgcctcacaccagccccagcttgccgatgatctgaatcaggtcgtctatggattccgccctcccatgctcaacccacgtggtgagcacgctcagcgtgaatccggtcctcacggcaataaagtagtcgccatgcgcggggtccacgccagggattgcgccaaagcggtcgcgcagctcaccggcaacccgccgatggctcgcatagacgatgtcatagcgattgattttcacaaggagctcaagaatgtcgccatgctccatccaatacgagaagtaccggcgcagcatcctgcgctcatcccaaaaggcgtctgggcccagcgagcccagcgcctctcgaaagcactcgtcgcagcgccaagccagcaggtctgagaggttgtcgaagctccgatagaacgtggtgcgcgccacgccgctctcatgctggacgtcgctaatcgtcacctggtcaaagggcctgtgtccaaggcaggccatgagaccctcgtacaacgcgtgcgccgagcgaagcgttcgcctgtcgttccgaatgtggtacatgtcatccgcctcgaatccccagcgcagccttgaacgccatatcgctacaacgttccctccgcctgtatcggttctttacgctgcagttgtagcgtatttatcgcaatgctacataccaagtgacgcaggcacaaggagttgcaccacagacgagaaggggcaggcatgtacgcgttgtggctttggttcgtaggctggggatggctctatgccatgattgcaatgagcgcggtactcgtggtccagatggttgtcgccaagcagaagggggagccatggggtgcgctgcgttcgctcggagcgcttgccgtgattgtgttgacgctccatgtgtgggaggagtgggtcatccccggcggcttccactacgtctataacatcggctccgacgcgttgctgcgagaccgctaccccatgagccagctgatcgacatgatcaccaacctcggcggggccgtgctgtggttcgtcctggcggagacggacgggtacggccggaggatgggctttgcggtcatgctgtttagctacttcgagttcgcggtccacaacctgctggcctaccagtcgatgacgatcctctacgacgccggcatctactcaggcttctacgcacccggcctggtaacggcggctgcctgctggctgcccctcggggttgcgcacaccatctggttcgcgcgcgagggcacgcactggaaggacgtggtcggcggcgtggtggtgctggtcgttctcagccaactgctggtgacgctgccagagagcctcctcaagagcgaggagagcccctacgccttcgaaaacgccggctggtatgagcagttcgttgaccccgtgacgcaggaggtatccgcaacggcgaacacgacggcgtaggtgagctaggtggcggggttcctctacgagagcggccccacgggcttcgacctcaagcagcgcggcacttttggccgcgtcagcttcggtcttgtgatgcttcacgtcgagggtgcggtaggcgttgaggcaggcacggctggtggcgcgcaggtatgggtcgtcctcccatgagccgccgaggggcgcctggaggaggaactcgcggatgtccttctcggcgctctcgtccacgcccttccaccctcctgcaagtgaaactgggacggaacccgctggcggctccgcccctgcaaaaagcccgtcggctcttacattggagcatagtgcgcatcccaggatctcaaaaaccaacgggagggataggccgatagaggagtttctctcttttgtacagctatgcctaatatgagaaaataataagcgtgaatgtgaaaaagggggcggcatggtggaactgctggaaatcgcgagagggcacaacggctacgtgaccgccgagcaggcaacggaggcggggataccgcgacgagagctgtccgaggccacggaggcgggcgacctcgtgaggctcgaccgggggctctacgcgctacccgacacgtgggaggacccgctcgtagtcgcgcagcaccgcttcgcgcgcggggtgttctccgacgacacggcgctgtggctctggggcctctccgaccgagcgcccttctcgctcaccatgaccttccccaggggctacaacaagacctcggccaaggcggcgggcatcgcctgccggtcgtgcgccgacgacgtgctggggctgggcctcgcgaccgtgaggaccccctacggaaacgaggtgcgtgcctacgatgccgagcggtcgctctgcgacgtggtgcgcggccagagggtgcccgacgcgcagacggtcgtgccggcgttcaggaagtacgtgcgcggggagggctgcgacccgaccgagctcgtctcctacgcgcgcaggctcggcgtggagggtaaggtccggacctacctggaggtgctgctgtgaggacgaggaacgcgatgcagctgaaggcccgcgtgaacgcgcgggcccgcgaggccggggtgccgccgcaggcgatgatgcagaactacttgctcgagcggttgctggagcgcctgtcgctctcgccgtggcgcgaagaggtcgtggtcaagggcggcctgctcatatcgtcgctcgtgggggtggcgtcgcgcacgacgatggacctggacacgacggtgcggggcttcacgctcacgcacgagagcgccgcgcgggccttccgcgagatatgcgccgccaaggccgacgatgactgggtcttcgaggtcgttcgcaccgaggatattcgggagaccgacgactaccccggcatccgtgttcacctgctggcgagttacccgccgatggcggtgccgctcactgtggacgtgaccaccggcgacaggattaccccgggggccattgcctacgagtggccgctgctgttcgacgaccgcagcgtgagcgtgatggcttaccccctggagaccgtgctcgccgagaagctcgagacggtcgtgtcccgcggcgtgaccaacacgcgcccgcgtgacttctacgacatccacgtgctgtggcggacccggagcgggcggtgcgacctgcccacgctcgcagaggcgctcgacgccacgtgcgagaagcgcggcagcgtggggagggtggcacactgggaggcggtgctcgacgaggtcgccgacgacgccacgatgctctcgctgtgggggaagtacgtccgcaagacgccctacgcaaaggggctgacattgcccgagtgctgcgggacggcgaagggcatcatgcgggaaatcgggagataggggcttatgcgcgagcacgcaacggacgcgggatcgggcaacgggcttccccgtgaaatcatcatccagcggtacttgcccgaggaagctgctgaggcttgtacgcaagagaaagcccttttcgcgcaagagcccgacctccccggtctcgaggacttaaaacagaagctcgaggaaaaggaaggcgagctcaagggacgcatctgctccgacatccacaggctgtcgtctctcgacgcgaatgcgaggctccgatcgtcgagtctggcagtcgacggagtcccaccgcctgcggcaacgtggcaggagaggagcagcaagtgctacccatcaacatattttgtattgcccatatcttctgcaggtagggatggatgttcgagacgaacgtgtcgcccttcttgtatgcggtcccagcgctggcgggagcatcgccatcgtatggctcgatgccgccgcggtggtggcgcgatcgcaaccgcggcgcgattcgtatcaaattcgtaccactcgacccatgcatagcaaagcaggtcagaggcttaagcctctgacctgcgaatttatggtgggcgttagaagatttgaacttcttacctcttccgtgtcagtctttttatgttgccgaacaggaattgttaccgcgacagttacgaactatctacctgcgttttaacgtcatattccgtatatgccgcaaatagcgtagaataacgaagtagatattttgcggcgttattgcggcaagttttgcggcaaggaggaacgatgttctactcgtcagcctacctacgagagcgcaagggcaggggctggattggtgtcctctcctacaaggacgagaacgggaagtggcgcaagaaggagaagtccctcgatgcgaagggcaagcgcgaggcgagcaaggaattagacaaatggcgcgatgacatggaagcggaggccgaaagcgcgagtatcctcgcaccagcggagaccgtaatagactacgtgtcacgctacgtcgataccctagaggcttccggctcaattgagcggtcaaccgtaaccgtctaccacgcaatgctgaagcacattgacggggaactgggttccctgcgcctcgaatcactgggcgctgagagcgcacaggcatgggtcaactccatggtctcgaacggttatgcagcctccaccgttcgcaaggcgttcaacctactcaaagcggccatgaccaacgcggaggacacggggcgcatcgtaaagaaccctctgcgcaccgtgaagctccccaagattcccaagaaggagccgaacgcgctggatgccgcccagagagcgcggctcgtctcgttccttgacattgccgcccaaactccggtcaaccttggggtcaggctcgctctcttcacgggcatgagggagggcgagatttgcggcctccaatggaagaacgttgacctcgaatcaggcgtcccgctgttaaaccagccctgatatgacctcgggcgggtagagggactcgacgtccaccaccggccgcttcccctcccagtagtcccagaaggggtggggctcggcgaagagcgccctcctgcgcaccgagtacctcccattcgctgtctgggcctcgagcatcgcggtcctcgaggcgtccgagcgcctcgcctgctcgagccactcgaaccagcacaggtacatgccaagcctcctggtcgagacgccgttgaacctggcgaggaatgccctcagcctcgagtgcagggcgtttaccatgccgagctcgtcctcggtcgcctcgctcgagttgtatctgttgtgggcgccacgccggccgccctgagtggcgttatgtatggcagagcatgtccgtcgagactcggcgcccgcgaggcgacgcagcgacgccaacacccccccgcgcccggttttcccctcgacgccacgcagcagaagcagtcgccgaggtcgttgagccggtgacacgaccaatcttgagcctcgacagcccgcacgtgcgcgactcgccgccgtgccggtgcggctccctgggcatgagtccgtcggggtggtgccccttgagggactcgtcgatgtagagctcgtccactggatcgacgtccccgccgcccctgaaggccctgacctgcctcgccatcacgtcgcagagcctcgcctatgtaccaggaagtcggcaggctcacggagcaccgcttcgcgcatgccctgagggaggcgccctcgagcgtggcgtcgacgaactcgagccaggcgccgagcggcagctcgagagcgccagcaggcgcccgtcctctcggtgaaggtgcgcccgacccgcgggacccacctctgcgtgccgtcggcgtcgtgcccgcgcctggcgacgcgcgagcagccgcacctcgggcaatccccggctcgccggcggtcctcccgcgacgagcgactccctgatcctctcggcgagctcgcgctgtcctccgcaggcatcgcgagtgcctcctgcagtatgctgttgtccatccgggcctcctgcccctcggtctcttggtcgaaccgaaggttagcggggggcccggacacttatatcaggactggtttaacagcggttcccttgattccgttacgacagacaccagggtattggttaaggtaacgagtaagcccaactgccccaacggcctcaagtccattacctggactgacccccagcaagttctagacgattccacgtccgcgccggtgggagaccctgtcacggtggatgcgaacagtagctgggcacacgactgggataaccttgccaaggacgacggaaacggaaacaagtactactacacggtcaaggagctcggttacaccgtgggtggcacctaccatgacctcgataaggagacggatggcacctacacggtctcctacggcggaaataccggcatccagaccggcaccatcacggtgaccaactccgccaagaagaaccaggggtacgagctgccctcgacgggcgggaccccaagctcgctgcctgccgtcggaggggccatcgcccttggtgcctgcgcacttctcgccgtaaggtggcgtcggcgcaacggctaggcgagagaaccatacggtctgaacagtggcgccccgggacggtgactccgccccggggcgccttgttgtgtgctgacggtcgtgccttgcggcctcggagggggagagggatggtccccgtcgccccgaacctctcccatggcgcgaatcgatcctggtctggcgcgggctgatgttactttgccgcaccgttgcccgtatcctcctgaccctggtggctccgtcgccgtttcctgcggttatgggcgagtgccgaacttgcacacaaatgccgccaacccaagggaatatccagaaagttctgggaagattggaagcagaattccaatgatggggaacgcacatgattgagctcagggacatccgcaagacctacaccaccggcgggaccacgacggttgcgctggacgacgtcaacctccgcttccgcgacagcgagttcgctgcgatcctgggtccctccggctcgggcaagaccacgatgctcaacgttatcggcggcctggaccacgcggactcgggcgacatcgtggtgggcggcgtctcaaccagggactttggccccaaggactgggacacgtaccgcaaccaccgcatcggcttcgtgttccagagttacaacctgatcccgcaccagaccgtcctcaagaacgttgagatggcgctgaccctggcgggcgtgggcaagggagagaggcgccgccgcgccgcgcaggcgctcgagcgcgttggcctgggggagcaggtcaacaagcgacccagccagctttcgggcgggcagatgcagcgcgtggccatcgcccgcgccctggtgaacgacccggacatcgtgctggcggacgagcccacgggcgccctggacaccgtgacgggcgagaacgtgatgcagctgctcaaggaggtctcgcaggaccgcctggtggtcatggtcacccacaaccccgagctcgccgagcgctacgcaacgcgcatcgtgcgcttccgcgacgggcacgtcgagagcgactccaaccccgtcaccgaccaggagctggaggcggaggcccggggcgagggcgacgccatgccagcggagggggccgcgacggtggtggccgcgcccgtctcgcccgaggcctcgccggaggacgtcgcgcccgaccagacggtcgccctccccgcggcggttttggcaggggagagggacggggcccgcggctcgcgtcgtaatcccaaggccggccgggcgtcgatgtcgttcctcaccgcgctgtcgctctcgttcagcaacctcatggccaagcgtggccgcacgttcatgacggcgtttgcgggctccatcggcatcatcggcatcgcggcgatcctcgcgctgtccaacggcgtcaacaactacatcgaggacaccgagcagagcgccctgtcgtcgtacccgctcaccatcaccaagagcagcttcgacttcaccaacctcatgagtgcgatgggcagcatggggatgggcacgtcgtcctcgtccaccacgagcacggcgtcgtcgagcaaggacgggactatcggccagaccaagatcatgtcagacatgttcgccgaggtgaagaacaacgacctgggctcgttcaagtcgtacgtggactcccaccagggcgagttctccccctacgtcaacgccatccagtactcctacggggtgacgccgctggtgtacgagacggacacctcctcgggcgccaagcagctcaacccgtcgaagatggcccagaccctgcagagcggcatcgcgggctctgcgctgaccggcgggagttcgtcgggctcgtcgttcaacgagctggtggggagccaggacctgctggattcgcagatgagcgtggtcgccggccggtggcccaaggcctacgacgaggcggtgctggtcctctccgccgacggcaccatcaccgactacaccctgtacagcctgggcttctacaacatcgacgacatgaacaagatcaccgaggacgccctcaagggcaacaaggtcacggtgccccaggtcgactccaagttcacgatccaggacgcgctgggcatgaccttcaaggtggtccccgcctcggcgacgtaccaaaagaacgccgagaccggcggctggaccgacatgtcgtcggacgacgcgttcatgcgctccgccgtggagaagggcctcacgctcaaggtcgtcggcgtcgtgaagcccaaggacggcgagtcaacctcgctgatgcaggagggcgtagcctataccagcgacctcaccagctggctcatgcggcaggcggccgactcgcagatcgtgcaggagcagaaggcgaaccccgacgtggacgtgttcacgggcaagacattcgaggagctgcaggacagccagggcgagcagctggacatgagcaagctgttcaccgtggacgaggacgcgctcaagaaggccttctcgtttgacacctcggcgctggaggggtccaacatggggagcctggacctgtcgggcgtgagcctggacgcctcgggctttgacgccagcggcatgcagcttgacacctcgcagctccagagcgtcttcagcaccgagaccatggccaagatcatgagcggggcgcccaagttcagcctggaggactccggtctcgccgacgcaatcaccggcatcacggacgagcagcgccaggacatcctggatgcgtccgagaggctggggtcgagcttctccgcctggctcatcgccaacccggacgaagtccagaagatgatgggcgagaaccccgactaccagggggtgctcaacgactaccttgccacggacgaggggaaggcggtcacggacgacctgcggcagaagctgggcggcacggtggacgacgtggtgaaccaggccatgtccaagtacctcaccgagcagtttgccccgtacttctcccagcagatgcaggcgctcatgacgcaggcggcgcaggtgatggcaacgcagcttgcccagcagatgcagacgcaggtctcggccatgacctccaagctggggacgcagctctccgccgcgatctcgggccagctgcagagccagatggcgcagctgcagagctcgctccagaacgggttcaaggtcgacaccaccgcgtttgccaacgccattcacgtgaacatgacgcagcaggacctggcgtcgcttctcaacaactacatgaacgcccaggacctgagctacgactccaacatgcagacgctgggctacgccgaggaggggcagcccgactccatccagatctatcccaaggacttcgatgccaagcagaaggtgctcgacgccatcgacgcatacaactccaagatggagaaggacgggaagagcgacgcgaccattcagtactccgacatcgccgggacgctcatgacctcgatctcgaacatcgccaacatgatctcgaccgtgctgatcgcctttgtctcgatttcactggtcgtgagctcgatcatgatcgggatcatcacgtacatctcggtgctcgagcgcaagaaggagattggcatcctgcgtgccatgggcgcctcgcggctcaacgtggcgagtatcttcaatgcggagacgatcatcgaggggctgctgtccggcgtgttcgccatcgctgtggtgtacgtggtcgagggaccggtcaactcgtgggtgtattcgtggcagggcgttcccaacgtgatgtcgctgccggtcacatccgcgctgatactcatcggcatcagcgtggggctgacgttcatcgccggcatcatccccgcgctgtctgcctcgcgacgcgacccggtggaggccctccgaagcgagtagggccaaggcgtcgcctgaggttttcgagttgggtctggagcccccttccgcgcgtgcgggagggggctccaaaacgagaatgtggtataaaagaaatatatctgggctggccgaaaggccctggtccacccaagggcggggactttttccaatgtcattaacttaagcggatgacatattcgccggcatcgcttagaagaacggccgtcgttccgtagtgggacggcggtcgtccccttttccacactcaccccgttttatgtggcaaaacgctgggaacagtcttcaggctgtgctagaatgtagtgggacgatatatatgataagagcttgtaaaagcatctatttgtagttggaaggcatcttgtttctgaaggtgcagcgaaagaagggcgcggggggcggggagctcctgtacgcctcggtcgtcgagaacaagcgcgaaggcggcaaggtcgtgcagcgcacggtgaccaacatcgggcgcgtgagcgaggagcaggtgccctacctcagggccgcttggtccaagaggaaaccgaggctcgtctgggacgactgacggcgggggtgccaccatgggtgcgtcggagagaatcggccgcgacctcgagctcgtgcgcagcagggagttcaccgatgcctgcaggcgcgcgcccaccgacttcaccaggcgccgcaagatgccctgcgacgtgctcgtcgagagcatgctgtgccgcaaggggcgctcgctcaagatcgagctcagggagttcgaaagggaccgcatgacggacactgcgataagcgccccgggctacctcaggcagcgcgagaagctgaaccccgaggcgatggcgcggctgatgcgccaccacgccgcgcaggtctgctcggacggagacgcgccccgctggcacggcatgcacgtgctggccatcgacggatccacctgcaacgtgcccaccaacgcggccacgaccgccgcctatggggggtcgtcggccaggcacgggaaggtgcaggcgttcctggggcttagcgccgtgttcgacgtgctcgcccggcagatggtggggctcgaggtgacctccgggggcttcgacgagcgctccttcgtgcccgcgcacgtcaggagcgcccgcgaggcgctcggcgacgagccgttcgtcctcgtgatggaccgcggctacccctccttccccctcctggcatggcttaccgacaatggcgtgccctacctgatgcgcgcgcagtccgtgttcatgaacgccgagttcagggacgccggggcggcaggtggggacacgacctgcgagttcgacttcgcctaccagcgcattgcgagcatcaggaaaagggaccccgaggagttcgaggcgctccttgcgcatggccccatcgaggtcagatgcgtgctcgccgacatcgggggcggggctcccgagaagctcgtcaccaacctgccgccagagcggttcgcgccaaacgacctcaaggagctctaccacctgcgctggggtgtggagacgtgctttcagatgctgaaggaccgtctgcagatggagaacatgacgggaacgaagcccatcctcatcgagcaggacatatacgcctcggcatatcttctcaacgtcgccttcgacatcgccaacgaggccgacgcgaaggccaggacggccgagacgcggcggcgctacaggcacgagatgaccgtgaacagaagcttcgccttgggcgtggtgaaaggcgagctgctgcagatgatcatggcagacgactccgagcgcgacgcgatcatggcccggatcgtcgaggagctgagctcgtgcctcgtgccggtgcgaaaagaccgcagctacccgcgtgatgggataggcagcaactacgccaaccgctacagcaacacgcacaagcgcgtcttctaggccccgataaagagtgacttcccgacagatgcctcggagccgcagatgctcggggcggcgctcggcaatgccgaaacccgcaggctgcgattagaaaaggacccggaagtctcgttccgggccctcctaagcgatgccggcgaatatgtcatccgcttaagttaatgacattgggactttttccccgccgtttttatctaaggaggaaacccggggttgtccgagctttccattttcatcgatgagtctggcgacttcggcccctttgaacctcattctccctattacatactctcgcttgtatttcacaatcaggactttcccattgacgagcaggtgaaagcacttcgcaggcacatcgttgacgcgggcttccctgaacaccacaacgtgcacacagcaccgttgattcggcgcgaacgcgactatgcatctctcgatatcaatgcaaggcgcagactcttccatgccctgtttagctttatgcgtcagtgtgaaatagcctacgagtcattcctattccggaaggtagagtttggctcccatgacaagatggtgtcacgaatgtcgcgggatttgggcctctttgtgcgtgataacctcgccttctttcagtcgttcgaaaatgtcattgtctactatgacaatggccagaaggagattacgaacatcataaacacggtgttcaacgtatttcttgatgctgaattgtgcaaggtgagccctagtgactatagcttgtttcaggctgcggacatggtatgtacgttgcgcatgctctccgagaagttgaacgcttccggtattgggatgagtaagtccgagcttgagttctttcggaatgaacgcaacctcaagaagaactaccttaagcccatgcgtcgcaaacaggtcgagggttggttgaaatagctccttcagtcccttgagatggctcgttctgtcgttggagggttgaaagcagagtattctcaatctgcggacggaagattcgtttttgccgtggatgagaacagtgcgatagccaagagatgaacgtgggtttcgaattgatctactcactggctttttgagtctgcgtatcccgtacaacgtaagggggatgcacagttgggggctggagcatctcccgggggagtgcgggctcatcggctgggaggaatgttcgacggaaggtccccggtggctgcaactgtccccgcgtgtgtacttgcgcgagcgagttaccattatagttggaagaattatgtcttgccacttgggagacgcgaccggcggcaccatcgggggtcctgggaaggtgctcacgcggggagtttgctgccagcaaccgtctccccttctgccattggcagatccggcccgatatgagcactcacaaagggagtttgccgtcatggttgcaaggctgatgagaggcaagctggggaaacgctctctgtcggaaccttcgtggcagatccggcccgatatgagcactcaccttgggagtttgctgccaagtgggcctccttccgggtcccgatggcaactgcttcccgatatgagcactcatagcgggagcttgctgccatgatttcctttctgatgggaaaccaactggggaaatgccctgccgatggctgtcgtggtagttagggccacgcgaaagtgctcacattggaaatttgctgacaatagggctccccgccatggtgacaccgcacttctaaggggtacggcgaacccaagacgaacccttcctcccgtgggggctgcccctgcgcaaacgtacctaccggcgggcccgccccttctccttctcaggcctcgacatcctggcggttgtggggagtatgggcttcccgctcttccccccgttcgggggtgagcccttgaccagcacgacgaacttgctgcagggaggggagacgaccacgctccttccttgacgttgagggcctgccggttacggtgaggcccggcccatccgtcttccccgcaagagagagggacggcccgcgcgagcaatcgcgcgagccgtcccgggccggggcaacgtggcccgcgatgccgacgggagcggcgccgatcgagctgccacgcccttcttccctaactcctacttcgaggcagacgtgacgctgacctcgtagccgtccaggccggctccctgcagcacggcctcgacctgcgccttcacaagctcctgggcgtgggagtcggccttgtcgatcagcccgccgtccacggctgcctgcgactccttcttctcctcgctggagaggaaggtcgtgacgtcgtccacggtgatctggttgatggggttgaacgactggtcgtacgtctgaacgctcgacgggtcgatgctgcaggcgaggacctgggccttgggcagcgtgacgctgaccttcttggcggagtcgtccaccgtcaccgtcgcctgcgagatgtccttgatccccgccttggccgtgccctcgtacgtgaccaggaacgagctccccgtgaacgggatgctcaggcccagcaccgtgaggtcgtccttgctgtacttgcccacgttggcaaagttgtactcctcggtcgccagctccgcgacgtcggagaacgagttcttgatcgtggtcgagtccacgtggctctggccgcctgacacgagcccgccgttctgggcggcgaggaccaccacgactgccacgaccgccccgaccacgaacgccagcagcgtctggcgcagccgggggtggttgcccagccggtgccatcgcctggagtgcctggggccgccgggctccccgccgggggcggtgccgttggcttcggtcgtggtgttggcgggacggtcctctcccgtgcgcttgttgtccaaggtgctcatgcgtgctcctccctgtggcctagtgggtggcgccttgtggctactgtgcccctttgggggcggaaagctgcgcgagaagtcgcgtcgcgcgcaaagctgcgtgcgaagtgatgatgccccgtggaggccgcccgcacaccccgtggtcgcgcgtcagcccttcttcatatggctgaagccccgggggagagaaccgccccgaccccggcagccgccgcccccggtggcatcgcgtgccgcccgcgtggcggcgtttctctcccgcccatccccgtgtcccaacgccagatcaccgtgcgcgttatataaactgccgtgtgtagaaaaggacttgacacatattgagttcatactacgcacaggtagccaacgggcttaccaccgactcccctcctcgagaaaggctccagcgtgttcaaacccatcatggccgagttccttagcaccgccctcatgatcgtctttggcgtgggcgtccactgcgacacggtcctcaacgggaccaagtaccacggctccggccacctgtttgccatcaccacctgggcctttggcatctcggtgtgcctgttcatctttggcggcggcgtctgcatgaacccggcgatggcgctggcgcagtgcatgcttgggctggtgccgtggagcatgttcgtgccctacaccatcgccgagatgctcggtggccttgcgggtgccgtggtggcgtggctcatctacgcggatgccttcgaggtgtcggctggcaaggtcgacggcgtcgcggttcgcaacatcttcagcaccaaccccctgatcaacgacctgccgcgcagcttcttcatcgaggccatcgacaccttcgtgtttgtctcgggcatcctctcgatcgcccactttggcggcgacaacctgcttctggtcgcggtgtgcgtgggcctgcttgtgtgggccgtgggcatgggcatgggcggcatgaccggctttgccatgaaccaggcgcgcgacctggggccccgcatggcctaccagctccttcccatcaaggggaaggtggacaacaactggcgctacgggcttctcgtccccggcatcgccccgtttgtgggggccgcctgcgccgcgttctttgtgcacgggttcctgggtatcttctagggagaggggcgaggtcgcaaggctgtccgcatcatccggcgggggcgtccatcgggcgtccccgcctttttgcgggctgcgggcccgtccctgcatgtgaaattgaactcggcttcgcgcgaaaccccacgtcgggccgcatatgcaatattcttgaggggcaacctgtgaagggacggatatgtcacgaaagctgaacgcgcaggagcgcgcggacatcgaggcgatacgcgacgccctgtgcaaggccatgtcgcccgcgcagcgcagcctggcgtcgggaatcgcgagcgggctcgtccgctcgcgcggcaagcgggtcaccgagaaggacctggaccgcatcttgggcaagtacgaggactccgaggccgggaagggcctccgcgacctggtgaaggccgaggtccttggcccggcggaggacggaggcggctttgagctcgccgtccacggcgtggtcgaggaggacgaggcggacgcgcaggcgtcggacgacgccgaggcacaggcgcaggcggtcgacgcgggggaggggcccgaggacggcgaccccgagtccgtctcgccggcagaggcggcggacgtcgcggcggccgatggcgtgcccgacgcggcgggcgccgcggacggggacggtgacggccaggcggaggcgccgcagcccgaggcggcggggccctctccctcaagcgatgctccgtcgccagaccagggcgagacgaacgacgcgccgtcgcaggacgccccctccgccggcgaccaggcagccacgaaggccgacgcgggccccgcgcaggacggcgcgaagcccgcgcgcgaaggcggcaggcactcgcgccgctcgccccgacgccttcgcaagcgtggccgagacgaggactccggccagggcaaacccgccgggacgggctctgggcccaacgcggagcggagcctctcccacgttccctacgtccgtcgtggcggcgaggcggacgtcgaggcccgcgagaagatcctgcagcttgaccagcgcttctggctcaacggctggctcctctcgcacccctccgcctacaccatgtacgagcccgagctcaaggccatcaacgaggcgctgagcgacggtatgctccccggtgacatcacgcgccgccagcttgcctaccagatgggtggcgacgagaagttctttgagtacggctcggacggcttcaagctgctccgtgccatgggcgtggaggacatcgtgcgccaccgccccatgcccaaggcggacctgatcttccacgcgccgcgccgccgcaagcacatgcgcgtgctggtcaccgagaacctggacccctggctcgacgtccacgacctgatgtacgaggacggtcgcacgaccgtgctgggcgagcgcatccacgccgtggtcctgggcggaggtacgcccgtgctggagcgcaaccggctcgcgctgctgctcgacagcctgggcgccgactcggtggaggtcctgtactggggcgacatcgaccgcgcgggactcgagatcatggacaagctccgtgccgtgctgggcgagaggtaccccttcgcgtcgtttgtgcccgcctaccggctgatggtgcagcgtgcgatggagcgctaccccaacccggaggacaacgaggcaaccggccaggtcaatatagaggtgggcgacatgtcgctcctcctcgcgggcatgtccgaggaggaggcggcgtacgccacggcggtcatcgagggctgccgtctgattccgcaggagatcctcacgcgtcgcgacctgtagggacgccgcggcggggtcgtcgggcggtacctgctgaggaattgcgagtaatggcaatctccgggggagacggagccccacgtgaggggcacctgctgagaaaactcgagttgtggcaatggagggacgctgaaggaggcgcctttgccgccgatgcgccgatttcagcgctgccagaggctttcaaattgccacaactcgagattcttcagcaccctcagccgctatcgcccctcggggtcccttccgattgccacaactcgagttttctcagcaccctcgcgtgcaatcgcccgctcgggctgccacgggctctcttttcgcagcgggctgtcgcatctgcggggtagccgccccagctcaggcggcagtgcccaaccgtaggtcgcagccgctagcgggcccggtagtccagcacgcccgcgacggcgatgccgaccacgattgcgaccgaggtgggcaggttgttgcccgggaacatgaacgacaggatcagcgcgataccggcggcaaggcagatgatgccaccggggagcgcatgcctgcggtcggccgcccccagggcaccctcgcgcttgcggccgaacggctgccggcgcgtcacgatcatgaacacgccgatggccaccaggaccgcggccagcacgacgctcaagaacttggaatccagcatgggacatctctcccttacaagacgatgaaggcgggcgcacggtcgattatgacccatgcgcccgcccttggctcaggggagtccgagcctgtcgccaaagcgggggagaggagccccggccacgcgcccgcatcccctcccgccggcgcccgacgcctcccgcccgacggctagcccagctgctccagcagctgtctcatctcggcctgcacgctgtgctcggcgttggtgccaatgaccttgtccgccacctgcctgatggcgtagcggccgttgcccatggcccgcgagtggcccaccatgcgcaggatctcgtagtcgttcatcgcgtcgccaaatgccatgacctcgctcggctcgatgccgtgcgcgagcatcacctggtgcagccccgtcgccttcgaaacgccgcgcggaatcacgtcgatccagcgcttgcccgacggcgcaaaggtgaacgccgagcccatctcgcgctgcagggcgtaggccatgtccatcaccacgtcgtcgcggtcgcagtagatcgacgccttgatcacgctgacctccggtcctggcacgtagctcgcgcgctcggcgttggggaggtccttgtccagctcccgctcgtagctggccatctcgtccagcaggtagctcacgcgcttgtcgaacacggccaggtgcaggcagtcgaacatccccacggagcgctgcagctgtcgcagcgccgcggtggagtagacctcgcggtcgaccatccggccgtccacatacacctgggtcccgttggaggccacgaagtccatctggtccctcacgggcgcaaagaactcgcacagcgtgtcgtagcgtcgcccggagcttgcgcagaagtggactccgtggcgtcccagcgccctgatgaggtcgtacgtctcgggcgggaccctggagtcctggtccaacagggtcccatccatgtccgatgcaacgagcttgatcatgctacctccggtttcctgggcgagacgagcctcacccatcgtcgtacccccccgtcatgcccgcgtaagttccgcgcaatgcctgggcgcgtctcgcctgccatggctggatgcatcgcgctgaaagggcgcgaacttgtcccgtcgcgcctggctgaacgcatcgcgctggttgggtccgagcgcgccacgcccggcgtcgcacgcgtggacgacccccctcccacaagtgttcccgccttgtgggagggggtcgcgtgggattcgggtctttttcagcaagggccgctccccgaacgtgcgatgggggtagactcaggaggtaatgatactaatttgataggagataagcatgtcgccagtcaccaccatcctcgcagccctcgttgcggccgagttcctcttcatcatgtacctcgagacgttcgccaccacctccgaccgcaccgccaaggtgttcgggatggggaccgacgagctcgcgcgccccagcgtcaacaccctgttcaagaaccagggggtctacaacgggctgctcgccgtgctgattctggtcgccgccctcgcctttgcgagcaaggccgccgtcatcgcgctcatgctgtacatcgtcgccgttgcggcgtacggctccgtcaccagcaaccccaagatcatcctcatgcagggagggctcgccatcctctgcctcatcagctgcctgctgtagggcaggtctccttcgggggattggtgcggaccggcacacgaccctcgaccctgctgtagggcaggtctccttcgggggtcggatgcggattggcacgcgactctcggcggagcccctcttcgaacgagtctaagcgggggagaagggccagtcgacgcacccgaaaccccatccgccggccccgcgggtgccgtcctccgctccggccaatctgctccacaatctcccgggggcgtggggaatcacgtcctccgggccgctcgaaagagctcatagatggggtggacatggcggtgtctcgattgtgggccggtccttcccgtctggcttccgtttgtcgtcccccttggcagcggaagccccgcgtgagcacctttccggaacggctgccggcggagtcccacgaccccgtggcgtttgcccaggtaaagggctcgtagacaaaaggacggccctgcccctggcggcaaactccccgtgtgagcgctcctcgcgagcgacttcctggcaaggtccctcgccgggaccgcgcgaaggtgcttgcccgagcgatctgccgtcagccgtccgccccctccctccaatggcagccgcttcccgatgtgagcactcacttcgggagttccctgccatggttgcaaagcctatgagaagccaactgggggaatgcaatctgccaggtcatccgtgtcggcgggagccagatgtgggtacacacatcaggagcctgctgccagttggcccctctttctgggccccgatggcagccgcttcccgatgtgagcactcacttcgggagtttgccgtcacggtttcctttctgatgaggaaccaactggggagaaacgccgtcggcgcgctaccgaggcagtcgaggaaacgcgaaagtgcacacatcgggagtctgctaccagcgggtattccccggggaggtgcccgatccgccgcggtggcacttctcgcggaggaaggccttgagcatgggggcacggtggcctgccgaacgtggaggggccggcttgcccggaaggcggtcgcccaccccattcttagtcgatggattccccgtcgtggtcgtcgtggctcggggcaaaggcgcccggatgtcggaaaacccgttccacgtgtacacacgggacgggttttccgacggggaaggtaagcccgaccgtcgagagacaggtccggtgacagaaagaccgccccgtgtgtacacgcggggcgaggttctaggcagggaggaccctcgctgccccacggctgtcagaaagtgcgtcccgcgtgtacacacggggcacgatttccgacggggaagcgccttctgcccgccgggagatggggcccatgccagaaagtgcgccccgcgtgtacacacgggatggactttctgacggtgggtcctcccggggagccaccggcgggacgggtccctccttacgagggacctgacctgcgaggacgcgcttgcagggccggacgagagccgatcccccttcgtgaatggcgtggcttcgggtctgaaggaggctggacgccactgagccgaacatgtgcgggagagcttcgaggcgggacgggaaccggtccgccccttcttagacttgagcccgtctcgcgtgcgtggacctcaggaccttacgacccattccattcgagccacgtgactcgcgatgccggcgggaggggtttgggccgcgtccctgcgcttctctccccctgcacaagagacgggcgccccctcccgaagctcgggtctgggggacgcccgcaagtcgcctcgattgcgctcctggctacgcgatgaactccaggaaggcgtcggcctgtgccgccagcgtcgcctcgtcctcgggggagagggtcagcttgccggacatccaggactcgccggacagggcgatgccggtctcgtgctcgcgaagggtcttggctcccacgaactcgagcaggttgtccagggcctcgcgcatctcggccgtggcggtgcgcccacccgcgccggagaccgtggtcttgaccccgccgatcgccgcggagtcgcgacccttgccgggcagcgggcggctcagccagtcgaccaggttcttgacgtggccggggaacgacgcgttgtactgcgggctcacaaaccacacgccgtcggcgtcgcgcacggcctggcgcacctgggctacggcctcgagctcggggtcctccaggtcctggttcatcagcggaagctgcgagtagtcaaggtagctcacgttggcgcgtcccttgagcagctcctcgaccctcttggccagctgcaggttgaacccgtccctgcggagggtccccaccacgatgagcacgttcttctctgccatgatcgatcctttccctttgtcctgcgaatccgtcaacctcccgcgccgacgccgcgggctcgccaccactgcgcggggccctcaggcccctgcctgggtcctacccagcaagcccgaaggcgtagctggtcatcgagattgcccccaggttcctcacgtcgttgaagacctcgggggcctcgccctcggacgcgcccagcacggtcaggagcggcaggtagtgctccggcgtgggcacggcatagccagaggaggggagcgcctggtagtccaccgccgcctggtcgtcgcgcgcctcgaccgccttgcgcacggcctggtcaaaggccacgttctgcggcgtgccgtcggggttgtcccactccacctcgcggaggttgtggaccacgttgccgcttcccagaaccacgaagccctcgctgcggagaggggcgagcctcctgcccaggtcgtaggcgtactgggcgtcgcgcaggccgttcacggagagctccaccacgggcacgtccgccttggggagcatgtggtgcagcggtgtccagacgccgtggtcgatgccccaggtgtcgtccacctggacgtcgttgccaagcagctcccgcacgcgtgcagtcagctgcgcgttgccctcggggcggtagcggatcgcgtacagctcctcgggaaacccgtacatgtcgttgacctggcgcgggtgcgggtcgctctgcaccagcgtcccgcgcgtgtaccagtgggccgagacggccaggatcgccctgggcgccatggccctcacgcgggcaccgaccctcccgagcgcgtgcgccacgtcgtcgtcccgcagggccatcatcgggtcgccgtgtcccacgaacagcgcgggctgcctcttgtctgccatctcaaacccctaagtctctggatactagtaggtagtgactttgtactggcgcaagcataactgctacacttgcgatagcaaataacgttttttctcactactaggtatcttctggcataccaagggggagggcagatggacaggggacaggacggctttggcaactgcccgttcgtgacggcacagaggctcctgcagggcaagtgggccatcctcgtgatgcaccacctgagtgggggcaccctgagatttggcgagctccagaggctcatgcccaacctcacgcactccacgctgtcgtcgcagctcaaggcgctcgaggcggaggggctcgtcaaacgcgaggtgtttcccgaggtcccgccgcgcgtggagtactcgctcaccgcgatcggccgcgactttgggcccgtgctcgacagcatccagacgtggggcgagcagtacatcgactacctcagggagagggagggccggggcgagtaggccggcagccccggcggggtgagggcggggcgcacgatcccgcatccctctcgccaggcgagacgcctgcggctgcgtggtccgagcctttcgcgttgggtgaggggctgcgacctctcgcgtctcccgtgccaggcgagacgggcgtggcagcacatcccacctcgctgccaaggcgacaggttggaatccgggtgtcgcgtatctctcgcacgtgcttgcatacccatatgagcgggtaccatagtggttgcagtcgccccacggaggggcggcaggggcagccatggcccaggcagacgccacgaccaggaggaggtgccatccatggacggcgatagttcgcatcgaacagccacaacgtactcacttgggatggcggccgccggtcggggtggcggctgccgccggtagtcgcacccagcgtccgccggtccccgcgcgtgccagatgcccatgcgggcggccgcgtgcaaagccccgtgcaggggaggtgtcgccatgacgctgcacaccaagaagaccgcaaccgacaagagggcgcaggagcgcagggagttccagctcgactggctgcgcaggatttcggccctcgacgtggaccacgccctcgccgagctcaactcgcaaaggagggggctctcgcaggcccagattgagctcgcccgcgcctcgtacggggccaatgaggtctcgcacggccacagggactccgccccggtccgcttcctcaaggcgttcctcgacccgttcacgggcatcctcgcgctccttgcgctggtctcgctgctcaccgacgtgatattctccgcgccgggggaccgcaacccgtccacggtcatcatcatcgtcgcgatgatcctgctctcggcgacgcttcgctttgtgcaggagggcaggagcggcgatgcggccgaggccctggccaagaccatccagaccacctgctgcgtggagcgcgcggacggcggtcgcagggaggtcccactggcagacgtggtggtgggcgacatcgtgcacctctccgcgggcgacatcgtcccggcggacgcgcgcgtgatatccgcccgcgacctcttcctgggcatgtcctcgctcacaggcgagagcattcccgtggagaggaccgcggcggcctgcccccaggcggcatccgacgggagcacggcggccacggacctctccaacatcgtgttcatgggttcgaccgtggtatcgggcagcggcgtcgccgtggtgtgcgccgtgggcgccaacacgatgtttggcaacatggcctccagcctgggggtcaagcgcggcaagaccgcctacgacgagggcatcgcctcggtcagcaggctgctcctgcggctcatggtcatcatggcgccgctggtgttcgtgatcaacggcatcaccaagggagactggctgtccgcgctgctgttcgccctctcggtggccgtggggctgacgcccgagatgctgcccatgatcgtcacgacctgcctggcaaagggggccgtggacctctcgcatgaccgcgtgatcgtgaagcacctggactccatccagaacctgggtgccatggacgtgctgtgcaccgacaagaccggcacgctcaccgaggaccgcgtggtcctggagcgccacctcaacgtgatgggggagcaggacggccgcgtgctgcgctacgccttcctcaacagcttctacgagacgggcatgcgcaacctcatcgactccgccatcatccggcgcgcgaccgaggaggggcgtgcgggtacgcccgggctggacgtggacgcactcaccagcgagtggcacctgctggacgaggtccccttcgactttgagcgccgccgcgtcagcgtggtggtgggcgactcccacggcaacacgcgcatgatcaccaagggcgcgatcgaggaggtgctgcaggtctgcagcgacgttgagtttgacggcgaggtcgtggagctcaccgacgacatgcagcgcatcgtcctgcagaaggcctacgacctggcggacaagggcatgcgcgtgctgggcgtggcgcgcaaggccgacccgtcgggcgtcggggtcctctcgggcagtgacgagcgggggatgacgctgattgggtacctggcattcctcgacccgcccaagcggagcgcggccgatgccgtggcggcgctgacccagcacggggtcaccaccaaggtcctcacgggggactccatgagggtcgcggcgaacgtgtgccgcaccatcgggctcgacgtgagggggaccctggacggcgctcagatcgctgcgatgagcgacgaggagctggaggcgcgcgttgaggacgtgacggtgttcgccaagctctcgcccgaccagaaggtccgcgtggtcagggccctgcgcgcccgcggccacgtggtcggcttcatgggcgacggcgtcaacgacgcggccgccatgggtgccagcgactgcggcgtttcggtcgactccggggccgacgttgccaaggaggcggcggacatcatcctcctggagaaggacctgggcgtgctggagcgcggcatcgtcgaggggcgccgcacctacttcaacatgaacaagtacgtgaagatgaccgccagctccaactttggcaacatcttctcggtgctggtcgccagcgtgttcctgcccttcctgcccatgactgccgtgcagctgctcctgctcaacttcatctacgactgcgcctgcacggccatcccctgggacagggtcgacgactccgagctcatgcacccgcgcgcctggcagcccggctccatcgcgagcttcatgcggtggatcgggccaaccagctcggtgtttgacattctcacctacgcgctgctgttctttgtggtgtgcccggcggtcgcgggcggaacttgggcgcaggtcgcgggcaacccggctgcctccgccctgtttgcggggaccttccaggcctgctggtttgccgagtccatgtgcacgcaggtgctcttcgtgcacctggtccgcacggagcgcatcccgttcttccagagcatggccgactggcgcgtgctgctgctcgacgccgtcgccatcgccctggcactggccattcccttcaccggggtggggaccgcactgggcatggcggcgatccccgcggcgttccttggcatgctgccgctcatcgtgctgggctacgtcgccctggtcatggtggtgagggcgctctacgtgcaccgcttcggtcacctgttgtaggggatgggggcagggggtggacaccgtccccgcgcttcggtggggtggtcgcggcccccgccccagtggcatccgcggcacgccgcccgcatgccccgagcggtatgctgtggcgcaacggaacgtgagccgggcccctcgggggctcagttgggaggacacatggagaaggactacctcgacctcgcccgcaggcgcttctcggtgaggaggttcgatcagcgccccgtggaggacgagaagctggacaaggtcctggaggccgcgcgcatcgcgccctccgcgtgcaactttcagccggtcgtggtctacgtggtgaagtcgccggagtctctcgcccgcctgcgccaggccacccgcatggcctttgacgcgcccgtggtgcttgccgtgtgctgcgacctctcgcgcgtgtaccacaacaggcacgagaccctgtacgaggactacaccacgcgggagatggacgcctccatcgcctgcgaccagatgatgatggaggccaccgacctggggctggggaccctgtgggcacgcggctacgacacacgtgcggtcgccgaggccctggggaccccggacggtgtcgtgccggtgtgcctgctcgacctggggtaccccgccgagggcgtcgagcccagccaccatcacggcgaccggaggcccctggaccagatggtcgtgcggatctagcgagaggcccgctcctctcacccatgcaaggcgaaagcgggggaggcccccagcgggacctcccccgagtcgtttccactggcagtgcgggagccgcgttcgtctcccccgcctgcgctaggccaggagctcctttgccagggcgtcgagctgaccacgcgagtcgtcgtttagcgcgcccttgagggtcacgacgttgcgggcgaacctgatgctgggcagcccctccagcgcctcgcgcatctgcttggcggccacgggcatccagctgccgttctcgaccatgcccacggtgcggttttggtagttgtgctccacgaggtcggtcacgaacgtgtgcatgaaggggaagtagctgttggcgtaggtggtggtggccaggaccaggcggtcgtagcggaacgcgctcgccagcgcctgggccatgtcgtcgcgcgccaggtcataggcggcaaccgtggcgccgcccttgcggagcttctcctcaagctcgcgcacggcctccttggtgtggccgtacaccgaggtgtagaccagcgtcacgccgctctcctcggggcggtagctcgaccaggtgtcgtacaggcgcaggtagcgcgagaggtcgcccgtgagcacggggccgtgcagcgggcagatggccttgacgtagcagcccgcgaccttgctcagcgccatctggacgttcttgccaaacttgcccacgatgccaaagtagtagctccgggcgttggtgacccagtcgtcctcaacgtcgagcgcgccaaacttgccaaaggcgtccgccgagaacagcaccttgtccgtctcgtcgtagctgaacatgacctcgggccagtgcacctgcggggcggcgacaaagctcagggtgtgcctccccagcttgagggtgctgccctgcttcacgatcacgccgcggtcgctgtagtccacgccaaagtaggcctgcatcatcttgaacgactgggcggacgagacgacctgggcctcggggtagcgatccatgaacgccgcgatgttggcggagtggtcgggctccatgtggtggaccaccaggtagtcgggcttcctgtcgcccagcacctggtccaggttggcaaaccactcgtcgcggaaggcggcgtccacgctgtccatgaccgcgaccttctggtccaggatcacgtaggagttgtaggacatgccgatctcgcgcacgtcgtactggccctcgaacaggtcgatcctgtggtcgttcacgcccacgaaggcgatatcgtcagagaccttcacagcttcctcctttgggaaggggagagactccttctcacccgctcacactagtccacgcgattctaccgcgacggggcatgcggggtcttgggcgtgattaaggcttgggtcgcggcccggggcgtgccaggcaatggcgtggccgcgcatttgcgtggggcaggcggcgtccgacaacggcacctgctgaggaaatgcgagtagtggcaatctgcggaggggaccccagacgatttcgctgaggaatcgcgagtgttggcagaaaacgggcgtccacgggtgccaatgctcagctttccccagcggcgaggcttccctaattgccaatactcgacattcctcagcagccatgtgccaacgcgctcggcgggcgccgccagcggtgggctgaaggccatcggatgtcaaagaggaagggaagcgcacccagcttacgggagggcctcccgtggacgtggagcgaatttcccttgaacgtaatttgacgcctgcggacagcatcggagttcaaaccatggcatgtagcgcccgatgtgagtgccttcgtcgcgagtcccctgtgtccctggccggttgatttcagcgtaaccgcaggtaataagaccagccatgattccaggtataaatcactggcagccgaagcctgatgtgagcactcacgtcaggctcccgtcgccatctggcttcgacttccaacccaattggcaagaggagtccaaagtgagtgctcacatcgggagtttgctgccatgggctggccccggtgacccaaggcgacccaatcacctgcagaaactcggcgctcgtctcgcggtcggaaggagatggcccgacaaaagtgctcacatcgggaatccgttgccacggctcgacccttgatgctggcccatgtcgatagaagggctcagagaagggaaagggcacggtccccggggaagcttccgacagaggacgcggcccctttccctctttggccattgggggcttttccggcgggagccaaggcacttctggtagaggagcgcgtgtgagcactttgtggtcaagagaggcctgcgggtgaagcgacgttttccaggtgggcggctcaaggaacatatgtggcttcgtcctctggcaacgaacgcctcgcgtgagcactcacgcgagcgagctccagtcaaaccggtccctttcccaccctgattggcagcggaagccttgcacgagtgctcgcacggcgaccttccgccagtcggtccgtcgaagaagggggtggccaaggtcacggccccattctcgggcggaatgtcgctcgaaggggcatggagacggaatgatctgcggggtggctgcccgtgctgggcggcagatgcccaatccattcaatgaccccgattccccggtcacgagcggcgtggtctgttgagacggttggccccatcttgaggaatgccctgggctgcccgcgcattccgagtggaggatcgggggcgattacccttccccgagggccaccggccaccctcccttccttgacttccaccgcccctcaaactggcggttggcgtgggatatccggtccatccccagatggaatgtccgacagcggcccgcgggtgagacgagggacgggcgacgacggtctcgacggctcccgtccccgccgcgacgacgtcgtctgcccgtccccgaggcagccccggcagcgcagctccctccccgcgttcgtcgagccctccactttgaccagaggccggaatttgttgcgaggacaacggaaaggcatcccgcgctctgatatcttcacagcatctttaaggttctatttgaaaccaggcggtggttgtccgccaattggggaggccccgtgctcgagagaagagatttcctgcgtcttgccatggtgcttggctccggcgccctcgccgggtgcgccgcgcagcggtcgggtgccgccagcgcctccgactccggcggagggggcagcgactcccaaagctcctccggcaatcagcgcgtggtcgcgaccctgcgctccctggcgcagatggcggtgctcgcggggctgccgccggtcggcgtctccaaggacgcgaccgacctcgacgggctgccatcagacgtgcaggtcgtgggcaccagcgcccaccccagcctggagaagatcgtctccctccaacccaccctcgtgcttctcaccggcgaggtccccacgcagcgggagctcgagtccggcctggacgacgcggggatcgcgtggcgcgaggtggacgtcaactcctttgacgactacgccagcaacatgcaggagctcacccagctgagtggccgcggtgacctgtacgagaagaacgtggaggacgtggcgagcgcgatcgacggcgtcaaggcgaaggcgggggacctcccccaggtgagctacctcgcgctgttggtctcgtccaccaaggccaaggtcgcgaaggcgggctacttcgcctgcgagatcctcgacaacctgtcaatgcacaacatcgcggacgacggcagcgcgctcgatgacctctcggtagaggcgatcgtggcggcagacccccactacgtcttcgtgattccccgcggggacgaggacaaggcgcgcgaggcctttgagcaggacttccagtcccagcccgcgtggtcgtcgctcgcagcctccaaggagggaagggtcgacgtcctgcccaaggacctcttcgagtacaagcccaacgaccgctgggccgaggcgtactcctacatcctcgacctcagagggaagcagggctagccatgtccgctggcgggggagagaggacgggcacgcggtgccgtgtggcgctcgcgttgggtgtgacggtgctcgtcgccgtcgcgctcgcctccctcgtcacgggaaccgctgcgctcggcacactcgactcgctgaacgcgctcggcacactcgccctgggaggtgacgccggagccacggcgtccctcgtcctgctcggcgtgcgcgccccgcgcgtggtcgcgggtgcctgctgcggcgcggcgctcgcctgctccggcctgctgctgcaggcgtcgctcgacaacgaccttgcctccccgggcgtgatgggcgtcaactccggggcggggctgttctggctcgtcgccgcgctgctggtgccggggcacccggtcgtgcggcagggcatggcgttcgtcggcgcgctcgtctccacgctcctggtgtacctggtctcgcgtcgcgccggcagcagccgcggcaccgtggtgctggccggggtggcggtctcgagcctcatgggcgcgggcatcgacgccgtcgtgaccatctggcccgagtcggtggcggaccgggttgccttcaccctgggcggcctctccggccagaccttccagcggcttgccctcggcgtccccgcgatggcggcggcgctcgcggcgggggtggccctgggccgcggcatcgaccttctcgccctgggtgacgagacggcgcacggcctggggctcaacgttcgtgcctcccggctcgccgcgatcgtgtgcgcggcggtcctcgcggcctccgcggtctcggtctgcgggctcctgggcttcgtgggcctgatcgtccccaacctcgtgcgcatgtgggcgagtcccggcacccgtcccggcctcgcgctgtgcgcggtgtggggcgcctccctcctggtcgcgtgcgacctcgtggcacgcacggtcgccttcccgtacgagctgccggtcggcctggtgctctcgctcctgggcgcgccgttcttcatctcgctgctcgtgcgcagggggcgtggccgccgctcccactccgtcgccgcggcacgcgggggtgatgcccggtgatctccgtgagcgggctctcgttcaggcgcgacggcgggttcaccctgcggatcggctccctccaggcggcggacggccaggtctgcgccctcgtgggcaagaacggctgcggcaagtccaccctgctcaggtgcctcgcggggatcctcccgtacgaggggagcgcgctcgtcgacgggagggaggtccgtgggctcggccaccgcgaacgcgcccgcaggctcgcatacctgccgcaggacccgggatgtccccacatggacgtgcgcaccctggtgagccatggccgctacgcaacgctcggcgctgtcaggaccatgggcgagagggaccgggccctcgtgcgccgagccatggagctcacgggagtgtggcagcttcgcgaccggtggctctcggacgtgtccggcggcgagcttcagcgggcgtacatcgccatggtcgtcgcccaggacagcgggacgctcctgctcgacgagccctccgcccacctggacgccctcaggcgccgggagctcgccgaccttctccgccggctcgcgggggaggggctcgcggtggtggtggcgacccacgacgtggaggcggcattctcgtcctccgaccaggtctgcctcatggccgagggggacgtggtcgcccgggggaccccggaggatgttgccgcgagcgggagggtgccccagacgcttggcgttggcgtggagcggcaggagggcccccggctgctgtgggggtatgcgctcacgcgcacgtgacggcgcgcgggatacggaaagggaagggcgccccgtcggggtgcgaacgagagggggatgcgtgggatacgtgcttgatggggaggggctggacgggctggtccgcgagcttgcgcgcgactacctggtctttgccccggtgcggaaggtcggcgcgggccggttcaccgacgtcgaccaggtgatctacgacttcgtggacgacgcttcgcagatagagctcgacgccaagagcgactactcgttcaaggagctgctcacgcccctctcgcagacgctgttctacttcaccgaggaccaggtgagagaggcgcggggcatcgggcccgccggcggccccggccagggcggcgacgaccgcgacgtcttcgtcctcatgcgcgcttgcgacctgcacggcgtcaggcgcctcgacgacatgtacctgcacaacgggcccgaggacagcttctaccgccgggtccgcgagcgcgtgcactttgcgctcatcgggtgccccgagggctttgggcactgcttctgcgtcgacatgggcacgaacgtggcccccgacaactgggagttctcgctcgagcgccgaggcgacggctacgcctgcgcggtcgagggagagtcgctgcgcccgctgttcgagcgccacgccaagggggccagcgaggtcgtgcccgcgcacgtctcccagaacgaggtgcacgtgagcgttcccgggtccatgccgatggaggtccgcaccagcgacctgtgggacgagtacacccgccgctgcataggctgcggaaggtgcacgctggtgtgccccacctgcacctgcttcaccatgcaggacgtgctctacaccgagaacggcaggatgggcgagaggcgccgcgtccaggccagctgcatgatcgacggctactccacggtcgcgggcggcgcgagctaccgcaagcgcaacggggagcgcatgcgcttcaaggtgctgcacaaggtctacgacttccgccagcgctttggctacgacatgtgcgttggctgcgggcgctgcgacgacgtctgccccgagtacatcagcttcgcggcgtgcgtcaacaaggtcacggacgccgtcagcgcctgggatgcccagcacgaggggagcgtggtctcagatgactagcaacaacccgtacctgccgtttccctccagggtgctccaggtgatccagcacacgcagaaggagttcaccttccgcatggcgtttgggggagaggtgcgcccgggccagttcttcgaggtgtcggtgcccaagtacggcgaggcccccatcagcgtgagcggcatcgttcccggggagtccgtggacctcaccatccgccgggtgggcgtggtgaccaacgaggtgttcaaggcctacgaggggcagtcgctcctcctgcgcgggccgtacggcaacggcttcgacgtgagccgctacgtggacggcgagtgcgtggtcgttgccggcggaacgggggtgagccccgtgcgcggggtcgtcaacgccctcgcggagagcgcgacgccgcgggacaagcacgtgatcgtgggcttccgcagtcccgacgacatgctgttccgcgatgacctcgcacggtgggaccaggctctcgacctcatcctcaccgtggacggcgcccccgagggataccagggcaacgtcggcctggtgaccaagttcatcccggacctgccgctgcgcgacccgtccaccacccaggcggtcgtcgtgggcccgccgcccatgatgcgcttctccgtgaaggggctcctcgaactcgggctggcggaggagaacatctgggtgagccaggagcgcaagatgtgctgcggcctgggcaagtgcggccattgccgcataggcgagaagtacgtgtgcctggatgggcccgtcttcaactacacccagagcaagcagttgctggactaggaaggaggccgccgtgatacaggacgtcgacgtcaaggcgatgaagaagaacgccttccgcgtgagcaaggagcgcggcatgaccgcaagccgcgtgcgcgttcccggagggctcgtgagcgccaggagcatggcgcgcatcgtggagatcgccgaggagtacgggaggggcgagatcttcctcaccaaccggcagggggtcgagatcccgggcatccacatggaggacatgcccaaggtcaacgagctcctgcgctcgatcatcgaggacacgggaatcaaccagggcgacagcgagcacggctacctcgccagcggcacgcgcaacgtcgtggcctgccccggcaagaggctgtgccccttcggctgctacgacaccaccgccttcgcgcagcgcatggaccgcgcgatctttcccaacgaccgccacgtgaaggtcgccttcaccgggtgctccaacgactgcgcgcacgtggccctcaacgactttggcgtcatcggcatgaccgagccccagtacgaccccgcccgttgcatcggctgcggacagtgcgtcgaatggtgcaggcgcaggtcggtgagcgcgctcagcctggtgaacggcaaggtcgtgcgcaacgaggaccgctgcatcggctgcggcgtctgcgtggtgtactgccccacgcgcgcgtggacgcgcagcagcgagcactacttccgcgtcaagatcatgggccgcacgggcaagcagaacccacgcctggcccaggactggctgcgctgggtggacgaggactccatcgtgaagatcgtgaagaacacctacgccttcattgacgagtacattgaccccaacgcgcccgagggcaaggagcacataggctacatcgtggaccgcgtgggcttcgacgagttctgcaagtgggcgctcgagggggtcgagctgggggagaagtgccagcgcgccactcgcgtgtactgggactccaagcgctacgaccgcgataacgacctgcgctagcgcaccccttcggtggcgcgccctcgggtcgcgccccgtccccatgacggcacgcggcgtggggacggggcgcccggggtttccgccggcacgtcttggctcctagtccctctcgcccagcccctcgtcgacgccgtcgagccactcctgcaggagggccaggtagcgcgggttgtcgtccacgtagcacatgtggcggcagttggggaagatctcccaccgcgcgttggggatggcgtcgtacatctgcttggcgatgagcggcgagcacaggtcctgcgtgccgtcgatcaccagcgccgggcagctgatctcgcccagccggtcggagtagtcgtagtcgcgcagggtccccgagggcatcagctcgttgtccccccacgcgtggacgtacgactccctgccggtgcgcttggggcggcgcaggcactcggggctgtcctccgtcacgggacccgagcagaagagctccatgtagcgcgccagcgccgcctggaacgcggggtcgtcgaagtcgcccgtccgctcagcccgcgcgaaggcgtcccgctccgcgtcgctcaggtagcgcagcctgcggtgcccctcctcgccccacaggcgggacgaggcgagcgtgctgctgagcacgaccgacctcacgccggcaggcttgtggtcgcacaggtagatgatgcaggtggcgcctccccacgactgcccgagcaggtggacctcccccaggcccaggtgctcgcggagcgccgccagctcgttcacccacgtggaggcgacccagagctccgggtggtctgccatggcgtcgtcccacgacctcccgcagccaatctggtcgtaggtcaccagcgtgcgcccgtcgcggtcggcgagcgggtccagggtctccaggtagtcgtgcgttgagcccggtcccccgtgcagcagcacgatcggcgcgcgtcccgcgaccggacggtccggctccgcgatgcggtagtaggtcctgtatcccaggtagggcatgtacccctcggtgacgcgcatgctgctccctccccgcggcggctctcgcccgtccccgccgcgcatgtgtctcgtttggcccatccacgataccgcagggacgggggagaggcgcgcgggcacccccctcgcacggcgcttgcggcgggcgggacggcacgtacaatcgggagggaaaacggacgccgccgcgcgcggcacgaaagggggacggcatgggctcgaacgaccggcagggggcatacgccagcagggacgaggtcccggagcggtacaggtgggacctctcgtcgctcttcgcgggcgacgacgagttcgagcgcgccctcgcggacgcgcaggcggtccccgacgagtacgccgccaggagggactctgccacggcgtcgggcgaggggctcctggcctacctgcgctttgacgacgacgccaccctgcgactccagaggctgtggaactacgccggccgccgcgcggacgaggacacccgcgtgagccgctgccaggacctcaacgcgcaggtgacctcgctcctctcgcgcgtgggggcgtcctcggcctggttcgagcccgccgtctgcgcccttgacgcccagaccctggagggctggtaccgctcgacccccggcctggggctctaccgtcgtgcgctcgaccgcatccgcgccctcgccccacacgtgctgggcgagtcggaggaggcgctcctggcccaggccggcgagatggcggcgcagccgggactcgccttcaccatgctcaacgacgccgacctccgcttccccgacgcggtggacgctaggggagaggcgcatcccgtcacgcacggcagcttcgtcccgctggagcagtcccgcgaccgcgtgctgcgcgagagcgcctaccacagcgtctatggcacctacggcaaggtccgcaacaccagcgccgccctcctcgccgcccagatgcggcagctcgcgttcttctcccgtgcgcgcgggtacagctcgtcgctcgaggcgtccctggtccccaccgaggtcccggtcgccgtgtaccagagcctcatccggtcggtccgccgcaacgcgcccgccatgcactcctacatggcgctcaggaagcgcgccctgggggtggaccacctgcgctactgggacgcgtacgtgcccatcgtccaggcgcccgaccgccgctacacctttgaggaggcctgcgacctcatgctccgggccctcgccccgctgggcgaagactacctcgcgaccgtcaggcatggcatcgcgtcgcgctggatcgacgtgtacgagacgccgggcaaggtgagcggcgcctactccgcggacggccacggcatggagcccctggtgcttctcaacttccagggcacgctcgacgacgtgttcacgctgtgccacgagatgggccacgccatgcagacctggctcagcaaccatgcccagccggcgcgctacgctgagtaccccatgttcgtggccgaggtggcgtccacgaccaacgagtgcctcctcacccgccacctgctctcgcaggcggacgaccccgccgagcgcgcgctcatcatcaaccacttctgcgagcagtttcgcggcaccctgtaccgccagaccctcttcgcggagttcgagcgcgacgccaaccaggcgtgcgccaggggagaggggatgggcgccgacgccctgagcgagcgctaccgggggctctgcgacgcctactatggttccgccatcgagtcggacgacgagatcgcgctggagtggtcgcgcatccctcacttctactacgactactacgtgtacgtgtacgccacgagctttgccgccgcggtggcgctctcgcagcgaatcctgggcgagggcaagcccgcggtggacgactacctggccttcctctcgggcggctgctccaagtcgcccatcgagctcctgcgtggggccggtgtcgacatggagtccggagaggcggtcgacgccgcgctggcgcagttcgcggagctggtggacgagctctcgtcgctgctgtaggcgacggcgggcgagaggggccaccctccggggcctgcgagacggttccgccgccccgcgtcccgccacgctgctatcctgtggctgtttctgttggtttcgagacgaggggtgcctgctcatggcggtggctgaccaaagcgctttgggggagagcctccccgcgaccgacggctccagacgtcgcccggagggcgaggtgctcctctcgcccgtctcgggcatggcgatgagcatgagcgacgtggacgacccggtgttctcgagcgggatgctgggcaagggcgcggccgtggagcccagctccggcgtggtgtgctcgccggcggatggcacggtgtcggtggtggcgcgcgccaagcacgccctctgcatgaccaccaagaccggcctggaggtgctcgtccacgtgggcatcgactcggtggggctcggtggcgcgccgttcgacctgctctgcgacgaggggcaggcggtccgcggggggcagccgctcatgcgcaccgacctcgacgccatccgcggtgccggcgtcccggccacggtcatggtggtggtgatgtcgacggacgacgcctccaaggtcgaggggcacctcggccccgtcgcgcagggcgaggagctgctgcgcgttatctagccgcgccgtcgtacgcgcacggccccgtacgctgccaggggaggggagcatggacatcaacggcatagcgcgcctcgcgggcgtgtcgagggcgaccgtctcgcgctacctcaacgacggctacgtgtcggaggagaagcgccggctcatcaagcaggtcatcgacgagacgggctacgtgccctcgcagcaggccaagacgctccgcacggggaagaccaacctggtgggcgtggtcatccccaagatcaactcgcagtccgtctcccgcatggtcgccggcctcacgtcggtgctcaacgagagcaagtaccagatgctgctggccaacaccgacaacgacaccggcctggaggtggagtacctcaagctgttcgccgagcgcaaccgtgtggacggcatcgtgctcatcgccacggtcatcacccccgcccaccgcaaggtgctgggcgagacgcgcgtgcccgtggtggtgctgggccaggagctctccggctgcacgagcgtgttcaacgacgactaccacgccatcctcgacgtcaccaacatcgttctggagcacagcgcccaccctgcgttcatcggtgtgctggaggacgacgtctcggctggccagatgcgccaccgtggcttcctggacgcctgccgcgaccacggcatagaggtgcccgggcgcgcgcagtgcgtgagcgacttcacggtggacgcgggctacctcgccgccgagcggctgctcgaggcctaccccgaggcagacgccatggtctgcgcctctgacaacatcgcctttggcgccatgacctgcctgcgcgagtacggtcggcgcatcccccaggacgtccaggtcaccggcgtgggagacaccgacctggcgcgcgtcatcacccccacgctcaccaccgtgcaccaccactacaagaccgccggcatggaggcggccaaggtgctggtgggcgccatgggcgagcgcgacgacgtcgaccgcgaggtccgcatgagctacggggtgctccgccgcaactccacgctgtagccgccgcgatgcgccgggggagaggcgcgtggcccctctccccaagcccgtccccacgccccgatggcgcgtccggcctgtcggtgacgccccgttgggattccgttggtcccgcccgtctcccatcgactccacgtctctgccgctcatggcagataagcgaccgtctgccgccacccgtggtggagaaccctcacaagttccacaacctggagtatcactgatttgtgagaacgatttcacacggattgccccacggtgtccgcggaagtcgtggggttaaggcgaggatgcgctcccagcttggtgtgggaacggtcccagtcgaaggggagtgggcatggctcttgattacaagcaagccgcgaaggaggccctcgaggccgtaggcgggcccggcaacatcgtgtcggcggcgcactgcgcaacgcgcctgaggctcgtgattgcggacgactccaaggtcgacaagaagaagctcgaggacgccgtgggcgccaagggcaacttccaggcgtccggccagctgcagatcatctatggcacggggaccgtcgacaaggtgttcgatgagttcgtggcgcaggcgggcatcaccgccgggtcaaaggccgacgtcaagcaggcggccgccgccaagggcaacggcttccagcgcgccatcaaggtcctctccgacgtcttcgttcccatcatccccgcaatcgtcgcctccggcatgctcatgggcatcatgagcgccctgcagtacatgggcacccccgtggcagacggcggtgccgggttcttcgcgctcgacaccaccaacgtgtggtggcgcatcgcctcgctgatcaatgcctgcgcgctgggcaacctgcagatcctgctgggcttctcggccgcgacggtctttggtggcaacccgtacctcggcgcctccctgggcgctctgctcatcagctccgacttcatcaacgcctacagcgcgtctgacgccatcgccaagggcaccatgatcacgctcgacgttatccccggcgtctacagcatcgactggatcggctaccagggccacgtcatccccatcctggtgggcgtctggatcctgtgcttcttcgagaagcgcctgcacaaggtcgttcgcgagatgttcgacctgttcctgaccccgctgctctccgtttcgcttgccgcctacatcaccatcctgttcgtcggccccatcttcgtgtggctcgagaacaacatcctcggcctgctcatgttcctgctctccgtgccccttggcatcggctacgtgatcatcggcctcatctactcgccgtcggtcgtcacgggcctgcaccagatgtacaccgccatcgacgtctcgatgctcgcgcagtacggcgtgacctactggctgcccatcgccagtgccgccaacatctcgcagggtggcgcctgcctggccgtcgcgctcaagacgcgctccgagaagaccaagtcgctcgccgtcccgtccggcatctcgtgcctgctcggcatcaccgagcccgcgatcttcggtgtcaacctgcccaaggtcaagcccttcgtctgtggcatgatcggctccgcctgcggcgccctgtgctgctacatcttccagctcgccgccagcggcaccggcgtcaccggcatctttggcatcctgctctgcatcacccagcccctgcagtacgcggtcatgttcgccgtcgccttcggcgtggcgtttggcctcaccagcacgatctaccgcgatccccaggcagaggccgagcccgccggccaggcgctcgccgaggccaaggccgcagctgacgaggcggttgcggaggagaggtccgtggaggagaaggacgccggcagcgctcccgcgcccaaggcagaggtcatcgcatctcccgtcgccggcaaggcaatcgccatggccgacgtgaaggaccccgtgttcgcgagcggtgccatgggcggcggcgcggcggtcgttccctccgagggcgccgtgtacgcccctgtcagcggcaccatcaccgtcctggccgagaccggccatgccatcgggctcctgtccgacggcggtgccgaggtcctcatccacattggcatcgacaccgtcaacctcaagggcggcccgttcacgccgcacacccaggtgggtgctcgcgtgagcaagggagaccttctcatggacgtcgacctcgacgccatcagcgccgcggggctcgacaccaccacgatggtcgtggtcaccaacaccgacgactacggctcggtcgaggggaagaccggtcaggtcaattttggcgacgacctggtgagcctgtcctaatacctccgggagtcacattggccgcccgtgcgtcgcatccccgtcacggggacggcgcacgggcgtctcgcctaggtacgcatcgcacgacgtcccgcccgtggcaacctcccgggcggaagatgggagaggaacgcccatggcaagcagcaacgcggagcatcccaagcacgactggcgccccgccttccacatcacggtccccaacggggcgctcaacgaccccaacgggctctgtcagatcgacgggacctaccacgtgttccaccagtacacgcccagctggccggcgcgtggcgtgtgctgggcgcactggaccacccgcgacttccgcacgtgggagttccatggctcgcccatccaccccgacggcgacctcgaccgcaacggctcgtactccggctctgccgtggtgcgcgacggcaggatgtggtgctacctcacgggcaacgtcaaggagcccggtgactacgactacgacttcgccgggcgcaaggccaacgagctcctgtgcgtgagcgacgacggggaccatttcgacggcaagcgcctggtcctctccaatgccgactaccccgcctactgctccaaccacgtgcgtgacccgtacgtgtgggagcagggcggcgagtaccacatgctcctgggcgtgcgcacggtagagaaccgctcggcggtcatcctctaccactcgcggaatggcatcgactggcagatggaggggtcgctgagcaccgtgggcgagaggccccttggctacatgtgggagtgtccggggcgcatcgcggtgggtggcaggcagtacctgctggtatgtccgcagggcgtgcccaagcgcgacctcgcgttccagagcatctacaactgtggggtcttcccgctgcagcgagacctggtggagatggcacgcggcgactccgggcgcatggaggcttccggcccccagcgcgttctggaccctgcctcgttcgtggagctggactacgggtttgagttctatgccccccaggcgttcacggacgagtccggcaggaccatcctcatgggctgggtggggcttcccgacgtggtgggcgagtacgacgaccccacgcaggcatggaagtgcagcatcaccgtgcctcgcgagctgagcgccaacgcggcaggacgcctctgccagtggccggtcgcagaggtcgatgccctccgcggcgagcgggtggacctgacccccgagggggcgcatggctcctccggacttataggctcctctccctacgacatggtgtgcatggacggcgcggtgggggcgaccgtccccggctgccagctggacctcctcgtgagcgacatccggggcgagggcaggatctgcctcaacgccgacctggagctctccgtggtgggacagacggtggagctcgccttcctccgccgttccggcaggggcaggggcgttcgcagggtgcccctctcggcgctgtccgagggtgcgctcaggagcgttcgcgtgctcgtggacacctcggtggtcgagatcttcctcaacgggggagaggtgacgctcaccacgcgctggtacccggaccgcgtggaccggctgggtgtctccagcacctttgggggagaccattccgcatggctgctggatggctggacctttgcgggggtatagggagccctagcacgggcagacggcggggtcgggtgccaagctcggccccgccgttgtcttggatgcccctctagcaggggttttcccacccatgccgcgatgcatcaaacgcggccaaaagggatgtccggggacgaaaccgacccttggctttgcgttattatgaatcgtggccaagactgggatgggggatccaagtcgcggtcctgcacgccgtcgagagacggggcgccaagcgcgttcgtgtgtggaacagccgcctctggtggcggaccgtatcgcttcgaaggagaggatatggcaaggaaattcaagtctatggacggcaacgaggccgctgcatacgtctcgtacgcctacaccgaggtggcgggcatctacccgatcacgccgtccagccccatggccgaccacgtcgaccagtgggcagccaagggcatgaagaacatcttcggcacgcccgtcaaggtcgtcgagatggagtcggagggcggagcctccggcaccgttcacggctccctgggcgcaggtgccctcaccagcacctacaccgcctcgcagggcctgctcctcatgattcccaacatgtacaagatcgcggcggagcagcttcccgccgtcttccacgtgagcgcccgcaccgtcgccacgcagtcgctgaacatcttcggtgaccactccgacgtcatggcctgccgccagaccggcttcgccatgctcgccgagagcaacgtccagcaggtcatggacctctcgcccgtggcgcacctggccgccgtcaagggcaagacgcccttcctcaacttcttcgacggcttccgcacctcgcacgagatccagaaggtcgccgtgtgggactacaaggaccttggtgacatgctcgacatggccagcgtccaggcgttccgcgaccacgcgctcaaccccgagcacccgcatgctcgcggcagccacgagaacggcgacacgttcttccagaaccgcgaggcctgcaacacgctctacgacgagctccccgacgtcgtcgagcactacatggacgagatcaacaagcgcatcggcaccgactacaagccgttcaactactacggcgcacccgacgccgaccgcgtcgtggtctgcatgggctccttctgcgacacgctcaaggaggtcatcgactacctcaacgccaacggtgagaaggtcggcctcgtcgaggtccacctctatcgcccgttctccatcaagcacctggtcgccgtcctgcccgagacggtgaagaagattgccgtcctcgaccgcaccaaggagcccggctccgtgggcgagcccctgtacgaggacgtggtctcggccctgtacgaggccggtctctccaacatcaccgtggtgggcggccgttacggcctgggctccaaggacgagccccccgcggctgcgttctcggtctacgaggagctcaagaaggacgagcccaagcgcgagttcaccctgggcatcgtggacgacgtcaccaacctgtcgcttcccatggaccccgatgcccccagcacctccgcgcccggcaccatcgagtgcaagttctggggcctcggcggcgacggcaccgtcggtgcgaacaagaactccatcaagatcatcggtgaccacaccgacaagtacgttcaggcgtacttccagtacgactccaagaagacgggcggcgtgaccatctcgcaccttcgctttggcgactcgcccatccgctctccgtactacatcaccaaggccgacttcgtggcgtgccacaacccgtcctacatcgtcaagggcttcaagatggtccgcgacgtcaagccgggcggcaccttcctcgtcaactcgcagtggagcgacgaggagttcgcgcgccagctgcccgcggtcgccaagcgctacatcgccaacaacaacatctcggtctacctgatcgacgccatcgacctggccgcaaaggtcggcatgggcaagcgcaccaacacggtgctccagtccgccttcttcgcactggccaaggtgctccccgccgaggacgccctcaagtacatgaaggacgccgccgagaagtcctacgccaagaagggccaggccatcgtcgaggccaactggaaggccatcgacgccggcgccaccgcgttccacaagttcgaggttcccgccgactgggcaaatgccaccgacgagcccaaggaggtcaagctcgagggccgcgaggagctcgtcaagcaggtcagggagctcatgcagcccatcaaccagatggagggcgacagcctgcccgtctccgcgttcgcggagcacgccgacggccagtgggagcttggtgcgtccgcgtacgagaagcgcggcgtcgccgtcatggtcccgcgctgggatccctcgaagtgcatccagtgcaacacctgctcctacgtgtgcccgcacgccacgatccgcccggtcgtcatgaccgaggaggaggctgcctccgcacccgaggccatgcgcacgaccgatctcaaggtccccaagggcaccggctacaagttcaccatcgccgtctcgccgcttgactgcatgggctgctacaactgcgtcgccatgtgccccaagagcgacgtcaaggagggcggcgccctcaccatggtgccccaggaggaagaggccgcgcaggccgaggtctgggactacggcgtcaacaaggtcacccagaaggacgagctcgcgggcgactccaacgtcaaggcgtcccagttccacaagccgctgctcgagttctccggctcctgcgccggctgcgccgagaccagctacgctcgcctcgtgacccagctcttcggtgaccgcatgttcatctccaacgccaccggctgctcctccatctggggcaaccccgcggcgacctgcccctacaccaccgacgccaacggccatggccccgcttggaacaactcgctcttcgaggacaacgccgagcacggctttggcatggaggtcggctacgaggcggagcgcgaccgcgtcgtcgtgatgacgcaggcgctgctcgagtccgactgggcgtccgacgacctcaaggccgccgcaaccgcgtggctcgaggccaagggtgacgccgagggctccaagaccaccgctgccgagtacgtgaggcagctcgaggccgctggcacgcccgaggccgagaagctcctcgccgagaagtccttcctcaccaagaagtccttctggatcttcggcggcgacggctgggcgtacgacatcggcttcggtggcctggaccacgtcctggcgcagaaccgcgacgtcaacgtcttcgtgttcgacacagaggtgtactccaacaccggcggacaggcgtccaaggcctctaacctcggccaggtcgcacagttcgctgccgcgggcaaggacaccaagaagaagtccctcgccgagatcgagatgagctacggctacgtgtacgtcgcccaggtcgccatgggtgccaaccccatgcagaccctcaaggcgatccgcgaggccgaggcctacgacggcccgtcgctgatcatcggctacagcccctgcgagatgcacagcatcaagaagggcggcatgatgcactgccaggaggagatgaagcgcgcggtcgactgcggctactggaacctcttccgcttcaaccccgccgctgccgagggcaagaagttcacgctcgactccaaggagccgaagggcggctatcaggacttcctgatgaacgaggcccgctacgctcgcctgacgcgcgagttccccggccgcgcagaggagctcttcgcccagaacgaggaggcggccatggaccgctacgcgcaccttctcaagctcaaggagatgtacgccagcgagtaggccagcaaggctgagagcctagcgaaccgatggggccggaccgggatgcattcccggcccggcctttctcgtgccgtccccatgtgcttgaattgggtcgaccagcaagggagatgaggcgcgtgccaacgccactcaggtatcaggtgacccactacgactgcggccccacgtcgctgctcaacgccctcgcggtgctctttgaccgcgacgagctgccgcccgacgtgctgaagggcatctacgcgctctcgctcgaccgctactacgacggccttgcctaccacggcggcacgtccggcatggccatggcgcacatcgcgttctggctccaggactacgcggacaggacgggcttccccctcagggccctgcgcgtcaccggccagcaggtgagcctggcggagggctcacccctccacgaatgcctccaaaagggcggggtggcggtcgccggggtccgtctggacgttgaccactacgtcgcgctcacgggccttgaggacggtctggtgcgcgtcttcgacccgttctggagcgcgccgggcgagaaggattggggccctggcgtgacgcagataaccgacgccccgttctcgcacaaccggctgatccgccccgaggtcatggactccgagtgcgaccacgagtactccttcgcctgcgcgagcggtgcggaggcggtcctcatgtggcgcacgccctcgcacgggcgagacggccaagactagggcggcgggcccaccccactgggatgggcccgccgcttcgttcgcctgtcagtcttgagaccaggcttgctagtccctcttgccttggtgggaggcgaggtagggggagaggagcggggtcatctggccctggctcaggatggtgacctcgtgcatggcacggctcgcggcggtgtagagacgcctgcgcgcgaggggctcgtcggggtagacctcggcctgcgcgtcggggatgatgaccgagtcaaactccaggcccttggcgagcctgaggtccagggtcaccacaccctccttggggtgcgtgtcccccttgcccaccagcggcgcgaggtcacccagctgccgcgctatccagttggcgcgggcgccgtcctgggcaacgatggcgcagagcccctccttggcgtgcgcgttctctgcggccctgcgcagcaccggcaggtacgcctctgcatcggcggggcactcgcggatgacgggctccacgccggggcgctgcaccgagctcagcgtcacgcgctcctcggggggcagcaggctgcagaacagttcggtgatctcgggagacgagcggtagctcgtgagcaggcgacactcctccacgaccccgtgggtctcggcaaacacctcgcggatctgcccaaagcccgcgcttccctccacgatagcctggtgctggtcgcccagcagcaggaagtgggcgcgcgggaagtagcgggccaggaccatgagctgggtctgcgtgtagtcctgtacctcgtcgaccatcacgtagcgcacgtcgtcgtcgcccgtgccggtcaccaggatcttgaggtacaggtactcagcggcgctgaggggcctcccgcccgtcaggcgcatgcccacgcggtcgagcctgagccagctcgcgtcgtcgatctgcttgcgggcgccgccgtacaggaactcggcgtagcgcctggccagggcgtcggtctcacgctcgtcggagggcgcgatcgtctcgccaaacacctccacctggcgttccacgtccagccccagcatctcctcctgcagttcgtcgttcttggatatctgggtgatcctgcgctcgagcttggagcgcaggtcctcgcgtaccagcgtcatgagctttggccctacgccaaagcgctcgaacttgcgcaccgaggcggcgatggacgatgccttgagcatcgagagcccgccctcgcgcacgtccctaaagtcctgctcctccagcgcgagcgaggggaggccctcctccagggcgcggagcgacacactgtccacgtccgccccgctcgccctgtccgccagccccagccccgatacccactcgcgccaggtcatgatctgcgggttggactcgcccagcgagggaagcaccgcgtcgatgtagcgcgcgaacacgtcgttgggggagaggagcaccacctggtcggcccgcagcgtgtccctctggccgtagaacaggaaggcgatgcgctggaggaggaccgaggtcttgcccgagccggcgatgccgttgacgaggaggaccgggacgtcggagtggcgcacgacctcgttctgctcgcgctggatggtggccgtgatcgcctggagcttctcggtgtggtggcgtcggagcgcccccagcagcagcgagtcctcgatagccacggtggtgtcaaagtagccgttgaggtggtcgcgggtgatgtcgaactgcctgcgcagctccaggctcacgttgcgcgtgcgcccgtccacctggtaggaggtggggcccatctgctggttgtagtacgtctcggcgatggggctgcgccagtccacgatgagggggcggcggttctcgtccgtgacgcccgcgaggccgatgtagacgtcgcgggccggcctgccggggcgcatctgcagcctgaccttggcaaagtagggctgggcgagaagggcgatggtgcgcctcagcttgtccacggtgaagtcgtggttctggttgtaggcgtcgatgaccgagttgagggtctcgatggccgcgagcgtctccatggtctcgtccgcgctgctgaagttgaggcggacctcctcgctcatgtccctcaggtcctgggcggcctcgcggtgggtgacctcgatctccctggtgagactgtcgcgaatcgcctcgagctttgcatagacctggctcaggtgggcctgctcctcgtcaaacaccggatcggacatcgcaacctccctgtgcgctcaagattccgaagagaaaattctagaccaaggggagaggggctgtcccctcggggacgaggaagcctttatgccgcctgcggccaaaaccgaccgttcgccaggttgaccagagattggcatacatttgcccgcgcaagggtattatttcaacgagcaaggaagtcgcccccacgggcggcacggtcggggaggtggtgcccatcaacagcgaggaaccgtattcttggcgtcccgtggatgacaccgagtgccccgtcttagcgtaggagtcccgcatcatcgggaacatggtaagcgaacacgcatcgcacaagccaaacggcagacggaagagccggtgtcgccacgcaggagctgggcatccagtaatggatgcgggcgtggccagtatgactgacaagtgcatagcaaacaggttttgagacatggcgaaacgggtgataccaaagtaatcgccaaggttccaaatccaagggcgggcgacctgcgggtcgcccgcctcgtcttgtttgagataggatgaggtggcctgcccccgtggcgggatccaaccaccaaaggagcagcgagaggtatccccgcatgatcaagctagcgctcaccgacatggacgacacgctcaaggcgatgcgccatccgcgcgtgacggactatgccctggacgccatcgacgcgatgcttgccgccggcctccactttggcccggtgagcggacgcgtccccgacgcgatgtcgtggatgttcgccggtagggaggagtgctacgccacgggcgccttcgtcaacggccagatggtctacctggacggagaactcgtgcacgaggagtggctcgatgcgggggagctctcgcgcgtggcgcgctgggcgtgccagaacaccactgacgcgacgctcgtgctgtacggcaccggggatggcatccccagcgagagcggccactacgtcacgggcgaccccgcgcgcatcgagcgcgacccccagaccttcggccctcgtgacgtgtgggcggaggtcccggcacacgaccaggtcaaggccaacgtgttctgcggcgggggcagggagcacctcgtccaggtgagggacgcccttcgaagcgagttccccgcgttcgacttcgtgcttcccagcaacgtcgcccccatcgtggacatcatgccccggggctggaacaaggggtcgggcgtgcgcgtcctggcgcaggccctgggcatcgggctcgacgaggtggcgaccttcggggactccgagaacgacctgggcatgatagagggcttccccaactcggtcgccgtgggcaacgcgagcgaggaggtccgccgcgcagcgaagtggcacatcgggaggagcgaggacgacgccgtggcggacgccctcctccagatcgccggggcggcggggaccggtggcgaccccgcgttcatgcagggataggagcgactggggcccgggtgctccgtgcgacgaggggagggggagccgtgaggcttcttgaggagagaatcaggcgtgatggggtcgtgaagagcgaccaggtgctcaaggtcgactcgtttctcaaccatcagatggacatcggcctcttcagggaaatggccaggcagtggcaccgggactttgccgacgcccccatcaacaaggtcctcaccgtcgaggcgagcggcatcggcatagcggccgtcgtggcggaggagtttggcgtccccgcggtcttcgccaagaagagcgagagcatcaacatcgacgggaccttctatgcgacccgcgtgcgctcgttcacccaccagagggtttacagcgtcatcgtctccacgcgcttcctggggccggacgaccatgtgctgatcgtcgacgacttcatggcaaacgggtgcgccatggacgggctgctccagatctgcgacgcggcggggccaccgtcgagggggtggggatcgccatcgagaagggcttccagccgggtggcgaccgcctccgtcagcgcggcatccgcgttgactcgctggcgatcgttgactcgatggacccccagaccggggacatcaccttcagggactagccatgggcagcggtagggcgaggcgcgacgaggggcttcacacccgtctggagggcgaggacgcgggcgagttcaaggcctgcaccaggaagcgccgttacgcgagtgaggcggaggcgaagaaggccgccgagaggagctctcgccgcaaggacgcccccaagatcttcgtgtaccgctgcgagtactgcggcggctggcacctcacgcaccaccgcccccgcggcgggaggaagtaggcaggggcatcgcgcgccacggaggccccctcgcggccggtgggtcggcgagggggcctcgttgcgttgcgtctctcccctggggactcggtgggtcgagatggagtagagcttgtagttgcgcacgtggcgcgagactccatgcccgatgtaggcgagaaggactgccgtcgccgctagtgcatcgccttggagaaggacggggccttcctggtgcccgcctcctcctcgcggagctcccggaggatcgaccacgccatggggattgtcacacagaaggtgacgcagtcggtgacgggctgggcgagctggacgcccgtgatgcccatgaggtggggaagcacgaggacgaccggggccaggaccaggccgagcctgcaggcgcccaggatggtcgcgcgccacatgcggccggtggtctgcaggaggaagttggtgatcatggccgtgcccgtgaggggcatagtcaggctctcgaccctgagggcgagaacgccgacggcgaggacctcggggtcgctcgagaagaggtggatgaggggctcggcgaacgcgcaggtgaggatgccgatgccaaagaccagggcgagcgccacgcgcaccgagaagaagtagccctcgcggatgcgcccgtacctgcgggccccgtagttgtagccgatcagcggctggaagccctgcccgatgccgatctgcacgtagttgccgaagccggtgatgcgctggacgatggcgagggcggcgatggcggcgtccccgtagggccttgccgcgccgttgaggagcgtggtcgccacgcccagcatgacctggcgcacgaaggagggcagcccgccgtttgccacctcgcgggcgaaggcccccgtcggcctgatgaccctgtggggcgagaggggggtgatgcccacgcgttgcatctggcgcaccaggagcaggaagctcagcccctcgcacaccaccgtcgacgtggcgcttcccgctatccccatgcccaccacgtagatgaggacgggggtgaggaacatgttgaggatggcgcccgacatgatggcgaccatggagtacagggactctccctcaaagcggagctgcatgttgagcatgagcgagctgcacatgaagggcgcccccaggaggatgatccccacgaaggtgcgggcgtaggggagaatggtgggggttgaccccgcgagcacgcaaatggggtcgatgaggaggttgcccacgagggcgatgaccgccccggcggccagggtgcagacaaggcccgtgctggccatctcgcacgcccggtccctccgctgggcgcccaggtaacgggcgattgccccgcccgtgccctggcccatgaagaaccccacggcctggatggcggtcatgaccacgaacgagatgccgatggcgcccgccgccgacgtgccgagcccgctcacgaagaacgtgtcgctcaggttgtagatgctcgtgaccaggttggagaggatggagggggcagcgagggacaaaatgagggggcggatgggctcttgggtcatctgcctgaacttctcgcgtgtcgtgtcctcgcctgctgccatggttcccatggtacgcctggaggcaatggcatcaggcggccatggaaaaagtgctcggagaacgaggcgccaggtcgcacgacggcgtgtctggcgggcagccatccatgcaattgggcggctgggaggcttggagatggcggggcccgtgcgggtggggagtccccgcttaacattctccgggctcgtgttgattgtggtgcacggtgcttaatccccctagccctcatgcggattttggagccgtctgcttaatcttgctagccctcttgtggattgggtgacgaaaatccgcacgagtccggggaagattaagcaggcatgggcagaatccccacgaggcctaggaacgttaagcatgccagggaagaatcagcgagggctcggggaatccaggacacgtcccaaccgttgctgcacgtccatgacccggtgagactggctgcctttggaatggtgcgaccaccaggggcacgctcgcgttgaggtcgagcatgtcgcgcacatgccggtgggatgccgatgggggcacgagggcggcccttctcgcccttctttgagctctttggtcgggtgtggttttgctgctcccgcagaatatcctgccaacgtcggtaaccgccgacgcgggcaacgccagcgttacggcgactagggtgctaacccctctcggacgaggtgccctccgccggcgcctggggcgagaggatcagccccagcatgaggggggtcgcatacatcagtgggagcgcgtagcgggtgatggcaccagggcacacgagcatcgacaggctggcgagcgcgatagggaccatcacggccccggagcggttgcggcgatagagtgcggcgaacagggcgagaaggggcagcagcccgccgtaggtgccgatcttgagggcctggggaaccagctggaggagcgtgttgtagtagtagccgctggcggcgtcgttgagctgcttcagggcatagggctgcgtggtgtcgatccccgtgtcgccctcgtacctgtcgagggcggggacggcctcctcgcacgaggtgacgggaatctcgatgggcgtggacgggatgaacaggctccccgccaccttcaccgtggactgcacgtagtaccagggatgcgagagccccagatgcgcccaggccttgaggtaggcgttcacgtccttcttcgaggcgtcccactcgtacaggttcttggtggggtcgacgaaggtggggtcgtagaccttgagcacctggtcgatgggcatgacgcgtgcgatggcctcgcggtcctcctggctcacggagtccccgtcgtacttgaggaccgcggcaacctgctgcatggtgaagcccaggctctcctgcctgccgccaggtgccaggtcgaagcaggcgtagctcagcgcggggaacgcgacgacccccagtgccacggggacgcagagcgccacgagggcgcgtccccaggtgggcctgcagagcggcacgagcaccaggagcgagggaaccaccacgtaggcgccgaccttcttggtgaggatggagagggtcgagaacgcaatggtcgcgaccaggttgcgcggtcgtcggaggaactccccccgcgtgcgggccgcctcgcagtagcacaggaggaacgccaggaagaggggtgcgaagagcgagtccttgagcatgtccgccgcataccgcgcgtaggggacgaagacgcagacgaagaccgcgaccgcaaggcgcagcacgcgcgggacgcgcaggcgctccaggtagcaggtggcggcggcgagcacggtggcagagaggaccgcctgcagcagcacgaacgcgccgtatccgatgcgctggtcgcccagtgcctgacccaggtcgtgcgccgccccatagatgagggtggtgaggaaggggtcgtggtcgatgtacttgtggtcaatcaccacgctgacggcacgggctgcgtagtaggtgggggtcgatgtcgtggactgggcgatctggtggagcgtgtcccagtcggtcatgcagggcagggcgggaatgacccagatggcccaggcggcgagaatcacgagggtgagccttcgcacgtctcgcctgttgagcgagagcggggcggcgtcgatcaggcggtcgtgccgcgagctcacgatgcgccttgccggctcccacaggaagacgacggccgcgaggaggcaccagaacaccgcgaaggtccccaccagcgagaggagcccctcaaggtacgaggacggctgaaagttgatgccgtcgccgcagttggccatggtggagatggcggtgaccaccgcgatgaccgcggcgaggcaggtggcatagcgcatggcgcgcggcttccttgcgtggagcgagcgcgcgaacttgatggggttgggcatggttggtctttcgggatcgcgattggggcgcccgggatgggcggcacgacagacatgcaggtgattctagcatcacgggtcgtggcgctccccatggcctgtgcgacaatggggccgaggagaggggggcggtcatgagggacgcacggctcgtagtcatgaggcatggggagagcgtctggacggacaagacccagaaccgctttgccggctgggtggacgtccccctcaccgagcgggggagggagcaggcccgtcacgccggcgagctcatggcggcggagggcatcgagccagacgcactcttcacgtcgctgctgcgtcgcacgatcgtctcggccgacattgccctggacgtgctcgaccgcatgtggattcccgtgatccgcacctggcggctcaacgagcggcactacggtgccttccaggggcagacgcgccccgccatgcgcgagcgttacggcgacgagctgttccaggcctaccgcaggagctttgacgttcgcccgccgcagatcgacccgtcgtccccgtacttcaccggagacgacccgcgctactccgccgcggcgggcgacgccctgggcggacctgaccccagcaccatccggagcgagtgcctgaaggacgtgatcgcccgcctggagcccttctggcaggcatacgtggtgcccgtgctcctgcaggggagcacggtgctggtggtcacgcacggctcggtggtgcggtcgctcatcaaggtcatcgagggcgtctcggacgaccagatcgtccacgtcaacgtccccacgggcatcccgcgcgtgtacgacttcagggtggacgcctttggcggcctgaaggtgaggggggagggccgctacctcgacccggaggccgcggaggccggcatggccgaggtccgctcgctggcgtagcgggggagaggggcacccctccaggcgcctgaccccaccctacggctgcagcaggtcctccacgaagcccacgcggtagttggagaagaccacggagccctcgtcctgcgtggcgtccaggtctacgtccgccgcgatgccaaagtcgtcgtcgccgtccgagtcgtggaacatctgccgcacgtgccacacgtggtcctggcgctcgtcggcctcgtccaccaccaggtagcgcgagctgtgcgcgtccccgtcgaggagaatctccccgtgctcgtcgtacaggccgtcaagcgcgtcgcgccagcgggcctcgcgccagccccagtcgccgtccagctcgcccagccccgcctcgtcccgcacggcggcgagcctcacgcggcgccagagggcgttgcgaaccagcagcgtcacggccctgcggtcgcgcaccaccacgtccgcgtccggcgcggcgagctcggcgcccgcaccctcgtccgtctcggcctgcgaccactcgtccaccagcgaggagtcaacggtgcgcaccacgagccccagccagtgcacgatgtcctgcaggcgctcgtccagcttgtcggcggggaccgtgcgatcgagcacgcggtaggcgtcgctcaggtagcgcagcagcgtcccctcgctccgggcgatgccgtagcgtgccacgtagcccttgaagtcgctggcggtctcgaccatgtcgcgcaggacgctcttgggcgagagctcgaagtcgcttgcccagggcaccttctcgcagtactgggcaaaggccgcctggagcagctcctccagcggcttggggtaggtgacctcctggatgcggtcgatcctctcgtcgtagtccacgccgtcggccttcatctgcgccatggcgcggtccctcgcctggcgctcctgcacgcgcaggatctggcgcgggtcctcgagcgtggcctcgaccatgctgatcacgtcgagcgcgtaggtgtcgctctcgcggtccagcagctccagtgccgcaaggaggaagggcgagaggggctggtccagggcgaagtcctccggcaggtcgacggtcaggccgtactcaacggtcgtctcgccgccctccccctcaacttcgcgcctctcgaccacgccggcgtcgatgagggtggcgaagatctcgtcggcacgggtcaccaggcggagcttctgctcgtcggtctggttggagtcgtcgatcagccgcatgacgcggtcgtgggcgtcgccgccctgctccacctccgagaggaccatggagtgcgtgaccttcatgtgggggtgcagcgtctcgggcgccgcctcgatgaggtgctggaaggtctgctcgttccagccgacgaagcccgcgggcggcttcttggtcttgatgctccgggccttcttggggtcgccgcccgcctttgcgagggcgcgggccttctcgatgtcgtagacggtcgcctgggcgatgaccaggccctcggtgtcaaagccggagcggccggcgcgaccggcgatctggtggaactcgcgcgcgttgaggcggcgctgcctcctgccgtcgaacttggtgagcgaggtcagcagcacggtgtggatgggcacgttgatgcccacgcccagcgtgtcggtgccgcagatcacggggagcagcccctgctgcgcgagcttctccaccagcaggcggtagcgggggagcatgccggcgtggtggacgcccacgccctgcagcagcagcctccgcaatgtcttgccaaaggtggtggtgaagcgggtcccggcgaccgccgccttgatggcgtcgcgctgctcgcgggtgctcacgccgtagcttgcgagcgactgggcgctggcgagggcactgtcctgggcaaagtggacgatgtagacgggcgcgtcgccgtcgttgagggcgcgctcgaccgtggcctccaggcccgtctccacaaactcgtacgagaggggcacggggcgcggggcgtcgaggatgcggtccacggggcggccggtgtggagctccaatgactcggcgatctgcgtgacgtcgcccagtgtggcgctcatgagcaggaactgcacgtgggggagggtgaggaggggcacctgccaggcccagccgcggtcgcggtcgccgtagaagtggaactcgtccatggcgacgcagcccacgtcggctcgctcgccctcggcgagggcgaggttggccaggatctcggcggtgcagcacacgaccggggcctgcgggtttattgtcacatcgcccgtgatcatgcccacgttgtcgcgcccgagcacgtccaccatctcgaagaacttctcgctcaccagcgccttgatgggggccgtgtagtagctgcggcggtcggtgcacatggcgatgaagcacatgcccagggccacgagcgacttgcccgagcccgtgggggtccccaggatcacgttgtccccggcggccaggtcgaggagcgcctcctcctggtggccccagggggtgatcccgtggctctcgacccagcccaggaagagctccagggcgtcctcgggcgggatgttgggaaagtgctcgtcgtcgggccaggggaccagctgccccagtgagacgtccccctccccgcgtgcctcgtccgtctcgcctgccgcgtcgcgcgcgtcgatgtctgccatggccctcccgcctgcctcgctttcagggactgagtatagccgttgggcatcccccgccccacgcgtggggcgggttgcgctggcgtgtcatggcgtgcgttccggctaacgggagaggccctgccgcctgagctcgcgggccagccacttggggttgttcgcgatggcgcgccccacgcccaccaggtcgcatgcgcctccgcggacgaggtcctgcgcctgggccagggtgcgcacgcctcccgcaagcatcacggggacgccgaccgccgcacgcaccgcacgggaggcgtcggcaaaccagcctggctcgtcatgccccacgcgggagtagtagcacatgccgccggagacgctcagcaggtcggcaccgcgggcctcgcaccagcgggcaacctgcacgccctcgtcgatcgagagccctcccggcaggtagtcgcacgcgccgaggcggaccgagagcgccatccccgacccaagctcccggcgcacggcctccaccacgcggagcagcaggtgggcccttccctccaggccgccgccccagcggtcggcgcgatggttcgtgaggggagagaggaactggtcgagcaggtagccgtgggccgcgtgaacctccacgccatcgaatcccgccagccgcgcgcgggcggcggcgcgggcgaagtcggccacgaccctctccacctcccgctcggtcatggcatgggggagctcgtggccgggcttggcacccgggcaggcgacggcgctcgccgcgagcgtgggctggcccgtcaggcgcgaggacgccgccgaaccggcatggctcagctgcaggaacgccctggccccgctcgcgtggaccacgtccgcctcgcgggagaggccctccgtgtcactgtcgcggcttgcggacggctggcccggcgtcgccctgccctcggggctcacgtagtggtgctccagagtcacgagcgagagcacgcccggggcgccgccctgcaggaggcgccggtcgcgggcgagcagttcctcggtgacctcgccactgcgcgacgccctcccgcacgccatgggcggaatcgccagcctgccgtggagggtgacggggccaaccgtcacgtcgtccgtgagcgagggggtccggctgccctcggtgggggtgacgggcatggggtcgttggcctcgggcgccttggccgagaggggcgtggcgccggggatcgtgacctcctgccatgccgtgggcctctccgccgagtgcgccgttacctctcgccccgccttgcgcgacggcgctccaccctcgggcgcaatggcccccggctgccggggagctatccctcgtccgggcacgtgccgccgcccctgagctcgtcgcggaccacgtcgtggaggatcctctccgcctcggccatcgcctcgcggtcgcccgagttccgcgccgcccgatacgcgttcatcgcctggaagaacgggccctgcaggtcctccgcatcggggtcgcccccctgggcgtcggaatcctggccggccatgtggccaaaggtctggggagagacccgctcgtccctctccgccgcgtccccatccgggccgtccgggaaggccgtcctcctcccgctggcctcgaggtccctcctcaggcgctcggcaagctcctcgtcgctctcgtccatcgtgtctcctctcggcatgcgcctccgcaggcctcgtcgatctgccgcccttgagactactcctgttcccgtgtgcccggcgaatgcgtcccgccgccactcccgttccaagggtcgctgcatgggccgcccgccttgggggacaatgaacttgtcaggaaggttgcaggtttgcgcggaggcatccgccaggtcaagggggagaggctcatggttgcaggctcgcgggtgaaggcactggcaggcacggtcgccgcggcggctacggtggcggcgctcctctccgggtgctcggcgggcaccggcagcacggacgcggcgagcgactcgggcgtggtcgtcaccgacccgtcggcatccgactctaaggcgaccaaggcggactcggccccgtcgtccacctccgcgaaggcggactccaaggcggactccgccgccggctccggctcgtcgcaggagagtgccgcgcacgacgtcgagctcgactcatactcgttcgacctccccgcctactggaagggcaaggtcgacgtggaggtcaacggcgacgaggcgacgatctacgccaaggacgtgcatgaccaggggcgtctcatgaccctcacctacgtcgacgagacggagccgcaggtcgctggtgacatcgccaaccacctggtcgcctacttccgctgcggcagcggcaccgtggaggtgtggaccaccaacttcccgtacctcatcaagtccgactccctccccgactctgtctccaaatcccttcccggtctgagcgacgagtccgctgcgaccctcgtggacctctccaccggcggccagcttagctacgacgacgtgaaggccgccgcgagcgtcgacgacatctcgatggcggagtacaactacaccaagaccgccatcacgggcgtgtatcccaagtagcgggcgagacggactgcggtaaccggctgcgcacggcccgcggcgggccagaggggaggcgaaggcgcaggtgagggtcctcatggtgatggaccagttcctcggtgccaacaacggcaccaccatcacgtcggagcgctttgcccgcgagctcgcccgcaacggccacgaggtccgcgtggtctgcaaggcggatcccgactccgccgcccgcgcccctctcggcgtctatccccagggggagctgcgctatcccttgatacagcacctcatcgacgagcagggcatggcctttgcgcgcccggacgacgtctcgctgcgcgaggccctcgcctggtgcgacgtggtccacctgctcatgccgtcggacctcacgtaccatgccgtgcggatcgcgcgcgagatgggcgtccccgcaaccgcggcgttccacgtccagccccagaacctctccagctccatccacctggggaagttcgcacctctcaacgacctcatcttccggctgttccggaggtacctgtaccagtacgtggaccacgtccagtgtccgagcatgatgatcgcccggcagctggttgaccacggctacaccaacgcgctgcacgtgatcagcaacggcatcgacgactcgtacgcgtaccggcgcatccccaaggacccctcgctccgtggtcggctcgtggtgacgatggtcggccgctactcggtggagaagcggcaggacgtcgtggtccgcgccatcgcccgctcccgccatcgcgccacgatcgtgctggtcctcgcggggcagggccccaccgagcgccgcctgcgccgccttgccgattcgctgggggtcgatgtccgctttgggttcctctcccaggcgcgactccatgacctgctctcgatgaccgacctgtacgtgcatgcctctgacatggagacagaggccatgagctgcatggaggcctttgccaccgggttggtccccgtgatcgccaattcgcccctctccgccacgccacagttcgccctgtgcgatcgctccctgttcagggcgggtgaccccacgagcctcgccgagcaggtggactggtggctcgagcacccggacgagcgcgatcgcatgggccaggagtacgcaaggctcgcggagcgctaccgggtgggcacctgcgtcagccggttcgagcgcatgctccgccaggcgattgacgacgcgcgcgccggcaggaccccaacgcccgggatcgtcgacgagatggccacctccccgtcgccatcccagcaggggatggaaggcgacgacgatgtctgaccgggcaggggagaggggcgtggcatccggcagcggcccctcccgccggtcccaggtgaaccccctccacgtgagcgagctcgagcccgagcacgttgtcgagatgccgcactggggtaccttctcgaccccgctggggtacgactacctgcgccgcggaaggtcgcaggtcgtgggataccacgtgttccgcgtcatcctcgatgtggtcgccttcgtggtgacgcacctgttcctggggttcaggctgcgtgggcgcgagaacgtgcgtgccctgcgcggcggcttcgtgagcgtgtgcaaccacgtccagacgctcgactgcggcatggtcctccaggcgctgcgggggcaccgcgtctatctcctcagcatcgagagcaacttctccatcgcgctctccgggcagttcgtgcgctggggcggcgcggtcccgctctcgcccaaccaccgtcagctccacgagctcgtgatggccatgggggacgcgctcgagcacggggacgtggtccacgtgtaccccgagacggcgctggtgccgtaccaccgcgacctgcgccccttcgccaccggggccttcaacctcgccgcgcgaaaccacgtgcccgtgctccccatggtgatcatccagcgtgagcgcagggggctctggcgcgtcctcaagcgcaagccgtgtctcacgctcacgtgtctgcccgccatctacccggatgagtcgctggggagggtcgacgccacctacgacctcgccgagcgctgctggcaggccatggatgccgccttgcgagagggtgccgacgagggctgagcgggcgagtctcgtaaggattgacgcgtttagactggtcctaaacgcgtcaaatcttattggatgcgacgttccgtaaagattgacgcggttagaccgaccctaaacgcgtcaatccttacgagccgcagccaaaccagccttggcataagtgttcgtccctgccagtcttcgttcgaccaggagaccgagggccaggcggcctggatgggcgacggcatgccgtgggagacgattgtgctgctgcggtggccctccccgcggggaaggagttctgagaagggggtcacagcgattcgccgcacatgaggatgggccggcttgcccggaaggcgaacgacctaccccattcttagcccatcgattccccttctttgccgtcgcgaggtggccgggcctgcctcggctccatatccttagggctcaaccgccgcggcgccttcgtggcgcaaacaggttggcgccactcgacgtccccatcgcctccggaactacagccagacagcgactgaccccaaaacgcaggcgcccctcccgtggaccgtccggtcgggggaggggcgcctgtcgtcgcgtcgttctttttccgtgcctagagcttgatctgcgcgtacacggtctgatagtcgaccttgggcttgacgtcggtctgcccgtcgtcagtgttctcggtcttgggctcaaggatgttgtccgtgtagtactgcgggtagttgtaccagaggtcgcgcttccacagctcggttacgatggatatgcggtcagagaggtcctggtagcactgcagcacctgctggtaggtggcgtagtacttggagctggagtccacggtggtggactgtgccgcctgcagcgcctggttcaccgtgtcggcgagcgtggaggcggcgtcggagttggactggcgctcgtccttgtcgttgaggtaggtgctgtcaaaggtagactccgcggcactcacctgcttgtcgaggtctgcaagcttgtcgtacaggctcttcaccgtctgctttgcctgcttgtcggcatcgctctcggtgctcgccgagtcggcggagtcggacgagccggccgacgcggagtccgccaccgccgtgctgtcgctgtccgccccaatcttggtcaggtcaggctttgccaccttgtcgcttgcggagaagcacccgtgcatgatgagggcgagaaggaccacgaccacaatcgcggcgattcccaggatcttcatgagcttgcggttgtcggacgtctcccagtcgtcgcccgagtggcgcgagacgtacgcgtgcccctgcgggaccacggggtggatggggttctcgctgatgtagccctcgcccgtcaccaggtgctcgggctgctcgggctccgtggcatgggtgggggagacgtgctgcgcgtggctgggatgcccctcgatgggcgcctcgtcgcccacgtgctcctcgctcatcgcctcggctgcctcgcgcgccctctcgctcgcctcgtgcacggcctccgcgtcgatgatgcgggtgggctcgctcgagagctcgtctcccgcggcctgccccgcctcgagcctctcgccctcggcacggatggcctccacctcgtcttcgctcagccagtgctcgagcctctcgccgcagctcatgcagaacagctggccgggcttgaggggcgcaccgcagtggggacaaaacttctttgaggtcatggcgactccggttcttacgaaagtgcgactcggtcgcatatgtacccccactatacgtgacgctgaatgtggccgcaaagcgcgttttcctcccacacaaccggcacggccgccgatttgccccgtcagtcgggttcccgtcgggccacccgccgaatgcccccggggacggtgcacctgccccgtatactcttgccaaggttacgttcaggaacgtttggaagaaggaggcaccaacaatgcacaagggtacgggttggcttgccgcggtcgtcgccctggtgaccgcgatggcggctccggcaacggcgctcgccgcgcaggacatgtaccggctctacaaccccaactcgggggagcacttctacaccgcgaacgtggcggagagggactcgctcaggcgggtgggttagcgctacgagcaggttggctgggtcgcgcccgaccactcggcgactcccgtctaccgcctgtataaccccaacgcgggcgaccaccactacaccatgaactccaacgagaaggacatgctggtcaacgccggctggagattcgagggaattggctggtactcggacgacgctcataccgtgacgatgttccgccagtacaaccccaacgcgcgctcggggtcgcacaactacaccaccaacggatcggagagggactggctcgtctcactaggttggcgtgacgagggcctcgcctggtacgcgcttggtccgggaagggccgaccccaacgcggacaagcccgctccgagcaaccccggaaccggcggcggatcctcatcgcagggtggcggcagcacggtcacgggcatggtgtgggttaccaaacatggtaagaggtatcaccgctccccaaactgcccaaccctcaatggatccagcaacctcacatcggaaccagaatctgtcgcattgtcgcaaggtctcacgccttgcaaggtttgctggcactaggattcaagtcttcaaataatgggagcgggggacgcgcgatggcacgtcccccgctccctctctgtgaccacctggcgaggccaccgcccatcttctcacgctcatctcaccttgcgcgatttcctcggcgagaggggagaggcccgtgcgcccctactcgcagatcttgcagggagtgaggccgcgtgcctcggcgtcgcccagcgtggtctcggtgaccgtcttggcgttcctgagtccgcggcagtttggcgtggagtggtagcgcttgcctgacttggtcacgtatacgatctggcccttgtcctcgcccgccgagggtgccgcggtgggtgtcgccgactgcccgcttgcgccagaggatgccgacccggacccagacgtcgtgcctcccgtctccacctgggcatcctcgccgaccgcggttatgcttcccgtggagtagtcgatctggaaccccttggcggcgttgtagacctcgacctcctcgttgatgatgccgtcgctcgagagcacgtccacaaagacggaccgggggatcagctcgcccccctcgtacacgggcgtcgccacgtacatgaccgtggtgtcgggatgctggcggagcagggcccgcacggcagcctcggtcatctccatgccaccctggtcgttgtttgcgcccacgttctgcatgcgcgtgccggtcaccaggttgtggagctccgcgtcgcccccgagcgacttggccagcaggtgcgagcggttccagaaccagccgtggtacaggcggccgttggggagctcgatctgcaccttctcgttgttgccccatcccgcggggtcgggaaggtcacccctctcgctcgccgttccctcgtccatcatctgcttggtgacgcatgcggcaacctgtcccgcgcggcccagggagtcgagctgcgagtacctgacctcgcccgggctcagctgctgggctatgcgcgcgtcgcctacgtggcggacgtagttggggctctccgcctcgttccaggtggtgtaggcgtaggtgatgggctcctgggacgccgtctcctgcgccttgggctgcgaggccgccggctggtctcccgtcgcctgggagtccgccgcgggcttggagtccgcggagtccgtgctgggctcggactgcgaggcataggttggggtggattccgcctgggcgtctccgccgctttcgtcacacgccgagaggagcaggccactcgttgccaggcagcaggacaggagaatcgcccagaccaggctcgtcacccctccgtgccggtggaagcgcgtgcgtttgcattgtcgcggctctcgtgtgtccctcatggccgcccccgtttccgaagagattccgaggtttttgcaagctagctgcaagctagacgaacgatagcagagccgtggcgtcacgtcgcccagatgatgcgacggggcggtgacggggaactatcatggttgaatggcgcaatcgagggggctgcctgtcccggcgtgcgttgaggaggagggaagatgagcgagtctctcaagcggtattcggcggagttcgtgggaaccttcgtgctcgtgctctgcggctgcggggcgtggctcgagctgaaggcggtgggctacgttggggtcgcccttgccatcgggcttgccgcggctgccatgggctatgcgctggggcctgtctcgggcgcccatctcaaccccgcggtgtcgctggggatgtacctcgaccgccgcatcgacgcccgcgacctgtttggctactgggcgggacagttcctgggcgcgctcgcgggggcggcgatggtgttcctcctcgtggcgctgtccaacgtgggcgtcgcgacggcggccgacctgggctgcaacgggtttggcccccgctcaccggtgggcgtgtggctctttggtgccatccttgtggaggtcgccatcagctgcatcctgactctcgtggcgctgggatcgaccgagggacgcgggcgagagcagtcctccggcgttgcccgcggcgtcgccctggcgggtgtcaccatgttcgccgcaccgctcacccgcgcgtccgccaaccccgcgcggagctttgggccggcgctcatgatggccttcgtgggcgaccccgttccgctggcgcagctctgggtcttcatcgtggcgccgttcgtgggggcctcccttgccgccgccatccacggcttcctcaagccgggggccaagcccattaagaagtagccacgtactctccgtcaggggagagaagaggggccccggagccgcggcatctgcccatggctccggggcccctcgcctcgtgcggaccacgctactcgtacaggtgctcgctgaagtagcggtcgcctcggtcggggaagagggtcacgaccgtgccgtggtcaatcctctccgcaacccgcagcgcggcggacagcgccgcaccggaggaggagcccgcgaacacgccctccttccgcgcaagctcgcgcgaggcgccgtacgcctggtcgtcgttcaccttgatgacctcgtcgaccagtcccatgtccatggtgtccgccacaaagtcgttgccaatgccctcgatcgcgtaggcggcgtgctctccgccgcccatcgtggagccaacggggtctgccagcacgccccgaatgctcgggtccctctccttgaggtagcgcatgatgccggtgaacgtgccgcccgagccggcgcccgccacgaagtagtcgatgtgtccgcccaggtcgcgccagatctctggggcggtgctctcgtagtgcgcctgggggtttgcctggttcttgaactggcgcagcgcgacggagctgggaatctggcccagcagctcctccatcttggcctgcgcccccagcatcccgtcctcctcgggcgtgtggacgatgctcgcccccagcgcgcgcatcagggtctgcttctcctcgctgaacttgccgggaaccacgaacacgaccttgtagcccttgcccagcgcggcgaaggctatgcccagtcccatgtttccggccgttgcctccacgatcgtggagccgggcttgaggaggccgcgctcctcggcgtcacgcaccatccacacgcctgtgcggtccttcacggaccccgccgggttcatgagctcgagcttggcgaacagctcgacctcgggcttgacgcccatctcgttgatcttgagcatgggggtgttccccacgagctctcccatcgagtcaaagtagtggcgtatccctagtcctcccttgccgccgcgattgcctgctcaatgtccgcgaggatgtcgcttgcgtcctcgattcccaccgacaggcggatgagcccgtcggtgatccccacgcggtcacgctcctccttgggtatggccgcgtgcgtcatggttgcggggtggcacaccagcgactccacgccgcccaggctctccgccagcgcgacgaggcgcgtggaggcgaggaacctgtgcgcgtcgtagccgtccgcgagctcaaagctcaccatggcgcccgcgcccgacgcctggaggcggttgacctcgtagccggggaagtcgggcaggccggggtagtacacgcgcgcaaccgcgtcgttctcctccagcgcacgcgcgacgacgcccgcgttgtgcaggtgacggtccatgcggacgcccagcgtctttatcccgcggatgagaaggaacgagtcaaacggccccagcaccccgccggtggcgttctggacgaaggccaggcgctcggcaagctcctccgtcgccaccacggcgagtccggcgaccacgtcggagtgcccgcccaggtacttggtggcgctgtggaccaccacgtccgccccaagctccagcggcctctgcaggtagggcgtcatgaaggtgttgtccacgatggagaggagcccgtgctcgtgggcgatgcgcgagacccccctgaggtcggtgatggtcatcagggggttggcggggctctccaccagcgtcgcgcgggtgttggggccgatggccgcctcaaggtttgccgggtcgctcgtgtccaccacgcgaaacgtgagcccaaagtggtcgaacacctggttgaggacgcggtaggtgcccccgtacacgttggtggggatgatgacctcgtcgcccttggagaggaggctcagcaccgcggtgatcgctgccatgccgctcgcgaacgcgaaccccgcgtagcctccctcgaggtcggcgatcaggcgctcgagggccgctcgcgttgggttgcccgtgcgcgagtactcccagccccggttcttgcccacgccgtcctgctggtacgttgaggtctggtagatggggatgttgaccgcgcccgtgacggggtcggtggtcgcccccgcgtggatcaggcgggtggcaaacgacggggtgggctgctggctctgctgtggcatgctgttcccttctcccgccccgtggcgacgcatgggcgttcgctctcccgcaggggagacatgacccatggcacctcccacgggggaggcggactcttctctcaacttgttgcgcgtcaaattgccccgtttggcggggccacccatgtggtggggggagacgggcgcaggcgtgcgccttggtgccctacgcgatgctgcgggagcggagcgaggcactcgtcaccccaggggtgtcaggcacaacaggcacgcacccagtgaaccagcagtgcctttgcatgcgagctcgtgcgtgctgccgtcgccctcacctcccgttcgccctcgatacaaaccctagtgaacaactaggatatatgctttatacggcgagggagaggggctgtcaacgcggatttccaccgagtcatccgttggaaacaaaggggtggccgggacgggaggggggatcgggggatgcctcggcaggctaggtcgtacaaagtcgagagcagccgcccacggctagggatagtcaaagaggcaaagaaggggtttgtgtgtttgatagcgtcttatttgcgggtttgagcgtcggaaagtttcgggtctgagcacgaaaaaattactggttcgtgcatgggcacgccgaccatcccgcgattggcccaacatgtcgttgcttccggttttacgacgtgaggaaagggccagcagaggggaaatgagcggcacgtggacaagatagaggaggaatacgcagggggcgcggcagacctctaaagctagttttcgccagggtagtcatagaagtcatccgacggggtaagagaaagtggcgagccgattgcgggcgatcggagggcagtcggcgtgtcggagcccatgcgaggggaagtacgccaggatggacgacctgtcgcccgagcccccgagaggaggaggaagcccgaggagcgaggtgcgccccctacgaggggacgatagactcctggctcgacgacacgactgcaggactggcgcaagcagcgccacacggccggggggtgtgtgtatgtgaggcttcgggacgagctgggctacgacggctcatactctcaaacgtgcagcgctacgtcagggcgccgccagcgaggagatggacggggagcgtgaccgcaggggcgcgagggcttcttacgctgagctggctgcccggcgaggtccaggtcgattcggggagggacttcagggtgcgtggcgtcctcaccaggggcaagagcctgaccgtaaactgcccgactccaaacgtggggctcaccaggtgttctggggcgagacgtccgagtggcgtctgccaggggctccgcaacgtgttagagttgcgcggcgggggcgcccggttcgacgtgacgaggagggccagtttgaaagcaaccgaggggtcacgcaggctgcgtcggggcgagagggtcaggctctcggagctttccggcgcttcgcggcgccaatacgggctcgactacaccttccccaacccccgctcgggcaacggaagggcaagtcgagaaaaaaggtgggtgacacaggaggaacctcttcgtgcccgtcccgtcgttccccgacgtctccgcgttcaaaccgcggctgctcgcgggactgcctcgacctctcagcgcgggcaagcgccatacaggccggcacgccgagctcgcgctgttcggggaggacaaagacgcgctctcgccgctgccgccggcccgcgttctcgtgcgtgaggtgggagaccaggacgtgcaacaaaaagcagggcaccttcaccgtagcggcccacacgtactcggccgggcccgcctacgcgcgccgccgggtcgacgtcgccatgggcgccttcgaagtcacggtctgcgacgctcgaccgggaggggagtggtcgcacaactacgagagcgagtggggcagggccccagaccgacagctccgtccgatcattgcatgacaggtgcgataaggcacgacgggcggagggaccgcgggtctggaggggactagaggggccggggcgtaggcctcgccctctgccggcggagctctgtcgttcctggaattctgcggttgagcgacggttagttgctcgcgccggaaggtgtgatgtatggatgatgggtggttgtgctgcggcgaaggatgttgtgagtcgcacaagagcgcgtttggggtgttgtgtgctgggtggaaacagaagt
